United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 12

SEQ ID NO: 324 - DNA, 152140 bp, Homo sapiens
aattagctaaagataaaaaggaaggggaaattcccgtggaagggaagacattaaaaggcacagaggctagaaagagcatggtaatgaaaaaatgctcatcatcactggccatcagagaaatgcaaatcaaaaccacaatgagataccatctgacaccagttagaatggcaatcattaaaaagtcaggaaacaacaggtgctggagaggatgtggagaaacaggaacacttttacactgttggtgggactgtaaactggttcaaccattgtggaagacagtgtgatgattcctcagggatctagaactagaaatactatatgacccagctatcccattactgggtatatgcccaaaggattataaatcatgctgctataaagacacatgcacacgtatgtttattaaggcactattcacaatagcaaagactaggaaccaacccaagtgtccaacaatgatagactggattaagaaaatgtggcacatatacatcatggaatactatgcagccataaaaaggatgagttcatgtcctttgtagggacatggatgaagctggaaaccatcattctcagcaaactaacgcaaggacaaaaaaccaaacatcgcatgttcttactcacagatgggaattgaacaatgagaacacttggacacaggaagggggacatcacacaccgggtcctgtcatgggatgcggggaggggggagggatagcattaggagatatacctgatgtaaatgatgagttaatgggtgcagcacaccaacatggcacatgtatacatatgtaacaaacctgcatattgtgcacatgtaccctagaacttaaagtataataaaaaaactatatatatatatatatatatatatatataaaagaaaaaaaaagaaagagcatggttattttaaggacctacagttatgcccaagagcaaagtgtgtgaagaagggaagacgagggaagagaggggagaggtgaacagaggtttgacaggctatgcagtgtggagtttcttttaaaaaaccatggagagtcaaaacatttcaaacaggacaacaatgcagccagatttatgtattagaaggagctctctgacactggtgcagagaaatgactggcagagaggcccattagggagggatctgctttagtaaacagacagtaaattaatgaggcctttaactgaggcagagagtgtggtgaggaagggttgaactagagaggcttcacaatgtcaaactgataggactcattaaacatgaggttcaggaaaccagatgtcagggatgattcacagcttgattgcttgggaagctgagtagaagatggtgatattcactgagatcagagatgaaagaattcccaggtttcagggaagttgatgagtttagtattaagcatactggcttaattccccctggtacttagggcacgtactatcttggataaatttaattaagacagactctttggtcagtagaaatttctatctcagatcttgagcaagatggaaaaaagcttttgaaacagattttatcagctctaaaagtataatatctttccaaactgtctcccagaactccccataatgacttctcccttgcatagagggcaaggaggcgaacaaaaatggatagcattttatttgaagataagttagctgtctaggattagctatttgcgtgatactatcttaactttaacagcactttgacttttagaattcatgttttttcaggtcaatttacagacctgctaattttttaaaaacaattctgaatttatatacaatccatagtttatcaaacatattacattcttctgcacgtggctatccagttatcccaacacaatttattgaagagactattaaactcaccaatagaaggaaacacatattccccaactttttccccgtgccttcatgtataaggattttgaacagagtccaatatctggatgagtgttggtttacaaaagtattttagctcaatgaggacagtgagcacccattatggagatatggcctgtaaaatggcattttgttttaaagtctctcacagtgatgggaagagaaagcaaagtttaaaagtgagcggtcctcttttatctcactgttagttctaattgaatattaaaccatttaaagattaatttaatatatctcaaaagttgagttttggtttcttgtgagacgggcatgtaggtgaccagatataccagtgtttcccaagacagagatttaattcagagatacaggtgtagaattcacatgcatatacctgttaactaatgctgtaagtgtggacactgaaaaaaaaatgccaatgacttaagcttggagaaaactaacatttattttctccatggaagaaaaaggatttcatgaaagagaaaacaaaaaataacaagaaaaacaggaaagagcccgatttaaaaagccaagtgaaaaatggcttttaagtgaaaataattggccagtattttcatatgtttgggaaaatatatgtaaagctatagatctaatagatatattccttctctctcatacacatgttttttctggtacttttaaaatcccaaattttattttggcgtaatatatgaggtacagatgtaattgattttttaaaatggctaccaaattcacctaataagtcatctttcctcactaatttaaaatgccgtctttatcattcattcagtgtgcactgaccttctacttatagcctcataccacaggattttaatgtcattacattaagctattattaaacctttacaatacattttaacacttggtaggcaagtgattccttatttttataacgatgccaagaatacacaaaaatagtctcttcaataaaattgtgttgggacaactggatagccacatgcagagaataaaattaggcccttattttatataaaaatcaactcaaaatggatttgagacttaaacgtaagaatggaaactgaaactactagaatataaatggaaaaagctttttttcccacattttccctgattatttttgcttactttgtttctgtatatatgttctaaaatcagcttcctagtttccaaaatacgattggaattgtattaagattaccttaagtgtataggctacactatctcaggagacaacagttctgataaaactatggtttgctatttttctccttcgcaaactgcactaggagcaggttggagaaactgagttgtaaatgaaaacccactaccagtagctccccttcactatctagatctccagctctaagaaagatggcatgaactaaggctgtgtatagggtagatgtgaaatcgaggttccggtggagagggaagtgtagtctcctttttgttaagaaagaaacaaaaccccaaacttacttgcccaatatcttaggccctgaaacaccaggataattaggtgcccaaaaattcataatcattattttttattcctcctaactgcaattttgcatcctttcaccaacatctccccaatacccatttcccctcccccagtcccttgtaatcaccattctctctacttctatgatttcaactttttcagattccacagacaagtgagaccatgtggtgtttgtctttctgtgtttggctatttcacataacataatgtcctctaggttcatttatattatcccaaatcacaggattttcttctttttaaaggctgaatagtatcccattgtgtatatatatacacacacacatatatatgtgtgtatatatatatatatatatatatatatagtaccacatttttgttatttatttatctagtcatgaatatgtaggttgattccatactttggttattgtgaataatgctgtagtgaacatgggaatacagatatctctttgacatactgattcatactgattacatttcctttgaatatatatccagtagtgggattgctctattatatggtagttttctttttagatttctggtaaacctccccactgctttccataatggctgtactaatttacattcccactaacagtatacagggttcccttctgtccacatcctcaccaacacctgttacctttcatctttttgaaaatagccattctaactggagtgagataatatttcattgtggttttgatttgtatttccctgataattaatgattttaagcatgttttcatatacctgttggccatttgtatgtcttttaagaaatgtctattcaaatccttttcccacttttctttaagtgaatgaggtcttgctatgttgcccatgctggccttgaacgcctaggctcagcatcccgagtagctgggactaaaggggtgtgccactgtgcttgacttctttgcccattttaaaattgggttatttgtctttttttttttttttgctattgaattgtctgaattccttatatattttggatattaacctcatcaggtgtatggtttgcaaatattttctcccattctgtagatagtgcctttactctgttgattgtttcctttgctgtgcagaggctcttctgtttaatgtaatctcattggtctatttttgctttttattgcctgtgcttttggggtcacatccaaaaaatcattgcccagaccaatgtcataaagctttttccctatatattctagcagttttagtttccattcttacatttaagtctcgaatccactttgagttgatttttacataaaataagggcctaattttattcttctgcatgtggctatccagttgtcccaaaacaatttattgaagagactatttttgtgtattcttggcattgttattaaaaatcacttgatcataaaggcagagatttatttctagtttctgtattctgttccattagtctatatgtgtgtttctatgccagtactatagctttatattatacagtcatttatcacttaacatcagggatatgttctgagaaatgcatccatagttcattttgttattgtgtgaacatcatagagtatacttacagaaaccttgatggtatagcccactgcacacctaggctgtatggatagcctattgcccgtaggctacaaacctgtcagcatgttactacactgaatactgtaggcaattgtagcacaatggtacgtatttgtgtatctaaacatagaaaacatacagtaaaaatacagtataaaagataaaaatggtacacctgcattgggcacttaccatgaacgaagatttcagcactgaagtttgctctgggtaagtcagtgagtgagtgatgtgtgaatgtgaaggcctaggacattactgtacactgctgtaaactttataaatactgtacacttagactacgctaaatttatttttaaaatatttttctttctttaataataaattaaccttagcttaccacaactattttattttataaacttttaaaatttgtaatctttttgactcttttgtaataatactctgtttgaaacacaaatatattgtacagttatacaaaaatagtttttcttcatatccttaagctcttttctatcttaaaattttatttttattttttactttctaaactttttttgttaaacactaagacaaaaacacacaatagccttggcctacacagggtcaggatcaaaacatcactgcctttcaacagcttgtcctactggaaggtcctcaggggcaataacacacatggagctgccatctcctatggtaacaatgtattcttctagaatacctgcctgaggctgttttacaatcaattttttatttatttttattttttatgtttttaaataagtacagggtatacacagtaaaataataataaaaatatagtacattaaaaaaaccagcaacatggtcatttattatcattatcaactattatgtactctacataattgtatgtgcttttttattcaaaaagaaaatcattaagaacacagcaatattaatatttattcttttttttagaagaacctgatttatttatttaatttttttattatactttaagttctgggatacatgtgcaaaacgtgtaggtttgttacacaggtatacatgtgccatggtggtttgctgtatccatcaacccatcatctacattaggcatttctcctaatgctatccctcccctagccccccaccccttgacaggccccagtatgtgattctcccctccctgtgtccatgtgttctcattgttagctcccacttatgagtgagaacatgtggtgtttggttttctgttcctgtattagtttgctgagaatgatggtttccagcttcatccatgtccctgcaaaggatataaactcattgttttttatggctgcatagtattccgtagtgtatatgtgccacattttctttatctagtctatcattgattggcatttgggttggttccaagtctttgccattgtgaatagtgctgaaataaacatatatgtgcatgtgtctttatagtagaatgatttatagtcctttgggtatatacccagtaatgagattgctgggtcaaatggtatttctggttctaatccttgaagaattgccacactgtctcccacaatggttgaactaatttacactcccacaaacagtgtaaaagcattcctatttttccacattctctccagcatcggttgcttcctgactttttaatgattgccactctaacaggcatgagatggtatctcattgtggttttgatttgcatttctctaatgaccaataatgatgagctttatttcatatgtttgttggctgcataaatgtcttattttgagaagtgtctgttcatatccttcgcccactttttgatggggttgtttgtttttttcttgtaaatttgtttaagttctttgtagattctggatattagccctttgtcagatggatagattgcaaaaattttctcccactctgtaggttgcctgctcactctaatgatagttccttttgctgagcagatggtctttagtttaattaggtcccatttgtcaattttgacttttgttgccattgcttttggggttttagtcatgaagtctttgcccatgcctatgtcctgaatggtattgcctaggttttcttctagggtttttatggttttaggttttacatttaagtatttaatccatcttgagttaatttttgtatgagatataaggaaggggtccagttccagttttccgcatatggctagccagttttcccaacaccatttattaaatagggaatcctttccctactgcttgtttttgtcaggtttgtcaaagatcagatggttgtagatgtgtggcattatttcttaggcctctgttctgttccattggtctatatatctgttttggtaccagtaccatgctgttttggcaaaccaggaagaagctgaatccctgaatataccaataagaagttctgaaattgaggcagtaattaatagcctaccgagcaaaaaaaaaaaaaaaaaaaaaaaaatccaggaccagacggattcacagccgaattctaccagaggtacaaagaggagctggtaccattccttctgaaactattccaatcaatagaaaaagagggaatcctctctaactaattttatgagtccagcatcatcctgataccaaaacctggcagaggcacaaccaaaaacagaaaatttcaggccaatatccctgatgaatattgatgtgaaaattctcaataaaatactggcaaactgaatccaacagcacatcaaaaagcttacccaccacgatcaagttggcttcatccctgggatgcaaggctggttaaacatatgcaaatcaataaatgtaatccatcacataaacagaaccagtgacaaaaaccacatgattatctcaatagatgcagaaaaggctttcaataaaatttaacacccctttatgctaaaaactctcaataaactaggtattgatggaacccatcgaaaaaaaatgagctatttatgacaaacccacagccaatgtcacactgaatgagaaaaagctggaagtattccctttgaaaactggcacgagacaaggatgccctctctcaccactcgtattcaacctactattggaagttctggccagggcaatcaggcaagagaaagaaataaagcgtattcaaataggaagagagaaagtcaaattgtctctgtttgcagatgacatgattgtatatttagaaaaccccatcatctcagccccaaatctccttaagctgataagcaacttcagcaaagtcccaggatacaaaatcaatgtgcaaagatcacaagattcctatataccaataacagacaaacagagagccaaatcatgagtgaactcccattcacaattgctacaaagagaataaaatacctaggaatccaacttacaagggatatgaaggacctcttcaaggagaactacaaaccactgctcaagggaataaaagaggacacaaataaatggaaaaacattccatgctcatgataggaagaatcaatattgtgaaaatggctgtactgcccaaggtaatttatagattcaatgctatccccatcaagctaccattgactttcttcacagaattagaaaaaactactttaaatttcatatggaaccaaaaaagagcccatatagccaaggcaatcctaagcaaaaagaacaaagctggcggcatcacactacctgactctaaagttctataaatgaactcacgaggccaaagaatgaagaagacaccaacacaaaggggaaaaaatcaaaacaatatggtcattgcaatggtagagatatgcacagtatattatggaaacccagagaagacaaacgtaacacagctttgggaagatatggaatttttctcccaggaggagaggatgatcaagctgagagatgtgtgaactgagtggaaaggaggggagtagtattccaagagaagcaaacagtatgagcaattcatggaggtaggaaagctgtatacagggaaccatcagcaggttgttgaataaaggaagctgaatgaggctgggcacagtagctcacgcctgcattcccagcactttgagaggccgaggtggaatcatcatttgaggccagcagtttgagaccagcctgggtaacatagcctgaccacatctctccaaaaaataaaaataaattagcctgctgtagtggcagtgcctgtagtcctagctactctgaaaggatcacttgagtccaggaggctgaggttgcagtgagctatgattaccccattgcactccagcctgggcaacagagcaagaccctgactctgaaaaaaaaaaaaaacaaaaaacaaaaacaggatcgtaaaagacaatactaacatacaacaaagcatgcagattccagtaaagcctgtcatattaggcagattaggcaggtttaaatatatttttatgtgatgatgagcccctaaaggcttttgagcaggagggactatctgaaaaaagatatagaatggttaagacccaagacagagagaaggtacaaggactatttggttgataaaatctgtaggaattggaatgggctgaatgtgggagtgggggtggggtgagagatggggaggactgaagactgaatagacccagatttctggtttgagtccgggagaggtggggtgctgaattcgaaggtcaggacacctatacctctgggaatacagcgatggttgcaaaaggcatctggtattgtccttctgccactgtcttaaaagggattctaaagggattttcttgcccttgttcctccagccctacacttgcattactggcctacgtggatgctcaccagctggctgtgtccatcattgcagccaagtctgagaattcctgattatacttagagcctgtggagctgctgacacaaacagtcattagcagacaacccttttgcaacaaagtatgctttaaaatgtaaactgtggagccattttccttgcgttgtccagaaggaacttcgtcctgcgtgagcctggattaatcatgagagagctcgtcaacattccactggtacatattcttactctggttgccttcagcggaactgagaaacttccaaaaggttggtttgagcaatcgtgtcttcttgttgtcttgtcatggttgtaaagtgtgtgtatatgagatatgaccaagactgatttatagtatggtgggcttgggttttacttgaagaagtaagggtgaaatgtatgatgagggaggaaattatatacataagcaattggttgatggtctctctaccaatattttactccgaagttctgcaataaaaggcttagccacatagtgcatgcagagctctgacttctagggcaaaacataagcatgtacactgcaagttatcaaggtctattttgtttatgcgaatgtcaaatttcagggtggtctaagtggatgatgacaaccttttcgcatcaggtttgccaggaatagaatcaaccccattctcagacatccagagcatttgcttctgaataaaaatcacttttattttcagttttagctttgccaaactcttaataaatattttagttgctaaaaattggaaatacagaaagacgtacacaatttgcctgtgtaacaaacccggaagacaatggattttaaataactttgaggctggagtcatgatttggcttggcaagagactgcaaaagtttttttcagagcctttggaatgtaccggaaataacaccacctcaggggaaaggaaagcaacttaagaaactgacaaacacctgttgcagtagcaagaatgtccagtgatatagtttctggccagtgtattatgaaactgggactagcgtatttgaaatcagaaagactggaaagtctgtgatttgcaaagtgactaagggtatcactgaaatctttttttaaaaagacatgagaaagcagatcgagtggtatcaatacaagagttttcaaatttaatgttataccatagagtaaaaagagatttttgcttcaggacatgttcaaattaatcattttccctttatattaatcaaagcactgaaacagtttgtattgtgtagataaatgaaggtggtatctgtatatagatgcaaaatgtatctttagattttctggttcactaaaaattctggagccataaggtcaaagttcacatgcaaataagatgcgggtttcttcacaaacaatctgatttcacagatttttttgtttcattttgttgcttctctttttccattttacttgagtataatggtatcttcaaatgtatttaaacatttaatttctaatgaatactttaaggcatctacagataaaagagactctagatcttttcaaacagctaataatagtcagaaagacttaacattggcttcagattattttaatacttcctgatcaaacaacggatgtccggtaaggccccacctggatgtttgaacgtatgggttgtcttaagtattatttgtatatttctaaaccacgcagttacataaaaatgatagggttaaatactaaaatacagtcttataaagagcaggacaattgattttgatgattcaaataaggatttgttgtacacacacacaaaacccccaaaatctctctatctgaataagtcttaatttatattctagaaagaattgattttcatttccaaactttacaaataaagcccttaattcaaatgcacactatctctattttgaaaatattgaaatatagtggcatagagataacaaagccaaacaccctgacttttaaataaactaaccagatcattcacccaatttcatttcttataatttatttactactagaattaggttttaaaatcaaaaaatttaagcaattttttctcagtctattgtactgtaaaatctaaattagtatgagtttaacatcactcttagccaaaataccatgtctaggagaacaaacatttatttactacatacagcagttctgagaataactaatatcatgaaagcataatccttaaaattttaaatgttgaagggtgaggaatacattggtagaaaagaaccacaataaaattttattattttcattattattattattatttgagacagagtctcgttctgttgccaggctgcagtgcagtggtgtgatctcagctcactgcaacctcctcctcccaggttcaagctatactcctgcctcagactcgcaaatacctgggactacaggtgcaagccaccacactcggctaatttttatatttttagtagagacagggtttcaccatgttggccaagatggtctccatctcttgacctcgtgatctgcctgcctcggcctcccaaagtgctgggattacaggcatgagccactgcgccagccattatactactgaaactaataaaaatggcccacccaaactatttctactatttctagaaaactactgttttccctattcttggcagacggtaataacaaaaagagttttttagataatatacttcttcctaagtcctttatcatgaatgcataaaggaaattgtacaatatgtattagctaataaattgacatatttaaaataacacaaaagtattcagtggattattttctgactttctgcacatcattttttgataaaaattaatatccaactttgtagaattaattgttcatagttttcattttagtttaattaaggctactaatgcccaatgataaggggaagaatcattgtctttctgaatcatttcaactagtgatattttcaatgatgaattcagtgccataacccaagtagtagaatttcacaaactgtcatttatgaaagtagccaatgttccactggataattggcttaactacatacatcaataacatttaatgctttattagggagtattaaatgtatggtgcaatgttagattctgcaggagcataagagttcatgtaagcagctctggatttgcttaatatgcacaaagaactatcaaaagtctcactttcaaaacacccgacttactacaatacgttgaagtgtttgagcgtacgtgattttatctttagatagatttgaataacctcctcttttaaattgtatgtatataaggataggattcacagatttgacatatgactaagtcatgactgacacagctgtcattgaaatccaggacacacagtcctggatgaatattttatattgacatgcattgaaagagttactcattgcatgtttgagtaaacagagttgcttcaaatattattgaccttaaagaaaagaaggaaggagcagaaatttcaagatctctttaaactctaccttatttccaaaggtaaatgaagtaggcagcttctcagtgaaataaaacctgatgtcgttgaaggagagtaacaagtgaggggtggaaagagggcctgaaaggagtggctctattcaggaagatgagaggatcacatgggccatgctgaagacccagctggggctaggaactgcagctttctttatagtgcccctgacctgaacatttactgcactatacccagcagtgctatgtgaacatagggtagggaggacagatggctggattaattcaggattggcactttccagggtcagtacagctaaagaactagagagtaaaggagttggagttatatggcagcgtaccatgagatacagattggatcaggaagaaagtaaaacaaggatatttaatgcttggaagagaaggttaaaaagtttaaaccaaccccaaagtgttttgttgtactaaaaaaaaaatactgcattcataatgttagagaaacatgaatattttccaagtcagagccctaattttactaaaatagaaaggagcaaatacaccttgtttctttatgtacccaatcattgggtcatgtcaatccaaaaataatcaatcaaaagttggtaagtcaatagtcatatgcgagagcccataaaatacaaaggaaaggtaatgtcatgtccttctcatcaagcagttgatatccaagtcaagcttttcttcgggtccagaaaaggattgtgttcattttcatgtatttgttattcatgtagtccttggattgagagaagaaatagtgccctagtttaaacgagctctggctgagatgaaagctggatagtagaatgaaagtaaacaagagacagtgtgctgagtcaacaaatatcattaaatacaactgatccatgtgattgtgtcagtgaaaaccggaaagcagatttggataactggaaatatggacaatgtggacttggcattctgtgtgtagaaactgatattgatgtacatcttctcttatccatctgtgcataatcagtatgatcttgaagatgcagtatgtcttagagaaaggaagtataaaccaactttaaccctgaagttcagctagttcagctctatcacttcctatttttgtgatatgtagacaagttgtgcaaccatttttagtccccatttctggtctgcaagtggaaatattaatagtatctaccttttttgtgttaaataaaaagataatgaataaaaagtataatgcatggcacataccagattcttaatcacttttagatgctaatattagtaaaaacagtcaaacttcacacaagactgttatgtcactgaatcttatgggaaggtgttaacttaataaagttcttagtaacaccttccatatttctccatgtctattttccaagacattctaagactcacttctttgatcttaactgatctcaacagttcatgtgacatctccagtgtgtcacctcattggaaagataacattaatagtaagtctattacctctgccacttctgcatctgtgtattgagtgaaaataacactagtgcataaagtttctctcttataaaagtagcacatggtatttaagattgattttgaaaatgcaaaatacataaagtttaagacagaagaagtcatccatacttccaggactattaacacattggcatattttcttccatttttttctacatatttttaaagtccttattaacattgtgctgcctgctatttttacttagcactaaagcatgagcatattctatattattagtaatcttccaaacgtcatgtgtggtgactaaataatattctgtttagataacagtgtgctagtatatgtttaatattcacctcactgagaaaaaaaaagacgtggatttgttgctcttgtttatttctgcagtaaaatactctatagtaaaaaactctattgtgtctgtggccagtctcaagctactatcaaataatgagcactgagttgggaaatagcatgtgtagtagcatccttcatatattatttctaccacacagacacattacagataacctcaagaacttatataataataaaatgtagttaaatcattgggaatttcaagtattaatactttgtttttaatatatttgattataaatgtatacaacttagtttttaataatgattgtatataacaatcacctctcaaaattcctaaaaaattaccaagtggctcttgcaaacctgcggaagacaaaacttgtgtgcctcaatcttctcccacttgactacgattaatagaatttagtacaattgatctgttttctgcagtaaaagtcacctatatgcctttctatatgtgagattatttccttaggatagattcccagagatgatgatgatgatgatgatgatattattattattttagagatagagtcttgctctgtcacacaggctggagtacagaggtgcaatcacagctcactgaaactttgaactcctaggctcagttgatcctcccacctcagcttcttcccaagtagctgggattacaaagtgtgtgccaccatgccggctaatttttaaattttttgtagagatgtggtttctctgtgctgcccagcctggtctcaaactcctaggctcaagtgatcctcccacctcggcctcaaaagtgctgggattacagacatgagccaccaaccacacccagcctgagataaaatattaacggtataatacatttgaatgtaataaagacaaggaaaacaatcaaacagcctgggtttctttttctaaattatagaatcaagtaacatttgcacagtgctccatgtggaccaaggacaattttaaatggtttccatttatttattccttgtgacaagttatgtggaggctatacattatctccgtctatagctgagacactgaggttaagtgtggttaagtgacttgcagagtcggtaagtgatggagctgggatgtgaattcaagtcctgtgccacattgcctcttttttttttttttttttttttttgagacagagtcttgcactgtcgcccaggctggagtgcagtgtcgcgatctcagctcattacaagctccgcctccctggttcacgccattctcctgcctcagcctcccgagttgctgggactacaggcacccgccaccacgcccggctaattttttgtatttttagtagagatggggtttcaccctgttagccaggatggtctcgatctcctgacctcgtgatccgcccgcctcggcctctcaaagtgctaggattacaggcgtgagccaccgtgcctggccgctacattgcctcttaatgtgtagttgctcaatagtcttccctttttttttttttttttttttttttgggactgagtctcactctgttgcccaggctggagtgcagcggtgcggtctcggctcactgcaatctccacctcctgggttcaagtgattctcctgcctcagcctcccgagtagctgggattacaggcctgcaccaccacacccagctaatttttgtatttttagtagagatgggatttcaccatgttggccaggaatctcttgaactcgtggtcctccccgcctcggcctcccaaagtgctcggattacaggcgtgagccaccgcacctggcctagtctttctttttaaacagtaaaagcattcaacatcatcaattaacctttgggctcattgttaaccacactccacaagcttaataaaatattgtttttgttctttatctctcaatatctagatgattatactattaattgcttatttcattcattcgttgtttagaaaataactttttattgagattgactttctcaaactttatgaattataagtttgcctccattgcattttgaaaattaacacttctttggcattctatctgctacaatttttttctattatgaaagcaatatgtattcatttttttaaaaaatcctgtaagatacagaaaaacaaaaatataaaattacacataatgctcatagcaagggataagtgctcttagcattttgctattcattctttcagtctctttctctcatatatgtgtgtgtgtatatgtaagtgtatatatgttgtatatatacacatacacacacatatattatatattatatattatatatgtgtgtgtatgtgtatgtaattttattttgtaaattttaagttccggggtacaagtgcaggatgtgcagttttgttacataggtaaacgtgtgccatggtggtttgctgcacctgtcacccatcacctaaataactgggctcagcatgtattagctatttttcataatgctctccctcccccaatcccacctgctgacaggccccagtgtgtgttgttcccttccctgtgtccatgtgttctcattgttcagttcccacttataagtgaaaacgtggtgtttgcttttctgttcctgcattagtttgctgaagagaatggcttccagctctatccatgtccctgcaaaggacataatctcattcctttttatggctgcatagtattccatggtgtatatgtatcacattttctttatccagtctatcattgatggtcacttgggttgcttccatgtctttgctattgtgaatagtgctgcagtgaacataggtgtgcatgtatctttacaaatttcagaggctgttatttcattgaggaaagagaagcatttaaataagaagctctctcttcagctgcctaccagcaaaggggaaaaacctacctctctgcatccatcttgtcctccttctccctcactgtgctttaagaggactttctcttcctatccgtggttaacccgtctttcttcctctgagccccacataaatctgctttctcagggacctatttccctcaattatctcctgtctttctccaatgtcctacatttttgcttctactaggtgcttccagtcagcatttaaacccactcttgtcaccatactcacctccagcaccatgcagcccctttcttcccttttattgttaaactctgctgcaaaaagatgtcttccctctcctcttagtttccacttccttatcacaacctaacccccaccactgcaatctggcttccgccaaatctgcaagcaccaaaatcaacatgacctcctcatcaggaaactcagtgggcacttttaggtccttatttaacttaacgtctcggcagcatttgattctccctcttttgtgaaacgtgtgctactcttgggctctgccaatagcctccactggctttgcttacaactctgatttcttcctctcagtctcttttctaaactcttcattctcccacccatcttttataaatgtttgtgttttcttctaattggcttagggcaccagcctccctccgtcttcaggctttcacgggtaccgtttcctctgcctggaacactcttctctctccactgcaccaagccaaatttgaatcatcctgtgaatgtgtgtgaatgtattgtgtagtttttttttattcctagttttatcaagttcagtggttgagaaacattatttatcatgttaaagaaatactattatattccgactctactaatggttttcaagtagggaatggatagttaactctgttactgcctttttgactgtgataggtatcttttaaactatgactatagtaaatcctgtttaaaggacttttctattaaattatccttatatttttgcaaggattttttttctgcctaaatgcatagtaataattttgaaatttatgatttaatttaatttgctttttaaaattttactttagggctttacatcctgcttgacttacattagcattgttttattccaaagattgatttgagaagctttctatactttatattccctatagcttttgtttgtttgtttttgagacaaggtctttctctgtcacccaggctggagtgcagtggtgcaatcacagctcactgcagccttgacctcctgggctcaagtgatcctcctgcctcaggctcccaagtagctgggactacagatgtgtgccacctgtacccggctaatttttttatttttgtattttttgtagagatgcagtcttgccatgttgcccaggctggtctcaaaacacctggatccttcagtggatccttctgggctcaatggatcatcctgcctcagcctcccaaagtgttgagattacaggtatgagccactgcacctggctccttgtagcttttatgtaactggagacttaattctttcttaagagttttttaaaacttatctgaaaaactttggggcattatatttttttcagaagtgttctttgctaatctaatctttttcttctgtgagtattgttgatgattttaccccaccctttactacatgtgaacaattttgtttttaaaattcttaattctttagattttcatctttaaatattcattactgtttagctctgttgaattgtggtccaagaatgtgacatataatctgtttttaaaatttatttaagctttaattttcatgggcatttgaaaatatgtgtcatctatcagggcttacagttgatgtgcatatctgtttaattaattttactaattctgctattctgttttactacatatataattatatttttgtcttttgatctataaacaggattgggattttttgtttttttgctatctttttattgtctatttcttacagattttattatggttagaaaatatagactatataaaatcaattctttgagctgggttaaaatctcctatgtagcttggtatattttctttatgtttgaatgtttcatctatgcatcatttacaaaatgtattctgtaattgtttcattgttttataaatgtacattatatctagtgttaattttgatgtttatatcttctatatctttactgtagttctgtttgatatattagtgtctgaaggagatctcttaaagggttacactatgttaaaacatttctccatgtactcttgtgataattttacttttgggtttgagtccatatttttaaataattaagtttcatgattgtcatatctttttagggcttgttccttttatcattaagcaatgtttctttttttcttataaatgcatatgcccctatattacatttttcttatattactattgctatgtcactttctttgggatatcgtttgctttatacatattttccctcccctttatttttaacatttctgttttattttatttaagtgtgtcttttgtgtttgatagcatctgtcatttcataggtcagcttataccattggcacttactgtgatttctggtatatttggacttgtttcttccatattattttatgtcttctgttaaccatgctttttcttggcttatttattcctcctcttcttcctgtttgtttttgcttttgtttttgattgataaagcctttctggtacctctttttttctctgttgttttggaatttttgaattttatttattttttagtagtaaccattaataaggttttaacataatcatttaaccatagatgcttctttctgtttgaagttattcaatatttctgtcctcttgtttatggcaaagagcttagcattttttaattacttagcattttaaacttctttcctgaactttgatcttatagttgtttgtctagaatttaattccactctttttaaacacaaaaatttgtgattttttaatattccatagtgtgttaaaattgcaatggtatttcaccaccatttatgctattgttttttataactcacccctttctttctggtataaattattccttagtgagtttatttactctagtaactatttcagagaaagtctgtgagtggtaaacactctcaatatttgtttataagtgttctgagtttaaaattattacctaagctagctgtgtaattctaagctaacagttatttttacgcagtcatgtaaaggtattagcctattgccttttggtatcaattgttgttgctgaataatctcaggttacccaaaattggcattcctattaaggaattaaactttttctttctggtagagtttaagattttatttatctttaatttttacagttttaattcaatgtgtccaagtatgaatttctttctttttttctttttttttttttcttctgagacagagtctccctctatcactcaggctggagtgcagtggtgcgatctcagctcactgcagcctccacctcctgggttcaagcgattatagtacttcagcctcccacatagctgggactacaggtgtgcaccaccatgtccagctaaattttttgtatttttagtagagacagggtttcaccatgttagccaggctggtcttgaactcctgagctcaagtgatctgccctcctcggcctcccaaagtgctgggatgacaggtgtgagccaccatgcccagctgtatttcttttttaaatctgtcttgtcatttggtgggtactttcgaccttaatattccagggtttgtttttcagttttgaaaaattatcagccatttatctctttatatattgcttctaggctgctcccctcttttatttttctcaaactcctatcagaggtgtattagtgcctgtcactgtatactttatatctcctaactattctttaatagtgtccatgtctgtatttctttgtattatgttctgtatattataatgatccttatgatatatatatcatatatatgatatatataatgatccttataatatattatattatatataatatatattatatattatatattatataatatatattatatattatatatataatattatatatattatataatatatattatataatatatattatatataatatatattatatatattataaggatcgttataatatatattataaaaattattataatatatattataacaatccttataatatatattataatgattattctgttgaaaagctgggaagaaagtggccctgatgactgtgtataagatgtcattttacataaaaattctgctttcttatttcaactactatgtttcaacttttttatttactccttttgtgaaggccttataaatacagttttgttcatttaaacagtacatcagtcactgtgctcaccctgggaattaaatgatgtctaaaacatgatccctgacctaaagctcaaggttttaataattgagtgtgggtcaaagacgtaaacagatcattttaatagtatctgtgtgacaagtggcattataagaatgacatttcaggataacataaggttaaggaaagaggcatttgggtctgcctagcatgtcaggggaagtggaaggagatggatgcttaaactgaatcgtaaaagacaaaataacattagcaagggagatatggggcaagtaaaacgctcccactcaccattttttttcactctcagcagatgagcttgcctttgactttaccaaaaaataataataataataaggtttattcagaaagtggatgtatcttttatggccaaacaacgtgccagtctgttctagatgctctataagtctgtcactgactatttcacttctaaatgtcaatcatactacttatttggctttgatgtataccttgccctttaactgaagggaccatataatttactgtataaatgcaggtagccctcatttcacagaggagtgagaaaaaagaaaggacgatgtctatagcctttcctcctgttgtcttaaaaaaaataaaatagaacaaaacagctttgagatctaattcacataccgtgcgctttacccattaaagtgtacaattcacaaagtggtgtctcttcattttctagttgtatgcccaagtgaattctctatgaatctgatgaagcttaagcttcagattctctcatttgcaggagccctttctaagaccctcagtgggctttagcaatgtgcttttatgagtgtctatttttataaaattaggggaaaattgttcttaaaaaacaattttttaaattattatccttttccaccctgacttcccttcagactcacttccctttatgctgatgatattggggtggacacagaaattttgtattcataattttatattttttctttaaaaagtacaaattgcacaaacttgggccccataaaacttggatctgcctctcctcgtatatcataaactctaagccctgctctcctgagagacttctcttttgattttcaaatgcctagtttggaagtagaaacaacattctttacataagctcttcctttcttttggcaaatttctactctggggaaacagaattctcattcaggtatgtaatggcttctgactgcttaaggaagggttagtaaacaaaattctagaatgttctcttttgatttctcctttcctttcagctcctgtcatcaccactcctcttgaaacagtggatgccttagttgaagaagtggctactttcatgtgtgcagtggaatcctacccccagcctgagatttcctggactagaaataaaattctcattaagtaagtattccacattttaatttttttaaatttttgtgggtatatagtaggtgtatatatatgtatatatttatgaagtagatgagatgttttgatacaggcatgcaatgtaaaataagtacctcatggagaatggggtatccatcccctcaagcattaatcatttgaattacaaacaatccaattacacactttaagttattttaaaatgtacaactaagttattgttgactatagtcactctgttgtcttatcaaatagtaggactttttcattctttctattttttttgcacccactaaacatcccctactccccccgatccctgtactaccctttccagcctctggtaaccatccttttacgctccatgtccatgagttcaattgttttgatgtttagatcccacaaataagtgagaacatgcaatgtttgtctttctgtgcctggctaatttcatttaacataatgatctccagttccatccatgtctttgcaaatgactggatctcattctttttatggctgaatagtactccattgtgtatatgtaccacattttctttatccattcatctgttaatgaacacataggttgctttcaaatcttagttactgaaaacagtgctgcaacaaacataggagtatagatatctctttgatatactgatttcctttcatttgcttatatatgcagcagtggggttgctggatcatatggtagctcaatttttagttttttgaggaaacttcaaactattctccatagtggttgtaccaatttacattcccacatcaacagtgtacaaggattcccttatctacacatccttgcgagcatttgttattgcctgtcttttggctctaagccattttcactgaggtgagatgatatcttattgtagtttttatttgcatttctctgatgatcagtgatgttgagcactttttcatatgcctgtttgccatctgcatgtcttctttcgagaaattgttcaaacttttttgcctatttttgattggattaatatattttttactatagagttgtttgagctccatatatattctggttattaatcctttgtcagatgggtagtttgcaaatatttcctcccattctatttgttgtctcttcactttgtttattgtatcctttgctgtgcagaaggccttttaacttgatgtgatcccatttgtccatttttgttttggttgcctatgcctgtgggtatctctcaagaaatttttccccagaccaatgtcctggagagtttccccaatgttttcttggagtagtttcatagattgaagtcttagatttaaatctttaatccattttgatttgatttttgtatatggagagagataggggtctagttttattcttctgtacatggatatccagttttccacacatcatttactgaagagactgtctttttcccagtgtatgttcttggtacctctgtcaaaaatgaaatgagttcactgcaggtgcatgaatttatttctgggttctctgttttttcccattggtctatgtgtctcttttgatgaaagtactgtgctgttttggttactctagctctgtagtatgatttgaagtaaggcaatgtgattcctccagtttttttcttttttcttttggctattctgggcctttcgtggtttcacataaattttaggattttttttttctatttctgtgaagaatgtcatcggtattttgataggaattgcatggaatctatagactgcttttggtagtatgaacattttaataatattgattcttccaatccattaatatggaatatttttccatttttttggtgtcctcatgaatttctttcattgatgtcttacagttttcattatagagatctttcacttctttgattaattcctagctatttaattttatgtgtggctattgtaaataggattatttttaaatttatttttcatattgttcattgttggtatatacaaatgttactgatttttgtacattgattttgtatcctgcaacttcattgaatttatcagttctaatagttttctgtggagtatttaagtttttccaaatataagagcatatcatttgtaaacaaagataattcttcccttccaatttggatggcccttaatatctttctcttgtctgattgctctaggtaggacttccaggactgtgttgaattaacagtggtgacagtgagcatccttgttgcattccagactagaggaaaggctttcagtttttccccattcagtatgatactactagctgtgggtctgtcatatatggcttttattattttgaggcattttccatctattttttgagggtttttatcacaaagggatgctgaatttttatcaaatgctttttcagcatatattgaaataatcgtatgtttcttacccttcatctgttgatatgatgtatcacattgattgatttgcatatgttgaactatccttgtatcccagggataagtttcacttggtgatgatatatgatctttctaatgtattgttgaatttggtttgctagtattttgtgcagtctggataggccaataatcccaaatcatcaagtcctggttccttttttgcttagcagtttttcccacttatcttttcctcttgaattttactataaccagaaaaaagaaatgaggccgcagcttcgacacatttcttagaaatttcctcagctaaatatctgagttcatcattcacaagctttgttttccacataactgcaggacaccattcagctaagttctctgtcctgcataacaaggatccccctttcttcttttcccagtagcatgctcctcatttccactcaagtcctcaccagtagtgctttgaacatacatatttctacgaatagtctgttcatgataatttaggtattctttaagatgatgtagattttctctaccatggaactctcttccttccaattcctcaggagcagaatcattaacacacgtatttctattaacagtctctttgaggaaatacaggctttttctagcatgcttttcaaatttttttcggttctaactattcatcaattgcaaagccacatccacatgtttaggtatttgttgcagcagcaccacacttccaggtaccaaaacctgtatttatttattatccttgctgtaacaaattaccacaaacttagtggcctaaaacaacataaacgtactatgttacagttctggagttcacacgtatgaaataaatctctctgggctaaaatcaaagtgttggcagggctgagttccttctggaggctctagggaagaatctgatttcttgcctttcctagcttctagaggccacctgcgttccttggccccctactccacttataagtctagcaatggcactactctgacctctgcctccattgtcatacctccctttatcaatctgcctctctcttccatcttttaaggatacttattatcacacagggaccattcgaatagtccagaacactccattttaagattcttaacatctgcaaaataaggtaacatattgacagattttggtgattaaaacaagaacctctgtgggagtgttattctgcttaccacacgcatttggcataaaaaaactcttatttggttaaaagaaactctcttttatattgctgcttctcttcctatttctttctactgccctaattcccttctcaacaaatggtttgcatataattaaataggtaatatatgtaaagcatatatttttatagttggaaattgttttcctcccttatgtatcccaagtaactagaagtgtgcctggcacttgttagcaatcagtaagtaattgtttaatgaaagaataaatattcaactaatcattagttacttctataagtaattaaccctttctgttcatcgtatttatacatatgcatgttctttatctattaatagctgctacttcccagaacttattgggagaagacacctatgtcttggttttatatgcttttctgaataaagtaaactttacattttgtcttatcagtgggcatcaccctttgaaagcatttttgaaggactatggtactttgactattggagcctaagaaagatgagaatataatgttagctttatattatcaagtaaggttattctattattcagaagtcactcaagtttcctctcacctttattctacttcctcattaacaagtcatcggtttgatacattaatcatggcaaaaaaatcacagaggaagcactaatctgtcatttttttctgtgacctgcagactctttgacacccggtacagcatccgggagaatgggcagctcctcaccatcctgagtgtggaagacagtgatgatggcatttactgctgcacggccaacaatggtgtgggaggagctgtggagagttgtggagccctgcaagtgaagatgagtgagtgggaaacagattcgtctattgatttgaaagttgacttggtacacttagttttgtatttattttttacattttttttttgagacagagtctcactctgttgctcaggctggagtgcagtggcatgatctcggttcactgcaacctccacctcctgggttcaagtgattctcctgcctcaggctcctgagtagctgggactacaggtgcgtgccaccaagctcagctaatttttctattttcagaatatacagggtttcactatgttggacaggctggtctcgaactcctgacctctggtgatccgcccaccttggcatcctgaagtgctggaattacaggcgtgagccactgtgcccccgctgacttggtacactttaaaacagtcagtaaatagagattttctcaggcctggtgattcagcactgagacaagttcaagttcaagcacaaccctgaggccaattaatcccacacctcttatgcctgctatcaaccactaccctaaggcaagcctctcaattctctatcctctcccattttcttaccttcactcatctcctgacttcttccaccctgaattctttcaccaggaaaacttcctctgaaacatttaccctacacctgtgaaacacaaccaaacacactttttatttctaacctctttgcagacacttttgccttatttcaaatttgatattcttctgagtgattttctgcttcagtggaagctgttctattttctccacttcatgtctacaagactgccaaacactagtaggtaatctcccagccctcagtgttgcttttaaaccattctattttgtattcctatacaaaatctttcctctgatgagggcttatgccattctgacctatcttttctctaactgtattcatcatgtcatctgctcttctaggcacttccccatatttattaaaaactttgattccaggcttactatctttctatccatctctactcctgcaattaccctaagaaattttaacagccatgaaatagaaccactagccacttaattctcataattccttgacctgcagaaatccagtgatgtttgtctttttttttcaattttaaggctcatacttttaatctctatgtacacacgtatgtagtcgttaaggtaagtctgccactgtgaggaaaggtagtttcattttatttttttaactttcattttgagttcaggggtacatctgcagaatgtgcagttgttttacataggtaaacatgtgccatggtggtatactgcacagatcatcccatcacctaggtattaagcctagcatccattctattcttcttgatgttctccctccccacaccaacacccccgacaggccccgtgtgtgctgtttccccccatgtgttcatgtgttcccatcgttagctcccacttctaagtgagaacatgcagtgtttggttatctgttcctgcattagtttactgaggataatggcttccaactccatccatgtccctgcaaaggacatgatttcattccattttatggctctgtagtattccatggtgtttaggtaccacattttctttatccagtccatcattaatgggcatttaggttgtttgtgttaactgttttattgtttttttgttatatatatttatatataaatatatgtaaacatatatttaaatataaatacatacatatatttaaatatatacaaatatatacttaaatatataaaaacatatttaaatataaatacgtataactatatatttaaatatataaatatatagctatagttatatatagttatatatttacatttaaatatatagttttataatttatttatataaactacataaataaactatatatttatataaaatataaataaactatatatttatataaatatatcatatatatattcatattttatataatatataatatataaatatataaatatataaactatatatttatatattgtatagttatatttatatataaatatatagctatatatttatatttaaatatatattaaatatatatttaaatataaatatataaatatatataaatacatatttatatatatgtaaaaaatataaaaatatgtgaaaaatacatatttatatataatatatgtaaaaaatattaaaatatgtaaaaaatacatatttatatatatgtaaaaaatataaaaatatgtaaaaaatacatatttatatataaatatatacaactatatataaatatatagttatatatatttatatattatatatatttatatattttttactacataatatataacatattatatattttagtatatatattatatattagtatatattagtaatataccatataatatacatagtatattatatataactatatatagttatatataaatatataactatatatgttatatatagtttatatataatattatatattatatataaactatatatatcacatatagtttatatattttttaatatataatatataactatatatttaaatatataaatatgtaactatatatttatatataactatatatttaaatataaatatatatttaaatataaattatataaatatacataaaaatacatatttaaatataatatataaatatatatttaaatataaatatatatttatatattatattataaatattataattatatattatatattataaatatataatatatattatatattaatataagtataaatatataaatatatattatgtaagtataaatatataaatatatattatataagtataaatatagaaatatatattatataagtataaatatagaaatatatatttaagtataaatatataaatatataaatatatatttaagtatatataaatatatataaatatatatttaagtataaatatatatttaagtatatataaatatatataaatatatatttaagtacaaatatataaatatatataaatatatatttaagtataaatatagaaatatatatttaaatataagtatatatatatttaaatataagtatatacataaatatatatatttaaatataagtatatacataaatatatatatttaaatataaatatatatttcaatataagtatatataaatatatatttaaatataagtatatatataaatatatatttaaatataagtatatatataaatatatatttaaatataagtatatatataaatatatatttaaatataagtatatatataaatatatatatttaaatataagtatatatataaatatatatatttaaatataagtatatatataaatatatatatttaaatataagtatatatataaatatatatatttaaatataagtatatatataaatatatatatttaaatataagtatatatataaatatatatatttaaatataagtatatatataaatatatatatttaaatataagtatatatataaatatatatatttaaatataagtatatatataaatatatataaatataagtatatatataaatatatatatttaaataaatatatatatattttttgagacggagtctcgctcaggctggagtgcagtggcatgatcatggctcactgcaacctctgcctcctgagttcaagcaattctcctgcctcagcctcccaagtagctgagattacaggcatgtgccaccggaccctgctaatttttgtatttttggtagagtcagagtttcgccaagttggccaggccagtctcaaactcctaaccttgagtaatctgcccactttggcctcccaaagttctgggattacaggcatgagcctgtttgtgttaactctttatcagcgtagccaatcgatgactcactcttggccttgtcacccactggaagtagtctgcatttaaaatcttcagcttcagtatgtcactctcatcatggacattttttggtacagccttgtcagatgagcaaaacagtttcccatactcatgatttgcctccaagtagagtttgtgggcacaaacttccattgtctccttctcagctaacaacagtgtctcagtctctctcattctcctactcttgctatacaacctcaacatcaccagcatcatcatgttctcttaccttgattcgtctctgttctcctttccattgattccccaatggggcttttatttccttccatacttagttctttcttctacctggtgatgtatcatcaaacactgccttaccagcatctttaaatctcatggcctcctgtcctgtaagcatctgctacttgcaaactgtcaatcttacaatgatgtaaccttcatcttctcttctctgacatgcttataaccatacatacgggcaccacacaaattagaggaatttaggtctacttgggacatttatttttagtttttgtgttgttgtctttcctcattatttcttatcttttgttattttgctggaggaaatcattaggtacttttttcagagtgtgaagatgtaaaatatttcctgaatttgtgcacgattggaagtcttcattttgctcgcattgttggataataattttgctgcatgcagaatgagagttttaaaatcccttttctttagttttagtagatatcctctgttgcagatgagaagtctttttcttatttctttacaagtaaatctgatgtctctcttaaaaagtttaggatttttcttttttttctagagttcataaatttcacaaattgacaagaatatattaggtgtatttttaagaattattgctactcagttttaggtgggccttgtttttttgtttgtttggttggttggtttttgttttgttttggtttttttgagacaagatctcactctgtaactcaggctgtagtgcagttgtgtgaccatggctcactgcagccttgactgcttgggctaaagcaatcctcctgcttcagcctcccaagtagctaggactacaggcatgagccaccataccaggctacttttatttatttatttacttttttttggtagagataagttctcagtgtgttgcacatactgagtcttgaagtcctgtgctcaagtgatcctcccaccttggccttccaaagtatcgagattataggagtgagccactgcacccagcctaggtgggcctttttgatctaaagaccaaagctttttagaaaggtacattttctctattttttttcttttttctttctctatgacttcaaatttttcttctcatattttctgcatgtcttaatattctactctcttgaagattccttttactttttcttcatattatgaatgtggtctccagtatgactattctgtcattctgagtgttttggtcttaaaaactatatttttaatttctaagaatttccttgatgtctctgttgtcataacaaactcacttgtatgatacaatattcacttaagcttctaaggatatcactagtgcatcttttaaaaagacattttcttttttcccctgcattacttttatttccttcagaaaaaaaaaaattgattttgtttgggttccatccttttatgtttacaatttttctcaaattgatcttttattttttgatcataataaatatacatggagtgttcagttaattaggataaaaagctggtgggaatagcatgactttatggaatactgatttggtacttactgtgagtaagtaggtggggatctgcctatatgcaggcttcccttcagtatgcagagaagtaagaaatcaaataaggaagttggaatgctctcatttgctaaataatgaagacttcattctgaggatgaaacacattcaagtatttccttactttgtgacactacctttcttttgaatatttttgcatattctctctggcccaattgttcttgatttgggttctatactaaatccccttttcttttcttgccttcttttttccaacctctcctttggagatctcatccattcatgtggatatacaccggtgtggccattccaattgctaaaattttggaatgcttccatacttcttggaaagatccgttttataaggctcccgagatcccccaacccctatcactactccagctctcttaagccctcccccaagagctccctcccctaaattcctaatggtccatcagctaaagtctcaatgctggcacagcgggatacttccagcatcctgctttaaggtgaccagttctgattggtcagtacttatgactccaccctgaatcatgttcccttacagtggggatccatggctatgcgtcaataccctagtcattcctagttgactttacattcaatttcccaaaagggaattcctcacccctcacctaacagatgaccaagacatcaagtcactgagaagataggagatttttgctttaagcaaaggtctttacctaagacattatctgtgcctcagctttaccatagagatcttgttcagggaacctatggaaggcatagataacactttatttgactgtcataggaatatcaagtgctcagctaagtttttcccagcaactgtatgacaatacaactcacaattgaggaacctggccagtactgtatttacatgtaggtatttacagtttattagaaggagagttgtatgctatagatagcaggcaaagtaataaagttgttattttcctatattttaaagcctttcttgtatttttgctataacacagggccgcaggaactctaaatgacagtgaatgcttagattaaaaaccaacaggtctcacgcctgtaatcccggcactttgggaggccgaggcgggcagaacacgaggtcaggagatcaagatcatcctgacaacagggtgaaaccccgtctccactaaaaatacaaaaaaaaaaaaaaaaaaaaattagccgggtgtggtggtgggcgcctgtagtcccagctactcgggaagctgaggcaggacaatggcatgaacccgggaggcggaacttgcagtgggccgagatcgcgccactgcactccagcctgggcgacagagcgagactccgtctcaaaaaaaaaaaaaaaaaaaaacaaaaaaacaaaacccaacaggtcatgaaggctttgcaagtatctcttaccaccaacaacaccaaagcccccattcctctccctcacattgaagtagaagaaaacaaagtccatatttcatgcgttcctttgtcaaaataacaaattggttacggcacatgtcctgcaagaaataaaatgtgtccattgctcagtagtctctcttgcgaagtccccctctgtatctgtaacgtaaaattcctaaggacataaatgtagttttaactattttacgaatagtactaaaataactggcatcctgaacttatcaattcttttgtatattagatttaataactttctttgaaagtttcatatttgagaataaaaattaactggcataaactatttcttctgaaagattaaaagtgtttgaacagtaaattacatgtttgagtccccccaaattgtatgacagaatttcttctgattgttaatataataatatctggtttactttctagagaatgaatgtatttaattaataatcataaaatttaatagtcaaattaagatggaagctaaagggaaaataggtcataatttctaactaggtaagaatatagttatatcaaaattttcttttcaaatgttttatgtctatcagtatgaattaaataatgttgaattgctatggtgacagtctatgttaatcagcttttattaactatcttttaaaatgaagaatgctatggtaacttcacactgttaatatttttcataaatttgtgttttgctagtaagattctaataaagcagagacaaccaagtgtttctaaactgatttctgtttgagatctactgaggaaaactgtctttgcatttggtgaattttgtaatgtaacatgcctcaaatgattctcaaaacagatgtttagaattaaattgaaagttagaaactctaggtttaataaagccatattgccttatttattttgaattttcatttctttttagaacctaaaataactcgtcctcccataaatgtgaaaataatagagggattaaaagcagtcctaccatgtactacaatgggtaatcccaaaccatcagtgtcttggataaagggagacagccctctcagggtaagtggttatgatgttaaaacacatatataaaatgtattttaaaatataacatttctttacacactcagttacacacttacaaacttctagtataaagtagtttccatgtacattttaaccaaatgtaaatatttctgtttgcatatatgcaaactgcatggcatttcatttgggtctggctagggaaaaaagagatgggaaccaataatgttaaagatagaaaaggaggcaatgaaaaagcaaacctggaatcctttgtatttgttggctggctaaatcatttatttttttttaatgttgaatctgagacttaggggatgaaaaagaaaaactaaaacccaggctttagaactgacagtttctggaaggagggagggagacaaggttcggaagaaaagaaatgagatctctggagagaagttaggcgaaaagactcaagactcatacacaaataccttggcaaatccctcctgagtcatgaagagtagtcacgcctgtaattccagcacttcaggatgccaaggcctgaggtcagaagttcaagaccagcctggccaacatggcgaaatcctgtctctactaaaaatacaaaaattagctgggtgtggtggtgtgtgcctataatcccagctactcaggaggctgaggcaggagaataacttgaacccgagaggcagaggttgcaagtgagccaagatctcaccactgcactccagcctgggcaacagaatgagactccatctcaaaaaaaaaaaaagttattatccatatgcttattttgtactgcctctgtatcttatccccacatttattgataaattattatgaggcatcattattgtctttccatctttatatcacctaaaagattacagactatgtttttcatttaacaatgcatagtatattttaagaggaatacaaaggtgtcactttatgtcaattaactgaactaaggtataaaattgctcagctttgctttatttaaaataaaataaatattgctaatttttaatgattaattatctggctttcctcttgttataaatcttggtgcatttcctacaatgacaaacaagggtggttgtacttatgttactgaatttagggttcaaaacagaaaagacagatgtaatatttaaactccaaagagtaattttaatattatgtgtgaaattttctagtatttcaaaggacatgtactcttctaaagataccatctagggtgcaaggtaaacctgatagttaaaagcaatgtgtttatttattcatatttcaatagcttttggggtactagtggtttttggttgcaaggatgaactgtatagtggccaagtctgagattttagcgtgcctattacctgagtgctgtacattatacccagtatatagttttgtatgtctcaccaccccactctgcaacatttcccccttctaaaagcaatgcttttaatcagatttagctgtgactttggggaagcaaaataagcccatatacatatatatattatacatatacatattatatatataatatatatatacacacactcatgggatgaaagaaaataaaaataaactatacctcataggaccctggtgaagattaatttaggtactcttgcactatttcatttaatattgtatgttttacataataagtggccaataaaggtcaaagcgatatctttgatgatgataatagtgatgacaataagttgatgatatttggcaaatgtatccttgatagacccataaacatttttgaattcacgtccctatctctggcaggaaaattcccgaattgcagttcttgaatctgggagcttgaggattcataacgtacaaaaggaagatgcaggacagtatcgatgtgtggcaaaaaacagcctcgggacagcatattccaaagtggtgaagctggaagttgagggtaaggagctgcatttcttcccctgactgtgtgaccaggggcctcactgtctactgtgaaggctgcacctgggcttgggagagaagagatgtgggcagcccacttccctcagttgttccagatattaggccataagttcaagcgtatgataacagaaaaggaaaactgaaaaaagaaagaaattttcactagtataaaaggtcatattccattgattactcacaatcactggtaatttttaccaaaacagactaaatttactgtaacagtaaaataatagaaacccattttagaatgccttcctggtttggacaattcttccctcatttaaagacttgggcataataattttaatctttttaatcatacagaacaactttaaaaagatgtgataaggaggaaaaagtagctattttcagatagtgttctatcacaaagcttgaaaaaaaaaacattaactcaaatcgtaaagccaaaaataatcccagttctgtgagttatgttatcaaaatcgtttttcttttctttctgaaaatattttttaatcagctaattcaataacttggtgtgaaaggtcttcactgagaaatcagaatccaaataggtctaggtgttctatttgcttgttagtcgggtccttcttgacctaaaattgcaccacattttgcttaaaaagaactatcagcacacctctattaggcgaataaactgagtacaaacccttcctagctcttcctgttgtatgccagagaattaacatttttggctcctagctttctcacctgttaagtggggtttgctctatttaatgaagttaggtgttgatagtgtttagcagagcatctggtcctttgtgcaccctcaataaatgttggctataagaattatcatctatttttctgcttttctcttatctgattgataagtgttagagtatcacatactggcacaaattacagttcaatcaggaaaagacttgaagagttctccatattttactttgattctgtcctactttccttaggccaaaatctatctttttctgcatatttccttctcattcatatagttttctattaactcctttaagattatttttatttccttgatggacattcctgtcacagctttaatgatctcgtttcccacgtttgcctccaattgaggtaacatctttattatgtcattgtaccaattgctcataaaattttcattaattcctcatggaaaataatgaggttggtgggaatagtggctgtcagaatataaaaatacattttcatcaagttgctgtaatttaatatcttctaaataatcagtgctatttgaagctccgtattcaacaaccagttgatatgatttattcagtaaaaactaaataaacctacaaacccacccagacacacattcagactcactgaatatctgtctgcctagatccagtgttttcttgttctgtctaaggaatgatgcagaattaatgctatccatttgtataaaatatcacaaagagtttttctctttaagatattaaaaataagctttctgtattataatatttaatactgatcatttaggtcactagcttcatagatattaaaacaacttgctttacctttgacctagagaaaattatcaccgaactccattagttggagttattatacagtttggttttgtgttaccatttaattttgtatcatgcctgtcagtaacattgaatactgcctcttttctcgtaacctttaaatggtcatgcttagtgctttaaaagttaatatatgctagagatagtattaaatttgctagaactgagagctcataatatcatttaaagttattctaactgtaggtaagatgattttcgcacacatttagcacacatgcctatttctaccctcatcttagtccctattaaaatagccaaaatatgtgacatgcttagcacaattgctggtacataataagcatttaataaatggaatctactatacttattatgattaaaacataaaattgtaacaaatttgctttggctctggaagctctgaaaggttgacttccacttgaataaatagttgaggtattttcataagatataatgtagacgtgacctatttagaggtaaggctaactcaacctacaactcagaacaagtttttttttaaaaaaaagcaactgagaaatgactggaaaaacctcaaaagtacatgcagatgcctgctagtttggcaatgatgaggactgaagatgatgaggcagggccatcgtcagttggggcagacgagcatatgtatgtatcaagtcgtaactctgcaaattagttatgcagtgactatatcgaatcagaactctatggtgccatttgatgctgggctacatgtaacacagatgggcatacaggaaaagatagagttttgtcattgatagcctctaataaagataaacatgccaggccatggattgggtaccatgtgttaactaaatctttgttgttacaactgtgaaagaaacaccctaccacacagaagtaaagctccctttccagattgccattctcagactgctggacctctgcaatggaaatgtaaaggtatcctatactttggtcttgccttaaaatgttcaaacggtgacatacataattattgatggaaccatctaactcaagcgtggtgcagcatggatgtctttctgaaaggatgtccaatgggaaggctaacattttaaaaagttccattgaggctaaatgttttatgtggattatcttgtttaattctcactaaaagtctgtaacaagggccctatattctgccattttaggaaacagaggaatagagaggatagctaacttacacaaggctgcacagatagctgtgtctaagaatttgagtcaggctgaatactgtctgttctattaaagaatgagatagtcctgtgtgacattgtcaagagaagtatctagatgaaaatgaggggaaaaccagaattctgcaaatgaaggagaggatgggagctgaaaaaaaatagacaggaggtattgacaaattttttgataaatttttcagagaaaagggaggagtcaaaaaaggaagcagtagctggagctatgtttggtgtgtagatcacgttgcattgcaagatttctcttcgaaaaatattgaaatgtaaaaaaatttaaatgttaaaatattaatgacactgagctcagagagaagaaaaatttgaacatacataagagaacaaaatactcaatgaaatgtggtgctggataatgcacaagggttgtatttgggggccaagtagaatgataaactgtatacagagggtgaccacatgttctggttttcccaggacagttctggtttacacctgttgtcctggaatcattattaatagagtctctcttttactttcagaagtatccaagcttccacgataaattatatggttactctccttagacaggaagacagaatgtccttgtaataggaagaaaagagaagagggaagttttcagtataaatcagttcataagtatgatggatggaatttgagaaaattctgttcttatggtctctatttcctctaggaaggagaaattagggttatcttttgaaaacacttttgttaaagggtcagggaagggggtgaggatgaagtgagttctaaaatagctgtggaatgggagagatgactcacaaagtaaaccaggattgtagggcagcattaaagttttagtagagagcaggaccgtgaatatggagtagcatcaatccacatggttgcagggtttttccctccagtgttgctctgctgtacaggtgtaagttcagaaaatagcagaaagctaaattcaaaggcaagacataaatgttggagttttgtcaggaaggaaaatagggcaaaggatttgagactattgcaaaagagagattgaagcatgaatcatggaatctttaggtaccaaatacacctataatttctctttcttttcttttctttctttccgtctttcttgtttgtttgttttgttttgtgacaaagtctcactctgttgctcaggctggagtgcaatggcacaatcatagcttactatagcctcaaactcctaggcttaagtgattctcccacctcagcttcttgattagctggggctacaggtgtgcactactgtgctcagctatttattttatttattttattttattttttttactttactttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttatttcatagagacagggtcttgctatgttgcccaggctggtctcaaactcctcaagcaatcctccagccttgacctcccaaaatgttgggattataggcatgagctaccatgcccagccatacctatgatttaatatccaaatatgaaatatcctcggatatgagcctaggattaaacactatagctccagcaatataacagacaagataatatgaaaatcttccaactagcccggaaatgctgggctagttgtataactgataagaataaaatataaatctctggaagctcaaaatggacaggaactgcaaaaaccataagctcaatgagctggtttcttattgttctaaaggtaatgggacaggtgctcatctccataacctaggagattggttttaagacccttaaaggggcaggagacagggtcttggcccatgtgaaatggaggttagcattcaaaaccttgtataaagctgagaaccacaaaagtagaaagatgggccagaaattccatcttcaggcacaaaaacacaacacaatggcttgtctgtctttagtcgtgagggagaaaaaaccaggtcatcttaggagtgaatattcaacactcaggactatagcttccataggcttgatattgacttaataccatcagcacagtctgggaattctcagctggaaaaatgaacatacaaactggtttcaggctgggcacagtggctcacccctgtaatcccagcacattgggaggctgatggcttgagcactggagaccaacctgggcgacatggcaaaactccatctctacaaaaaatataaaaattagccaggtgtggtggtacatgcctctagtctcaactatttgggagcctgaagtgggaggatggcttgaacctgggaggtggaggctgcagtaagccaagattgtgccactgcacttcagcctgggcaacagagtgagaccctgtctcaaaataaaaaaataataataaaaaacctacatacacataaaacattggttccaggccaaaaaacccacacacacacaaaacattggttccaggccaaaaatttaacaagaaaaaaaagctaaaagaagaagcactttacccaagttacataggcttttcatggatatacctacactgaggatgagttcacaatgcaaaattgtcacacctacagaaaacaacctaccttgagtgagtgttgtccaacataatatacaaagaaaattcagttaaccacataacatcatagaaattataaaataagtatgcttaaagtaattaaaaatgcaaaaggaggaataaggaaaacaaaaatacattagggccaggcacagtgactcacgcctgtaatcccagaactttgggaggccaaggcaggcagattacttgaggtcaggagttcaagaccagcctggccaacattgtgaaaccctgtctctatacaaaaattagccgggcgtggtggtgcacgcctgtagttccagctactcagaaggctgagacaaaaggatctcttaaacccaggaggcagaggttgcagtgagccaagattgcaccactacactccagcctgggcaacagagtgagactttgtctaaaaaaaaaaattaaataaataaataaattaggaagacaggcggttttgataaataattaaacacaattttaacacataaaaatataattaaaattaaaattcaatggatgagtaatagtatattagagataaagagataattcagccattagaaatcagctcttcagaatttagaattcagtgcagaaagattttgaaagcatagaaaagatgaaattgaatttaagaaatgataaaagatacattacagaaagagaaaatacagaaaatatgagaggcaatactcaaaaacatgatgactaagaactttccagcattgatgaaagacttaaatcttcaagtacgtgaagcataccaagtcccaatcggtaaaaatgaagagcagagaaataagcatttcacacccagtcaaatcataaggaaacatcaaagacaaagagattatcttaaaatattgaagacagattatttataagggacaacaattaggataacaatagagtgtggggaaactatcactttcatctatccttacaatttggtatagccgcatgaaggtttatgaaaaataaaaatcaaactttaaaatgtatatagatttgtctcagcaatttaacttctgacaatttatctaaaagaatatttgcacaagtgtatgttcaagattatttgttacaaagttacttagtaaaaagttgtaaagaacttaaatttgcttcaataggacaccatctaaatatgtgatgtaattccatgcagccattaaaaagaatgagatggatttatatacattaacttctaaaattatctaccgtatatgtgacttgggtctgctttccatctctgagcctcagcttcctcttctctaaaatagagataaaagcagaacctacctcttaggatgcttgattattagttattatagacacatagtgtgtactatataattatttgctgttttattatttatttcatgtatttaataagtacttgtatagtgcttaccatgtgcaaggtactgttctaagtgctttagaatattaattcattatcaatataatatgttcataagtgaaaaagtaagtaaagaacagtatatcttattattatatattagagtacatgtatatcgaactcttaagtcatcatctctgcatagagaattatatggggggtcccggcacgatggctcacgcctataatcccagcactttgggaggccgaggtgggcgaatcacgaggttaggagtttgagaccagcctggccaacatggtgaaaccccatctctactaaaaatacaaaaaattatctgggcatggtggcaggcacctgaaattctagctactcaggaggctgaggcaggaaaatcacttgaacccaggaggcagaggttgcagtgagcagagattgtgccactgcactccagcccaggcaacagtgcaagattccatctcaaaaaaaaaaaaaagaaagaaagaaaattatatggggggtaacttctattttatactttatgtaggcctatactttttgcatctttataaagagaactttataattaggaagaattaatacatgtatttatgctttggaaaaaaaacacttcttccaaatattatactatttttgataaagtaacatgaatctttctgttcattagtttgatatttttgcagttctgttgctccattgatctccaagacaaactcagggatgggaaaagttttgtcaaaggtaattgattcctatgttgcttaggttttcacaactcttggatattggctgaagaattttgaaggtggaggttctgatgaacaggacatagaacatgccatttctttagggaaggaatcaatccataaagctgctaagcttgagacctacaagaggaagctggcagagtcacctagatggaggaagtgaagggggtcagagaacagcagctgctgctgaagtctccactcatctgactcttcttttctatgtatagatggaaatctgaaatttatgattttatagtctggaatagtttgcaggatccagcacaaaagttttgttagggttctgatttctcagtgaacattttccacactttgttgggtgttactgacttacagcataaagggaaaagtaaaacaaagggaagttcctataggaaagggaagcaccgctaggtaagaactatttaggtatactgatttgacattgacagggaagcctcagtcatctgggaggcagaagaaagttttcagtctcacaactgtggaggctcttctggaaaggttaagccctgtctcaggcccccatgtgccaaagggctctaggagaggattcacggcaggatgtgaccagggaacatcttattgtctgatgtcaccagagaaatctacatatcatatttcatacattctaagatgctcattatttcatattttggcatatctgggttacatctcatcattaatcccttacaatcacaattgaataaattttagtttctttgttgcacattttaatatctctgaaattgagatttttcttacaggtgctaaaggcattcacacccagtttgtggcttctgccctccagctaagatcgttccttagctgtccccaaatatgagaatgaatatacaatgataaaacaaaaataaatcaaccatattggctcataaagctttctttatttttaactagaaattttccttctgcttgagatcatttcatttgttcctcacagaaatgaaagcattattttcagtgagatgatgccacctagcctttttccctcaaaaccttttatttgctgcctattcattttattaggttgaaatagagactaagtggcttttcagggccatatagaggaaattatcttttaagagacaattttgtctgcttctctaatccacttcacattctactttaggtatggtgtgtagccaaagagtgatctatgttgtttttcttatatatctgaaaccattttctcctgagtacctctaaaggacaggaagacagatactcaggggcagagggatatggcagtggaacatgctgatttgaatggcagggctggaattttcagtgagggtttgctatcatgattgcttgggacaacttttgaaattctgattttatttccctgttttgaccagtggcatatgccccctttaaaacgctagaccagagggccaaccatagtggctcacacctgtcatctcggcactttgggaggtcgaggcaggcggatcacttgaggtcaggagttagagaccagcctgggcaacatggtgaagccacgtctctactaaaaatacaaaaattagccgggcatggtggtgcacacctgtaatcccagctactcaggaggctgaggcaggagaactgcttgagcctgggaggtggaggttgcagtgagctgagatggagccactgaactccagcctgggcaacagattgagaccctgtctcaaaaaaatagagagagagagagagaaacaaataaagagagagagagagagagaattaactcctctgaccagtgcaggggctcatgcctgtaatcccaatacattggaaggccaaggtaggtgaacctcttgaatccaggagttcgagacaagcctgggtgacatggcaaaaacctcatctctacactgaagtaaaataaagtaaaataaaaataaaataccagaccatacaaatcaaatcttttaaggtgataacataattactgttttttatagctggggggtgtctttgttataagattttttaaacattgcaaaagactcatttaaaatttataaatatctaattttcttttttcccctcacattctctgccttaactaagattttttaaaatgcacttatttatttgaggctgaatgtggctcttactacattctgtgaatatcacattcagatgaatactgctttgtatatagaaactggctgaatgtagtgtacttgagacccaaattaaaatagatggatgctggagtgtatcaagctcttgttaattgcattttctattattatcttgtttacccttgaagctttaagccattaaggaaaatattgggcagaagctggaatcaagagagggctgtcagtcagcaattgctggtgggaagaggtgtcttggcaccaatacaaaactgcaaataagagccagggagggtctagaagcagaacaaaaagaagagagtccttctgggtacagggttattgtagggctccttcatgtttaaacaactccttatttcctcagggctttgaaaagcagcctcttgtcaaaacgtggagaggcattttggggagtagcaagggaaggcaagtcatatggagaatttaagtggcttcagtgcatgagtctccatcacttgtcaggacacctgcgtgctgccagcccagtttctttgcaatctgaaaggctgcactatctacccttaaggccaacaaatctattcagaaactttttatctgaagatatttttgcagacatatgaaataggtaagacaagtagaattccaaaagatgaaaataaataattcctatctatctatctatctatctatctatctatctatctatctatctatcatgtcacagaagcagatgtcaatagacataactataaaagatcagcattgtcttcaaaattttagacttctggctgccttctttcctagagatcaaatttacttgttgcatctacaaaagtggaagcaatcatgtaatgtttataccacatttgatttgctttttcctttgtttatgctgcagctcttaatatcacaaatgccacagagagaggtatttaaaaccccaccgtgtgctgtgctctcagtgattgcagttttaataaaatttgcagtggtcctgttcccggcatcagtcctaattgtttgatgccactaacaggtttgatttgctgtcatgagtacattgtgcatttgaaaaccaaacaaagaaaaaaatcacaaacctctgatatccctggaggctatcattgggaaaattaaatctgcatgatttaataggatgcatgttctaaaagaggagcttgacccattgattttgactttaggggatattatggtatattatggtatggtttcatctaaaaagttctataaggctttcagagaagaatggtaaagtggtcctttagttgaacagttgtcactgcatttctctaagaaaaagtcacttgtataataatgatagcactgaatagataatacataatgcttcaagtcaacacatagttaggccctcttaaagtgcagtgttaaagaaaatgtactttaaagtaattaaattgtttagtataatgttgacattatattatttgaaatgaaaagttatcgtgacctgaaatacatatactctaattggagtgagtttttaatatcagttttcagatattaaaatgagatgcataagttcaagcatacatacacagtaaaggaaaattgctttctattcaatgcattagttcatccaacaaagacacactgagcaatgttccaggtgcgacatgagacagagaaggccatgcctccactgggcttaatttcaaaatgtgactattttgattcatgcaaagatatcatggaaagctattagaattctatggcaagaaggagttcaagtaattttatattcagttattttcttcagatatcaaatacatgactctgagactgtaattgttatatttatttccgtgaacaacaaactatacaaggcattatttttggagaggacttaatatagtggttaataacatgggtggtaggatctcaagaaaactgcatgggctctagagtctcaggtaaacttcttgagtccaaatcctggttctaccacctatcacatgtgtaacttccagtaggttacttatctctttgtgcttcagtttccctacttgtaaaattaggttaataatactatctacttcataaattgaagaatgtagaagtagatgatatatttatagctcttacaagagtgactgacacagagtaaacactcaaatagaaattatcaatgttagttctagggctaatataacttctgtgcaacagaagcagtgatttacgcacttgtgcagacaattatagctcccttttccatgtgtcatctttatctctgaggtacaagcaataaagtccaatggcaaaaactaaatttttatttttaatagtttatttgtattaattttggttctagcaaaagaataataaccaactttaaatctgcaaggagaccccaaagtcatatagttcaattccttagtttgtagataaagaaatttgagactaggggcagtggctcacgcctgtaatcccagccctttgggaggctgaggcaggaggattgcttgaggccaggagttcgaggccagcctgggaaacatagtgagacccccctctctaaaaaaagtatttatttaaaaatatttaaaaaaaataaatttgagaccggaaacatcttttattttatagataaagacacttgagaccaaacaaattgtgactttgcccaggttggcaaaggaacttgagtgtcttattcctagtctaggacatgttccactacctattccgattctttcctctttttaatatttatgttgtgtagataatactctgcagagttcacatgctttagtatcagacagacctgggtgttaatcctgactgtgctgcttaccagttatgtgaggtaggataatttacttgacctctgcaagtctatttcctcatttgtgaaatggggggtaatattatctagaacacagagttcttaaaatggactcagatagcatattcacagtgtctatgcagtagctctttgataagtatttgctgttgttggtattgttgtctgttgtttacattgttataaagctggatgacatctatccagagaataccactagtcaagcttcttgaatttcataaatagaatgtcaacattaacaactgctcatctggtctccaaagaacataaatctactttcaatcagcaatgctttgtacctgcattcttgttacttgttagagattataactttggtgtggcttcaccgtgacaagtgataaagggaagcttatctaagaagctgtgtaaagaggtgcctttaatggctaacaggagagaggctatttggagtcaacctgttaaaaaaaaaaatagtacaacaacataaaagtgaaggcggccttcgtgtgtatcctgagcttatatcatattttattcactatagaaatagatatttgccaaaaatcttgttgaaaatactgatccattctagcactcactgctcccaagtaaatcccaagtgagaaatcactttaaaaatttagtgccataaaaaatgatgagttcatgtcctttgtagggacatagatgaagctggaaaccatcattctcagcaaactattgcaaggacaaaaaaccaaacaccgcatgttctcactcataggtgggaattgaacaatgagaacacttggacacaggaagggggacatcacacaccggagcctgttgtggggtcgggggagaggggagggatagatagcattaggagatatacctaatgtaaatgatgagttaatgggtgcagcacaccaacatggcacatgtatacatatgtaacaaacctgcacgttgtgcacaggtaccctagaacttaaagtataataataataaaaaaaatttagtgcctggctgaagctctgtgaacaatggctgcagaggagcttcctgccagcctggggaagccatagcctgcacatgatctgtcccttttagtgaactaaggttgacttgatggagccaatgctggcaaaggtctctgaggaaaactgacctggatttatacaaggtccagccttgcaggttgtaagggaggtcactttcatggcaggccaagatccttgagatgttttgaaaatttgaaggagaaaggaattaggccaaaatgaatagatactgcagacgaaatcttatggagaaatttccttggacttacatccttagcctcagcacagcaaattaatagaagcttgcagaagaccaagctgagatttcttatagagacctccagtggaacaaacttaaagaaggcccatatggttaacgttcttgatgcccatatggttaacattgttgatgcacctgtgtaaagaaccaggctaaatctaataaggccatactcactttgtcgtcaagaatctttgagattctttttaatcaaaagtggggagactataaggaacaatttgtgcttaaatggaaaattgtgtgttgtcattctagagcacacctgtgttgtgtgattccaattctgtgggagctgttttaaagctttataaattgtagataactggcagcaatgctaaatcgttctcctccatagacttgcaaatgaattctgtccagtggaaaagcaaccaaaaaacccaatctggctctgtttgcacagtcattttaatattcctgatctataaatgggtctgtccttgggattctcttttcacctggttgcaacacttcactggtttccttgtgaatgagttaaataaaacctttaactcatgtttattctgaaaaaaaaaaaaaaaatcagtgcctgggttggggagaagggtctctgctgagaaactgacattttatccattcctatagtaagtactgtgtactttattttcttttactttattttttgctcggcctggcatgtatcttagaatccaatttgaagcttagtcatagtatctgttacaccaaaccatccagaggttttctccctgatcctaatatattgttattcatttaatttatggccatatcaatataccttccttaagatctctatggaaagagaaagaaataactaagttgacggattcatggaacttctcctccaagtggttctcaaatgccagtgcacatcagaagcatctggagatcttactaaatgacacagcttcaggatgcattccccagttattcatatttgataggtttatgttagtgctttttaacaacaccccaaaggatccttaatgcagtgacccatgaaccacactttgaaaaacactgacttcaggttttctacttagagggactttattccagatgaatctaaacaattcaaggagaaagcttatctgcaaatagtaagatatcaatgttaggatagcttcaaattcatccatttgtggaatgcctactatgttctatgcaatgaggtaattcttaaggatacagacgaaagagagatgtggttcatttcttgaaaagtgttcaaattcagtgaggaagatggatatgcaaacaagtaaaatgcaatatatttacaatgatagaagtttgtgtagggttatatacacaggacagaggagatagggaaaggtcagggaaatcttcagagaggtgaaggccaacagggctttgattgatgaagagtgaggagctcttggtgaggatcatatcacattgagggaggaaaaagaaaatagaggaaaaaattcagatttaccatgcaagcacagcctgacactgactcataaccagggagtaaaagaaggattagagagtttgggacagtatctattagtggtgctataaaaacagaataaaccatgatttgactcacaggctaacatggagatcatcttcttggtatcttctcttggacctttttttctttttttttttttttgagacagagtctctctctgtcattcaggctgaagtgcagtggtgcaatctctgctcactgcaacctccgcctcccaggttcaagcgattcttatgcttcagcctcctgagtagctaggattacaggcatgtgccaccatgcccagctaattcttgtatttttagtggagatggggcttcaccatgttggccagtctgctctcaagctcctggcctcaagtgatccacctgcctcagtcttccaaagtgctaggattacaggtgtgagccaccatgcctagccctctcttagacataattttaaacgggtagatacctaacatcctgacaatgtgggaacctatggtttggaggcatatggccttatctggcatccagaattccatctaaaaggttacagaaatgttcccaacccaagccactttaggcaactgggatactgtggtatgatttaagattaagtttatggcttctatttatttttccaactaaaatttccggttggctaaaacaaaaatcttattcttaatagacctcagctcgtttaacgcatgtcagagtgcaggcatcttccagagcttagatcaaaaaagttatttaaaagtaaactaagattttgataaacgtaccatggttatacaggatgctaacattaggggaagttgggtgaacagtacatggaaaccttctatactatctttgcaactcttatgtaaatctaaaattatttcaaaataaaaatgttttaaaaaggtaaactaagaaatacttctttgtcctggtaattaagcagtttagcatctcctcccatcaaaaacagaaaatgaactttctttaagaagaaaaaagtgaatcaggaatgaagtcacatattttattggctgatgattaaacttctaatatattttcagaaccagtttaacaaaagtgcggttgctttatatacacctaagactgaaacaaaaacaagtaaactttgtgtagctcttgtctgatttacatggtaaacatttcttgctcgtacccactattcaccatccatatttacaagtgagaaaaacgttaccatctcaaaggccacagaaatgttcccaacccaagccatgggagggaatcccacatcattgaggcaggcagcccttattttgtcctggagaagagagtcactgtatttgaggatgatgtgtatgttttctaaaggagcttgccttctgactccttcagagttggagccacagtgggtaaacctcttcaggcattgccctgcttcaaagcagacagaaacgtaaacagtggcagtacaccaggatcgggtttctttgctttagctaccaagagtcaggaaagagaaaccaggtatttatttaggtttgtcattattgctaggttttcttttaatgataagggtttgagaaaagaagtatctgttcagaaacaaagtatcacagagcctcaataggattactttttcaaccacccagggccacgtgttttttaagtcaaatataaaaacaatttaacccattttgttctttgtagtccttgccttctaacaggcatctccaactcagttattcttaaaatatgatgctagatgagacaaatagtctatttaagagcagattcaaataatctgtatagatgagcatctatgttttaataacagggtcgaaagaatttctctctctacagagtgatttctctgtctcaaataattcagtttatgaaaggagttaaggatatgctttttaacaccggaaaagggtacttaacatgatcaatatctaggatacagccagctaaagcagattgacgttacaaaataaaataaagccttctccctttgaagtccgctaaaggaacagctttcatgactcagaaagatatcctagagatcaaaaaagctctggagaaagaaaaagaactagaagacctggcttcaaaatttacctctagtacttcccagttatgagttagctgctatattaattaattgctttatataaatcatgtcatttaatcttctccacaattctatgagttgaaagttaataactacgttttctggataaaaaacctgaagttcagagaagttgaacagcaactcagaaaaaacagctagtgagagtgaagtgaggatccaattctaccacctggattgctgttagggtattgtacatgagtgtaaggaaagtatcctactactaagattttgacttcccaacctctgagtttgtcctttgaaaaagccctgcaatggtgttcttatttaccaaatggtcagagattttctcaagatattgactataaggaaaatgataaacaacttaatgaaatggcactatgaaaataaaataatctaggaacaaatattattttattttcatagtgccatttcattaaattgcagcactattcacaatagcaaagacttggaaccaacctaaaagcccatcaatgatagactggataaagaaaatgtggtacatatatgccatggaatactatgcagccataaaaaggaaagagatcatgccctttgaagggacatagatggagctggaagccattatcctcagcaaactaacacaggaacacaaaaccaaacaccacatgttgtcacttataagtgggagctgaacgatgagaacacatggacacatggggggaacaatacacactggggcctgttggaggctgggagtgggaggaaggagagcttcaggaagagtagctaacggatgctaggcttattacctaagtgatgggctgatctgtgcagcaaaccaccgtggcacacgtttacctatgtaacaaacctgcacatcctgcacttgtacccctgaacttaaaatagaagttgggggaaaaaaaagaaaaaagaaaatattagcttggtgcaaaagaaataatggcaaaaactgcaattactttttttgcactaacctaataaagtgatcttcagaaaacagtctacttttttaaaaggcaaaaaacagagtggtttatataattggaataatttttacatctctttttgatacacacttcttattttctaaaattttcacaaatcatcttaaacattaatgctgtcaccaaataaattctcacaaagtaatagaaagctcaggaaattaatatttgagaagtaaatttagaggcaaggataacttaaactgagaagcatttataattttccattttgagaaatactctgtagcatttataaacattatattttaattttctatttcaataaattaatattgtaccagaataccaaactgcatttggaatcataggcaactgttatgtttgtcctttcttgatatttgaaaaaaatgaccttccttttgaatgctgccctcataatttaaaattggccttctccttcacaggggacattcacgataaactctcaataggctttaatttggagaattttagttttgccttagcagcttttcttatatcttctcttaattctataagtttaggctttatatgttttgaaattatattgttaagtgcatacacattaattattgttgtaattcctcctctgcagattgcatttttaacctttggatgatgttcctcttcatcccttttttataataccttttagcataattctgtattgtttgatattaatatcattaccacatttttcctttgttttgtgttttcctgtgctctttgtttggtattcttctatccctttcttccaacctccccacaatcttgtaagcagaatatagataaatacttttgtaattcaatccaaaagactttatttttagtagataagtgtaggtctttgtatttattctgaaaatttatttctattattctttagacgatttctatcatgtattatgctgtttcttttctctgcttctttttttaattccttttctgttttctggtagatcattatatatttttttaattctccactttaacccacaccacaaccactttgctgattttgaaattgtggatcacaatgttatatttcagtgattacttttacattttaatatacatatatgatgctataattctaacagtttaagatcatgtaggatcttctccagtctctttaactaaagcaagcatcttatcattctttaaaatcttatctaacagcaccttccctcatcctctgtcactttccttggcattatccaaaattttatttatcttaaaacactgaattattttatggtccataaatagttctatcaatatatgccaccaattgctgtgttcatcattcaattttcatgtgccttttttcttctgtttccaatttcttatttctgaaacatattattcattagttcattcaattagatctgtgagcagatatctttgtctttgtctttgtatgtttgaaaatgccactattttaccctgatcattcaggtgaacattgaaatctaagttgacagatattttccctcagtgttgtcctatgtcttcttacatcaattgatgagaagtgttctgtcattgtaactataattctttggtaggtaacagagttcttctatctggtctttttacctttgattaccagtacttttaccataatttgtcatagaatctgtattagttatctgtttctctgtaacgaattacacagaaactcaatgttttaaaacaataaacgattatcacttcatagtttctataactcaggaagtacagagtgactttcccaggccaatgtatggattatgtttgcagtaaagatgttggccacttctgcagtcatctgaaagcttgaatgggctgaaggatctaattcaaatgtggttgactcataagttggtataaattgatgctggccagtgcagagcctccctttgtccccatgtgggtctctcctcaggctgcttgagtgtccccacactatggtgccttccttccctaagagtagatgatctaatagagaacaaggaggagttagtaatgtttttcatggtctagcttcaaaagccacacacagtcacttctgccacatcctatttgttagaagtgagtctaagtccagcctacttccaaggagagcagaggaactatactctacttttccaagggagaatttgtggacaggttttaaaactacaatagtgtcaatgcaaaatgcaccagaaagtctcagtaacagaatcacacaagcagaagaaagaacttcagagcttgaagacaaggcttgaactaaccaaatccatcaaagacaaagaaaaaataatttttaaaaatggacaaagcctccaagaagtttaggactatgttaaaagtcaaaacctaagaatagttggaaggaagaagagaaagaagataaatctaaaagtctggaaaacatatttgaggaaataatcaaggaaaacttccctggcctcgctagagatctagacatccgaatacaagaagctcaaagaacacctgggaaattcattgcaaaaaaatcattgcctagacacatagttatcaggttatctagaatcaagacaaagaaaagaatcttgagagctgtgaggcaaaagcatcaggcatcttataaaggaaaatctatcagagtaacagcagatttctcagcagaaaccctacaagctagaagaaattggggtcctatttttagcctcctaaaacaaagcaattatcagccaagaattttgtatccagtaaaactaagcttcataaatgaaggaaagatacagtctttccagacaaatgctgaattagccaccacaaagccagcactacaatctcaaatgaactctaaatcttgaaacagattctggaaatacaccaaaatagaacctctttaaagtttacatctcacaggacctatataacagtaacacaatgaaaacaacaacaacaacaacaacaaggtattcaggcaacaaatagcacaatgaatagaatagtacctctcatctcaatactaacgtggaatgtaaatggcctaagtgctccacttaaaagatacagaatagcagaatggataagaatttcaccaaccaagtttctactgtcttcaagagactcacctaacacataaggactaacataaacttaaggtaaaggggtagaaaaacatattccatacaaacagacaccaaaagcgagcaggagtcgctattcttatatcagacaaaacaaactatagagcaatagcagttaagaaagacaaagagggagattatataatgataaaaacactagttcaacaggaaaatatcacaatcctaaatatatatacaccttaacactggagctcccaaatttataaaacaattattactagaccttaaaaataagatagatggcaacacactaacagtgagggactttaatactacactgatagcactagacagatcatcaggacagaaagtcaacaaataaacaatggaattaaactataccctacaacaaatggacctaacagatatttacagaacattctacccaacaaatgcagaatatacattgtaatcatcagcacatggaacattctccaagacagaccatatgataggccacaaaacaagtctcagtgaatttgagaaaatagaaattatatcaaatattctctcacaccacagtgaaataaaactggaaatcaactccaaaaggaaccctcaaaaccatgaaaatacatggaaattaaatgacctgctcctgaatgattgttgggtcaacaatgaagtcaagatggaaatttaaaaattatttggactgaacgataatagtaacaaatagtgagacaacctatcaaaacctctgggatacagcaaaaacggtactaagaggaaaattcatagcattatctgaaaaagcacatatagacaatccaaggccacacctccaattctccatgcaattggtgaaacaagaacaatctaaacacaaatgcagaagaagaaaagaaatataaaagatgagagcagaactaaatgaaattgaaatggaaaaaaatacaaaagataaatgaaacaaaaagctggttctttgaaaagataaataaaatcgatagaccattagctagattaaccaagaaaagaagacagaaaattcaaataagctttattagaaatgaaatggaaggtattacaactgatatcacagaaatatgaaacattattcaaggctaatatgaacacctttatggacataaactagaaaacctagaggagatggataaactcctggaagtatacaaccctcctagattaaaccaggaagatgtagaaactctgagcagaccaataacaagcagaaagattgaaatggtaattttaaaattgccaagaaaaagcagtccaggaccagacagattcatagctgaattgtatcagacattcaaagaagaattggtaccaatcctattgacactattccacaagatagacaaagagggaatcctccctaaattattctatgaaggcagtatcaccctaatactaaaccaggaaagagcataaccaaaaaagaaaactacagaccaatacacctgatgaacacagatgcaaaaattctcaacaaagtactagtgaactgaatccaacaacataccaaaaatataatctaccatgatcaagtgggtttcataccagggatgcagggatggtttaacatatgtaactcaataaatgtgatacaccacataaacagaatcaaaaacaaaaatcacgatcatctcagtagacacagaaaaagcatttgacaaaattaagcatcccattatgattaaaaccctcagcaaaatcagcatagaaaagacataccttaaggtaataaaagccatctatgacaaacccacagccaacgttatactgaatggggaaaagctgaaagtgttacccctgagaactgaaacaagacaaggatgcccactttcaccacttctattcaacatagtactggaagtcctagccagagcaatcagacaagagaaagaaataaagggcatccaaatcagtaaagaggaagtcagaatgtcactgtttgctgatgatataatcttatacctagaaaaccctaaagactcatccaaaaaactcttagaactggtagatgaattcagcaaagtttcaggatacaaaattaatgtacacaaatcagtagttctcctatacagcaacagtgaccaagctgaaaatcaaatcaagaactcaactgcttttacaatagctacaaaaataaaataaaatacttaagaatatatctaaccaaggaggtgaaagacctctacaaggaaaactacaaaatactgctgaaagaaatcatagatggcacaaagaaatggaaacacatcccgtgctcatagataggtagaatcaatattgtgaaaatgaccatactgcctaaagcaatctataattcaatgcaattcccatggaaataccacgattactctttacagaactagaaaaagcaatcctaaaattcatatggaacctaaaaagagcccacatggccaaagcaagactaagcaaaaagaacaaatctggatgcattaccttacccaacttcaaaccatactacaacgccacagacaccaaaacagcatggtactggtataaaaatgggcacagagatcagtggaactgaattgtgaacccagaaatgaagccaaatacttacagttaaccgatctttgacaaagcaaacaaaagtataaagtggggaaaggacaccctattcaataaatggtgctgggataattggcaagccacatgtagaagaatgaaactggatcctcacctctcaccttttacaaaaatcaactcaagatagatcaaggacttaaattgaagacctggaaccataaaaattctagaagataacatcagaaaaactcttctagacattggcttaggcaaagacttcataaccaagaactaaaagcaaatgcaacaaaaacaaagaaaaatagatgggacttggccgggtgcattggctcatgcctgtaatccctgcactttgggaggccaaggctggcagatcacttaaggtcaggagttgaagaccagcctggccaatatggtgaaaccccatctctactaaaaatacaaaaattagctgggtgtggtggtacgtgcctgtagtctcagctgccctggaggctgaggcagaggaatcacttgaaactgggaggtggaggttgcagtgatcctagatagtgcaactgcactccagcctgggcaacagagcgagacaccatcatgggaagaaaaaaaaaaacatgggacttaattaaactaaaaagcttctgtacagcaaaagaaataatcagcagagttaacagacaacccccagagtgggagaaaattttgcaaataatggatctgaccaaggagtaatattcagaatctacaaagaactgaaacagcaagaaaaaaaaaatcccatcaaaaagtgggctaaggacatgaacagacaatctcaaaagaagatatacaaatggccaacaagcatggaaaaatgctccacatcactaattatcagggaaatgcaaatcaaaaccacaacgtgatatcaccttactcctgcaagaatggctataataaaaaataatagatgttggcatgggatgtggtgaaaagggaacacttttatattgttgttgggaacgtaaactagtacaaccactatggaaaacagtgtggtgattctttaaagaactaaaagtagatctaccatttgatccagcaatcccactactaggcatgtacccagaggaaaagaagtgattatacaaaaaagatacctgcacatgcatgttcatagcagcacaatttgcaattgcaaaaatatagaaccagcccaaatgctcatcaatcaaccagtggataaagaaaatgtgagacatataaatacacacacatacatacatatacacacacaccatggaatactactacatatacatacacacacacacacacacacacacacacatacataccatggaatactacttatccataaaaaggaatgaaataatggcattcacagcaacctggttggaattggagatcattattctaagtgaagtaactcaggaatggaaaaccaaacattgtatgttttcatgcataagtgggagctaagataatgaggatgcaaaggcataagaacgacacattagactttggggactcaggggaaaagagtggaagggggatgagggataaaagactatatattacgtacagtttaccctgctcaggtgatgggtgcaccaaaatctcagaaatgaaaaaattttaaaaactacaacaatgtcaaattgtttgtattaatcctcctatgcaatcccagtgccacttgaaaggcagtcttcaagtacttctgaaaaatactcatccccaaaacacaggcaaaaaattttgattcagtaacctaaattgtgtgtctggcatttaattgtttgtttgtttgcttgcttaaacttcataagtgattcaatgaatttcgagttttaaaagccaccactttaactgatctggggtttcatgtattgcttcaagcctagaaaatctccaccactatgtcttcaaatataacctctctgctcttccttctcttctctactgctcacactcctgtaagcatatattagagctctaaatctgttcttcccatcttttagttaatctttcacatttctgtccatctttctctctggcctcagggctgtatgatggcttaagtgccatcttctgattcattaattcttcacttgaccttgtccaagcttgagtttatcatatcttttgtgtctctgcttgttattatcaatttctagcatttctactattatatgtatttcaattttgcctgtttgttttataatttatttttatacatatactattatttaaggttcttaaactccttttgaacttctttgttttcttccagagtaaattaatcccccagttactgaattcattaagttgaaagtcaatttattattgcttagcaattgttttcctaatgtgctttgaaattatgatttgccactgtaaatcttatcatcatctctctgaaatgatttattccttttccagtaattttgggggttgccctctacttccttcattcatataagatatttcagggagcaattttaggactctattctgtaatgttttgacattcaatccagacccagtcactaaaccgtcaaaagcataacacatgttctgactacgatactatgactgctttggtttcaagcagcgagcctccaatcccccatctcatatagtacacttctagagaaatcaaacttcaagcccctttctctgtttatagaattggaactcagcagtgactacttatctgttgtgttttgtctactttcttatacactgagatattcatcttgttttttaatatggctttgtctttttaggtagcaaaaaattatatcttcattattgctatgtacttatattctacctagatgactgaattgtaatatcataacaccaacttgagtagtactctttgtgctataattattatatatcatcatataaattctatccagctgaatatataaaaataaaaatttatattattgtttgaaagaggtcaaaagtattgatgtttaaaagtgatatttttatccatctagaaaacacaagagtatcaactccaaagctactttaactaatatgataattaatcctatttacaaataaaatgcacttatgtacacatatattaacagttttcctatatagcagaaataacgcattagaaattaattgaaataatggcattcacagcaacctggttggaattggagatcattattctaagtgaagtaactcaggaatggaaaaccaaacattgtatgttttcatgcataagtgggagctaagataatgaggatgcaaaggcataagaatgacacattagactttggggactcaggggaaaagagtggaagggggatgagggataaaagactacatattacgtacagtttcattcttgttaggtggatagaagtgggaaaagggtcttatagatagtaagtataaagagattggttttggtttgattttgatttacagatattctctctcctttacaacacagttgatcaaaatggattgctactatggtactgagtttctcataaataaaacttttcaagaaaattatggattactatttaccttggatgttgaagtgaagtgaataaattatatctcagattagtccaataagagcagtcattgattattctaaataccctattggacagttccaacaaaataggatgaaaatgccccactaatgcaactggcaaataacttgtttaacaataaatgtgttcttctttctacaagagactgtgctggactttagaggaaaataaagcagcaacaaaagtctgatactaatcccagtttaattctagccctaacctccctaaagaagattacaaatcaatttggaagacaagaacaatgcattacatataaagcagttaaataaaaatttagtaattaaatgggaataaagactatgaagcagaatattttaaaaatgataagtggtaaaacaataagttcagaagtcaagagtgatcctagtaggctaggcgagcaggatatgtggaaaaactaggactactgtttgagctcgaaatgaccaaaaaagtcatacagcgaataactatacctgagcttaaataggcctatagacttttcttgcataattttctctaatttaaagtaacctcaattgtgtgtgcatgcatgtaaatgtgtgtatgttaatgcataaacatatataaatttgtatctataaagaggtataatatatttgcattagaaagaaattttgatagtctataactgaaactataatttctggtagaacttctaagcttcctcccaggaaaatgacaaatcttagacattctttcatgtcttgagttcatccactgtttacttacagtggatgaaataggtgtattctttcaaaattttgcactgcttccaatcccaaataaggcaaaatgaacaatagtagcaacaataacatcaaactgaaaaatttcaaaggaaaattaatattatctaaaattgagcctacgctcaaagtagagttcaagtatagtcctgtatagatcatggagtgaaactgaaacgagactcagaattgacctgcagttgcccttgaaccctgacaaagaacactctaagagaagaaaatgacaagtgaatataattctcaaaatttactaatggaaaaagtttactgatactctttaactttagtggaataaagttttggagataccacagttgcagaataaagacacttaatatccctataaaaacaccatggccatcccaaccactctaagttacttggctgataaaggaaatagaaaaagagagagagggagagagtttttgttttgttttgttttgtttgtttgtttttccaaacttagaaacaaacacattgttctggggctctagaaagatgtgtccagcccgaaggcattcaaatgcaatttttcaagtctaatctggcccagtcatggaccttctttcatttctcctgattgaggtatgtgatacagacagggaatctgcagtttcctaatgtccagatgaccagttttaaatatgaaagaaactaatatttatccaatacctatgctttaccaggaaccgttacgaatattgtaaaaaaaagatttcttcatttgaaggtacatttgacagacgacctctaaatctccttttaacgataaatatattcaattcagaagttttaaatagtttttgaacttgatgcttataaacaaaaaccaagaatgtaccactgagttgatggaggtagggaaagttcagacagtagaatctaaatgaggaatcacaaattcacttaaatgtaaggggattgggtgttaagtgtaaatatgagaccttctcattgggaagactcaatgtctgaaaagggggttgaatttctggctctgcacctgcagcaaatctccaagacttagatcctttgtccggaaaatgggctaattttggcggggaggaagtgaagggtttcactatttatttatgacaaatattcaacactcacaattctctccaatcagaagttctttgagatgctgttggtcttgaccagtcagagaatggagtcatctgactcacccattctgagaatggtcctacagacactataggttttaaattggccattaaacctgcctataaccttgtcaaccttggctaagttcatctggatggatgcatggtccttggcacccatgatgcggttgctggcggaacatttccactgcatgttcaggtccacaaactcaggctggataatatcaattatgttcaattacagagacatggggagagtcaaatgagatcgagtaaaaaatgtgcatgaaaatatccacaatctgtgaaagactatgcaagtgtattattgtcattgaatgttgttagcaatagcatggccattttttacttacaaataaatattgcagttgacatattactaactctaagaaaggttcaaatttacatgaacaaataaaacttcaggaaagaaaactagagttccacttggggactacgtctgacatggttatattaaacattttggaacaattaatttggttttgttgtctctcttctaggatttttaaacatttataaattctcaattctttctattcaatctaaacattttacaatatcctgtggaccttacttccttagtagattcccagaaggtaatgatttgctcctttctgctctccaagcagcttctgtgttggtgcagagttgcagatctctgttggtggtaggttctattctgcagaaaccccctaatcctctgtttaccacaacatgagtctattgccatagaaatgatagctgagatcccagattgaacaccactgacttcacagcagggcctggtaagaggagactctaagctacaaggggggaacgcaatgtatgagaatagtaggcactctgtagccttgaaagaaagggtaactgtcaacattagaataaaaattcatgaaagagctacattgttaggtatgctgtagtttattttctgtataatactgcctggctaaaagtaatcattctgaaatcttatgtcatttaacagtttgctttcaaaaggtctgcagttttccttgattgcatttgtttcttattgaaataagaaacaagcagcttctaattaatcttgttgcacaactgatgtttctgtggtcaaagatttcccttttcatgatgtgttgttttgtttgcgtgtttattgtgtgtgtttgttttgtcttgtttttattaacagaagaaagtgaacccgaacaagatactaaaggtatttttttttctttctgcatggcttctttttaattgtgtagctcttttcaattgtttatttttgttgaccttataaacagctctaagtgccatttttaaagaaataacaaacaatgtatggggaatattaagtcacagcacttaacggtgttattagataggcttctttattatataatatgcttactgaccatttgcatttcttaagcaagattgagttaaaagtaatgtttaaatttggtgtctctggaaatacaaacaaaatgaaatgaaataaatcagcatgagagtataaatcccacatagattggaaaagaaagataccctttgactaaaagacttttggtgggggttggggggctttacagtctttggataaatgttaggatgtcaaggtgccaatttggtttttattgtgatgatttcaacaagatcaggagtattatgcaattgctccaaatcaataaaaattaagttattttaattgcacagagacatatgtttgtagtggaatatgtttagaggaaaatagctggaaattaaatttgtatgggaaaaattctactttttccccaacagttttctgtcaacagtttctgttttctgtaaaaaaaaaaaaaaaaaagaaaaaagaaaaaaaaaaaaggtaccttgcattctgattaagccccaaactttgtgctcttctaacctaaaatttgatatttgggggatgaaatttgtgagttctcatgtaatagagttgactgtaggaattaatctcaaactggtattatttaaaacagtacctccttatcttagtatctcatataaagtacagataatgttttcttatttttaaataccaggttgcttacaattaaatacaggtaaaaaagcattttacctggtcctatgtgaattttttttcttaatttattcctatcagtcattgctggtttgaatcatgtaacctaaaaacccttttcaaaggaagctagaaaataacaaaagaggaagggaaaataaaatccatgggagctccttgtgtcctttgaaataactgctcagaaatagaaattgataagagacttaagtattcctctggcactgctcccttaccaagaaaagagaggtagttcatctccagccaaaccactcatttatttcaggacttaacatggatgccctgtcccttgggctttttattacactccagtgcaatttcagagtgaattatgcctttatctttttactataccttactccttaagatgacaatcaataataaaactgattacatatctgaaagtgctttgaaataaggagagagagagaatataatgtgggtatgttataaaagattttagaattgctggcttcttgagcccaattttgaatataggattctccacttgcagttagcctgcaagtctgctcaagagacattaaagccccaaactcatgaatagatcccatgagagaaaacccagagttaaatatattaccttggtctattttccatgttgcagatgcacttgcttacccacaggaaaccaagtggtttagggctcacagtgaattggagaaggatggataagactatgtacagaaagaggggtttgatgatttttttgtttaaaaatccatatcaaaacagttataaatgctttccaacttactaagtaatttaatgttccttctattaagtggtttaattgtttatgtaacaaaaacacttttatattcttttatgcagataaaacacaaaatagggatattctatgcccattttatttaataagaaacatgtcatataactttttaaattgatgacctagaatgcattttcagattgtgactaccactgaaataatgggatttactgttgacttgtgtccaagtttgttattgccggtgtattattattcatggaggttaatctggcatttatttttaattgcaactgactttattgtttacaatgcttgaaaaacatgtcaaaatttccctcatcacctttttacctttcatatttgaaaaatggtaaatttgagtattatgcaattgctcagatagagttgggtaaaaacatatcagctttattgctgataaggctggaatgaaaaataaagatttctattccatgtgaggattagactaacataacttatgtttcctcatcctcttcctccccaccccactctttccccttgactcttagttgtaggatgaagaagccctgacctggtaaacttacttacacacatcaaccctatatccttcttagatgcaagagagctgggagactgatagctcagaataggattgagatacacataacatatccaagtcccttcccccaaccttaccagagaagtcatcatgttcgttcatttatttattcgttcactcagcaaatattcattgagtgcctaccatatatatataccatgcagggttctagaaatagagacagatatgtagatagatatatagattgtatcagtcagctcatgttaaaaagcaaagcaaaccttgcccttgtgatgcttacattctagagaggagagactgacaaaaaacaaacaagcaaacaaataaatcagtaattaccaaatgattcagatagtggtgatatgatacaatataaacaagggtaaggggaatggggatgagaaagtactatgataaggaaacatttgagtagaaacccagaagacatctgctatctcctttgagaagggaggaagactgggaggaagggtggaaactaactttcaatactgaaaaaagggggttgagtttctattttatcatttagagagcatgtgagagtgcaggagaaagcagcttccctttaatccctggccttattgtcctcttaacctaatccactgcacttaatgaaacccatggtcagccatagcctatctgcccccttcagggagaagtttatcagcagtctcatattcatgaagctacctataatgtcagcagtactcctgtacctgcctgtgccacactggagcccccagaaagttcccatggagggcagagtattacattagttaaattaattccaaagtcacgttgaattgactctgttttatttaccataccacactatgcttagttgtgttgtgcaatgtggataatcagaggtttcacaataagcccaaatgatattccaaatataataacagccaaaagaaaaaaaactgctataaattaggacaaaataaaacctttccaagaagaatttaaagtccccaaattaaaactcttggcttcataaattaaagcagcaaaacataatcgaaattacattattctccaattttttattctgctcatcttcagccagaaggctttcattcaaaaggcgtttttgattcaaaaagttcaagggtatagtcaatgttactagaacagttttctagcacatgtgaggttgaaatgtgctagattttccaaatctctcaaagatcctgcttgtttcagattctcgggcagtgggatccatagatggtcatgcagtagtcccacactcaaaaaatttaggaaacacaagcatagccccaacccctacaagagttattttagccagatgatgcacatggactctaagtctccattattgtaaccagaaaacattagaagagtacctggacgcaccctcactacgatgcctgtcagtgttagttgtcaagagtctgtaacgtgtgaatttagattaagttgggagaataagaatccaagcagaggcacacattgcatttgggtgatatgtctcttaagtctcttttaatctataatggatcactctttcttttttaccccctaatgctaatgattttccctgttaaatatctgggtttgattgaattgcatctccatagtgttctttgaaatgttcctcaaccctttaatttttgtagattgttaattggaccccaggacttacttaaaatcaggctcaattttgcttctgggggacagattcagcttcattttaaacatttgatagcattctttgttattttttaataatctctttttgccttgaagacagcaccttccttgcatttcttttctcctggttttgggacccacatttctatatctaaaatatcaatatcaaaagataggaagtcaaattaatttaaatctgcaaaaagcccccaatagtcaaacaaatcaaatgttccttaatctctttaaattatgcaatgctttttaagaggtactcaacaatgagaccaactggaaacactactctggacctgttctatcattgtcctgcgtatctccttatgtagcacatgtggtctcccatactttagtttagaatccaatattcacaaatttcaatttaactagaattaagtttcaaagcattgtgctaattggggcttcatactctaatattatattctgtgcttaagtcctagaaatcaaaaagtaggagcataaaatatacttacagtataataggccatccaaaagattccgtaatagtttaaacaaacactgaatttgaagtcagaagacttgagtccaggtttctcactcatcattcttgttaccttgggaaaccaacttacttaaattaacaaagatttggttttcactgctataagataagaacaggaatctagccaatctctggagtctcttccaagtttaatgattctgtgaatctaagtaccctccaatttgtaatgcattgtgagcctcaatcccactgtttagttaaaggtaaaatttcttcctacatcaaaataacctcctcttacttaatcagtggggattcagggtcagaaaggaatagaaattactcattctgctgcctacactttatctaaaatatccttttttttttttgcccaatatatcatctgaaaagtttgacacaatttgtctgccctcccactatgatacagttgagggtgtaaagtgtaattatttgattaattcaataaaatactatcctgtgcttgctctggtcaggaactctgcctgaaacaatacagcagtcaacgaaaggcaaggcttttggcttcaaacaatctaatgggaaaggggaataatagacaagtaaaaaataaataaggtaatttcagatagttgtaaggtctgtaaagacaataatgtaggctgatgaaaagtgaatggggggaggattacacttgatgttgtgtgagtaagaaggacctttctgagaaaatgtcacttaaacagagacttgaatgattcaaggaacctactacttgaggatctgggggatgagtggtctaggcagaggaagaacaagggcaagtttccatgttaagaacaagctcagtgtgtccttgagtggtgagaaatatagggttataacataaagggcttggaggctcggccatggcatgtggtattatccttaaaacagagcaaacactgaagaactgcacacaggggaacatggtctaatttgcatttctaaaagaccaccctagcttgaccatttcctgcaggagcgtcactcaccacttctgtcttcctaacagtttttgccaggatcctgcgggctcctgaatcccacaatgtcacctttggctcctttgtgaccctgcactgtacagcaacaggcattcctgtccccaccatcacctggattgaaaacggaaatgctgtgagtgtcatgtgtgtggggacttgtctggggaagacccattggtggtgaacttcaggatagaccatatagttgtagttacccagatctctgtcattggtctcacctacaccacttttcaaagcctcccaatatctttgtcctagaagccattgccatagaaatcaaactccaagagtttgcttccttccatgtatcatgaggaatactagaaaaccaatttctttctttgtgcctttgtgtaaatgggaagtggtaataatatcttcccatataagtaaaataattttcattaaactcatcaccgaaagattagttccctgctagaggctactttgatggaaagtaatccggagttagaatcagtgtcagttcagcattcttttcttcattttcaatagtggtaataataactgatgtatattaagtagttattttcagccaggctctattccaagcactttacctacatacatttatttatttatttattcattctacaaatatgtattgagcttctgaacatcaaacactattctaggccctgtggatacaggagtaaacaaaacaggcaaagttctctgccctcaaagagcttaccttctcatggggaaatacgggaaaatatatgttgtatgtgtatggtgtcaaatgccatgcagaaaaataaatcaggaaaaggagacagaaagttcaaccttaggagaaatcagaactctcctacactgttcatgggaatgggaattactacagtcactatggaaaacagtatggcggttactcaaaaagctaaaaatggaattgccatatgatccaccaatccactactgggtatacagtcaaaagaaagaaaatcagtatatctaagaggtatctgcactcccatgtttattgcggcactattcacaataaccaagatatagaatcaaactaagtatccatcaatggatgaatggatacagaaaatgtggtacatatacacaatgaaagaaatattactaatccataagaagaataaaatcctgttatttgcaacaacatggatggaaccgcaggacattatgttaagtgaaataaaccagacacagcaagaaaagtatttcatgttctctttcataactaaaaaaattgatctcatggagatagagagtagaatgatggatatcagaggctgggaaaggtagtggggaagggaggataaagaggggttcgttcatgggtacataagttagaaggaacaatattgagtgcttagtagctttattagtcagttctcgcatcgcgataaagaaatacctgagactgggtaatttataaagaaaagaggtttaattggctcatggttctgcaggctattcaggaagcataatggcttctgcttctggggaggcctccagaaacttacaatcatggcagaaagcaaagtgggagcaagacatctcacatggccagagcaggaaggagaggaaaggtgccacacacgtttaaacaaccagatctcacaattcactcactcactatcatgagaacagcactgaggggatggtgttaacccattcatgagacttctgtccccatgatccaatcaccccacgccaggcccaactccaacactgggaattacaattcgacttgagatttggtggggacacagatctaaaccatagcaatagcacaacaggacaactatacatagttcacgatattgaactacatagcacaatacaatatttaagtatttcaaaatatcaagaagagtggaattggaatgttcctagcacaaaaaaatgacaaattacttaggtgatggatatcccaattatcctaatttgatcattacacattgtatgcttatatcaaaatttcacatgtaccccataaatatgtacaactattatatatccataaaattttaaattaagaaacattttaaacagaaagttagacctcaggaggaagattatatttttaaaagaatgatcagtgaaggctcatttggacaaagacatttgaacaaagatctgaaggagttgaagggtgaagttacatagataactgggggaacataactagacaaagtctctgagataatggtatacatggcatgtcagaaaaacagcaaggagaccaatgtggttagtggggagtaagcaaagggtcaagagatgagaggcaggcattgtggatcctataggccgtgtggtcatttagacaactttgcttttatttgagtgagatgaggtgccactgtaggtctgtttctgttgtctgttttcccactgattcttgttcattttgtgttgtttccttgtgtgcctagctatctttgattacctgctgtgcattgttttgtataaaaatatcaggaactattttgaggtctagatgaaggtattttcctccaaagagaattttgcttgtttctgccagggacaagaggttactgctaatcttgtaccaccttcaactaagctcaaggtatgaagctccttgggcatcccagataattataacatgaccagtaattcattatgtggactatttaacttgtagttcacactgatagctccctgatatctagttcttttatatcttaatttattatatctcttattagactcttaagggcatgaagttttgatttatctcctgactccctaaggccatccaaaggaaagttcaaattttctgggtttggaaaactctctaagggtaaataagattttcttagtttgttacatctgttaaaaatttttttttcaaaattttaattttctcactgtgtagctttgtctgaataacctaacatcaacatctgagacagaaacctaccatggatttttattgtcattatatagactttaaccactttggtttgcaccgagtctttagtttctgatactctttatgaggttaagaaaatgtatttttattcttaatttgataattatttttaatataaatatattttaaaatcaataaaacacttcatcatcaattacatcctctttttgatgtcatttttcactttaaattgcaaagtttcccttatattgaaccattctttcatttctgaatacattgcttttttgtttaattttttaattgtgttgtttcaattttctgtatttctttcaggattatttgcatctattttcaataacagaaatggttttgtcttttagtaggctatcatgatcaggctttgttaatatttttccaatcttatagaatagactgccaagtttacatagtttcctttgatacagagcttgaggtgagaaagttgagatgcaagtctttcttatactccaagacattttcctctactataccaataattactgcttctctcttctccacatcctttctatgtagactccattgaaatgaatttctttcaaaacttcaatctttctcttctttatgctctgcatatgtttgtggaggaaatagggggccctattttatctgtcaggttattctcaagctctagtgtccaccatgattgtcaactataggaacccacaacagaaaatctcattcgcaatctctatctcacaggtagatgcctcagcctggtgccatatgcatacattatagctcccagagttcttcaattactttgctgactttcttaaagttggctcctgcttacagcccctgctatctgaagtttgaaattttccatgactttgtagggaaaatgtatccattctcctctcagtaaacctcttcttttgtgctaggtttcagctacttagttgatgttaatttttctatctatcaaatcacctctttttatcttccagaatttgctggaaatatctgatcctttgattataataccatctttctatatatttacttttcttaattttgtatttatcttttaggatttcaggtccataaacaagggttaaacatgtgagctaagattattattactgtaactctgatgttaatgaacatgacttgcatagagcactatcttattattttctttgtcatttaaaaatattcagcagagcaagttcttttgctactatctaagcctaccttaagcaggctctgtgatttttctggttactattagatgatttgaaatcattaacattatcccaacttagtcatttaagtgtctagtcctaagtaataaccaaagcatccaatggcattcacagttcctcccttctcagggatatttcagcttaactttcatataagaaaaaattgcagttggcttcttacctcatgctcactcattcttcccccatttcctagctgctctttatgaccccagaaggggtgggtgggaggtagggaggagcaataactggtgcaagagagctctaattcaactgatgcacttgtaagttggctttataccttctgtgcctgccagatatttaaaactgactcttaccctcatagacctattcatgattcttcagaaatcagggaacattaagatgataccagtgatgcattttcctcaggctatccatctttggccacattagcaagtccccaatttgttagttgatggaaagtctctttgtgttggggtctaatcagtcccccaaaaagtcatcttgggaggactgaaaatgactcccaatcagatcttctataaaacctttttattgacaaactctggaagcccagaccattggactctgtcttctttgttccttccattggagctgccagacatcctttagattttacaggtgggaattacatacttgtctaatgtgtctccaaattgcaagtgtgttagagtccccaagatcacattcatgtctgatgattcatgagaaggactcacagattttagataagctgttatgattatggcttattgcaggaaaaggatatagattaaaatcatcaaagaggcatcagttttcctcttctagtgaagttgcatggacagcacttcattctcccagcaacaatgtgtgacagcatgcatgaagtattgtcaaccaaggaggctcaccctaaccttggtgtccagagtttttactggagctcagttacatagatgtggagtgctcacataactagtcttagctagtttccagcccctccaaaggtcaaactaatacaacgtggcctaggattccaagtattcactatcattcacattattatcataaaccatccagcattgcccaaaatctcagatatataaagatattcttattacacaggatattccaaggggcagaggtcatctctcaggagccaaaggccagacctttctttggaatgtgtagggtttgagcacctcgagcccattgagttagcccttcaactttttactgcacagcagtaaaacacatttataactctccgggtggtcccatggaggatacttttatcccttaaggagatgggtgcatgtccaacccagtcctttgggtggattgagaatggctttcaatatggctgaacaacccaaacctttataactcatctaactggtggctattttcagttttcatttcctccaggacaggctgtccaactttttggtatcttggctgtagtgaacatatattatcatattacaatatattaatggtaccatttggagatcaaagaagtgtcccaaatcgggacactttaatatccacatcatcccaaattgtgtttaatgcaagcatcacaacaagaaaatgggggacttctttttaaggaaggcaaaaccttatggtataattcaaatgatattaagtataatttctacccaatccaaggcacattccttcatggacttgaactatttcatgtcttcatgactttctcttctccaggattacattagtatttagggctgccataatagaataccacagatagggtgtcttaaaaaacagaattttttttcctacagttctaaaagctggaagtccaaggtcaaggtgctatcagggttggtttctggtaaggcctctcttcctggcttgcagatggcttcacatggttatctccctgtattctcacagggctttctctccttgtgtgtgcacttctggtgtctgtgcctacaatgatgagcgccaaaaatcccagagtgttttttcataacacagttctcattccaaaatagtttttattcctctcttttatagaccattataaggtttcttcctctaaattaaataacagtgactaaaactaaggcaaatactctggagcaaaataaaaactaaaaaacagatagccttaaagcaggaagttaccctgtcactagggcttggcatactgtaggctttagaagcatttcgcggcatgaaagaatggtaaccctgaggcatctccatgtaataagttaatttgtatactgcttttaaataaagttaaacaacttacagtttcagaaagatagaagggaagagcattcggaagactgggagtgaagtttcccgggcctgaacccttattcaaaggcgtctcgacatggataacctcgagaacattatgctaagtgaaataagccagatacagaaaggcaaataccaaatgatctcacttatatgtggaatctaagagttgaactcatagaagcacagaatagaatagtggctgtcagggatgggaggatggggagatgatcatcaaagggtacaaagtttcagtcatgcaagatgaattaagtactgtagatgtaatgtacaatatggtgactacagctaacaacactgtattgcgcacttgaaatttgctaagagggtagatcctaagtgttctcaaaacacacacacaaaggtaaccatgtgagatgatacttcactagcttgattgcagtaatcatttcataatatacatatatatctcaaaacatcaccttgttcaccttaaatatatacaatttctatttgtgagttataccaccaataagctaaaaaaaattaaaagtctaaatttttttaaaggagtttcaaaaactaatgctttgctctatacttgtacctggccccacccttgtctctctaaagcagggtgccctaggaagactgattggctgtagccccaaaaggtgagaactaggacataagataagaaagggaagaagggaaagggagagaaggaagtggggaacaaagtgcgtcaatgtgtgaaattttagttggatgttgtaaaacaggaaaaaaaatgccaaattctatggctaccccaataacaaagaatgtcttatggcaatggcaccctccaagtcatataattcatttattattgtcactttcactattgttttcgctgaagtcttttttctgttacttgaacaaaatcatttttttcgtaatttgttaataaaattgtttcattttatctgtctatcctacatcccttcaaatacagtacacaaacaaatgaacgtgcttttccagcttgtaacttgaggcatggtagaatgagaattagatggggagttggaagactgaggttgtaaatgcccctctttagttaatgtgattttggggtccgtttacaactcagacactgattttctcatatctatctacactaacacagacgtcaggtggctgtcaaagatgatctctaatggtataattagagacatcagggctaatgttctctaattttgtccagttatgataaagtaacttggagtgcctgttctttacctctctaagaacgtttcaagtgtcatttaaaatttgattcttatttgtcaatgtgttttttggctcctctgtggaaactgttatagtcttaagcctgtcaagggagtataaagacatcctaagaaaatttggagactgggccgggtgcggtgactcactcctgtaatcccagcacttttggaggccaaggtgggaggattatgaggtcaggatggagaccatcctggctaacacggtgaaaacctcgtatctactaaaaatacaaaaaatttagtcaggcgtggtggcacatgtctgtagtcccagctacttgggaggctgaggcagaagaatcacttgaatccaggaggtggaggttacagtgagccaagattgcgccactgcactccagtctgggcaacagagagaaactccatctcaaaaaataaacaaaataaaattgggagactgacaatataacttcactaatttgtctatgtaaaaatagtaataaagaaaatggaaaggtatatactttttaaatttctagtattttcaaaagattcatatgaggttataaatggaagataaatgattattctctgtcgaagtttaggaataacaagagtaggatagtttaagatagttgaggccttattgagaccccaacttattcattcaacatgtgactcacaaaaagtgaaaggcaaaatagatttatcacctcagattctaaaacaggaataaaacaaacaaagtgactttcatccaggaagaaagcaaaagtacatccgcagttcttacggtcagagagtgtgtgctgctcttagagccaagtttagttcttggtaattctacccaagtctgaaaggaaatcaagatgactgtccacattgacgcaaatcacaggacatggaggcaatgtcaggcatttaatgttgtaaaagttgcaaaccagaaatcccatggaggagaacacagagaatcctatagtcctgatatcatttttggtggaatgaacaaagacgaacgcagagctgggagatatttggcacagaatgaaacagagtttgaactgtggctcttcactcactacgagttagtaaactaatgccatagcacgctgctcagtacaatgggtactctgaaagaagtgagtgctccctttctcccctgctgtgaacctgccagtgaaccaaaacccttaacagttagagccaaagagcaggagaaagtccagcaacgtgtcccaaagtgattagaaactatcttgctttcctcctatggaaataccaagcattttttgtggaaatctgaattcacagatgaagttcagagtgaatagtaacattccttttgttttacaatcttggaaatagtagtttggcatggaaagagcagagcttactttttaaaaagaaaattatttgtatttttataaccagatttatttatagttataccagtaatatctctgttattttggcatgcaactaaaaaatatagaaaaatttcatgtccctcttgctttgtccaataaatataatttctaaaatattgtagaagttgaataattttaacttgttagaagaattttataaaataaacagccaaatcacctaggttgaaggttgtcttttagaattttcttaaagggaggcatatctatatttagacatatttttaagaggcagtagttttgctttaaaatatatgacctgtgaagtccttttatcttactagctgtgtaaaccaaaataattacatgtaacaagtcttatgtggaataattcagcagccagtttgaaagaggctaattaatatttgtggctacattaatcagaaaaactatggaaatgtctcttggtttattatccctttttctatgattcataaacagacattattacaactgcataaacatgaaccctactgggcaacatccttttttttttttttatttttttccccaagatggagtcttgctctgtcatgaggctggagtgcagtggcgcgatctcagctcactgcaacctccacctcctgggttcaagcaatgctcctgcctcagcctctggagtagctgggactacaggtgggtgccatcaagcccagctaactttttgtattcttagtagagacagggtttcaccatgtgagccaggatggtcttgatctcctaacctcgtgatctgcctgccttggtcttccaaagcgctgggattacaggcatgagccactgcacccggccctgggccatattctaacagttccacaggatatttccagccagctggaactatctgcaagacagggccattgaggccagaatacctttcagaggtcttccctagctaaggtcaaatcataaaattatcggattatccatagctgggggtggattctctcaagaccgcattagtaatgtattaatgatacattaagaagtactccacaggtctataactgctcaatcaccttcaaagagtttttacacacattatgtcaggcatgaattattatgcctatttaatagagcttcctatcctactgcctctttttagaaaaaaaagttttattgtgatctttattgtatacatttaaggtacaaaacatgatgtttagataaacatatacagtgaaatgattactatagtcaagcaaattaacaagtccatctcctcacatagttacagctaacttagaaagacagaacatcacacccagagcagggagctgtgtctccagctccctcaggtccatatacctgagtgacttggagaaaatcatgcatttcctgtaactaccagacgtagtcacctcaattaagtaatctgttttgcttaggcataccttggtaaaagctcacagtactaatctggacccacccctttgatctttgaaacctgaggtgcgaaaaaatatcaaaatggagggcagagggatttgtttttattttcagatcatcaaaaatactaaactgttgatcagaaccatccatgaagaaagaaaaacaaattcaaactatgactaatggggcctgctgtgcgtgagtcacaaactgaatcaagcaaggcctctggaagcagggggaaaagcattcaggagtcactttgtactcaagcatgaacctcctaaagtgttggtctctttgctgaactatttcaacacctggatgaagtccaggagaagagacgtcaggcagtttaaaaattgcttctctttcctactaaggatgttttcagtgaccttgaggaggtgtttaagaatgactttcttaggtgtgaacatgaaaacagtgggacttagggcaacatttggggagattccttgcttcaaagttgtctctaaggcattgcacattcctacttcttgcaggagggaactgtctttccaaaggattttgcaaactgttctgcttttgcttatctaaactggaaagagatatataaacaaaatataaaatacaaaataacataaagtctgttgattgagcatagaggcttggggtctttagctttttttcttattgttgctttgtattaaaattcaagggagtccaaatattttcagtccccttgatctaactgggatactcatacaatgagacattgcacttctgataaatatgataatgatgagtttagtttgaattcccaactgagtgcatgtctcttaaaaacatttttctcttcactttgtaaatttcttatagagtctaggttgctcatctggggaaaatgccacaatacttgatctgacctggaaagattcccagtgaaggtaaattgatactcacataagccagtttttatcataagaattgagactagtactgaaggtaaagaataaaaagctagttggacaaacgttcactgcatgattgctacacagtgcttggtgccagggatagccagccacctggcagctaggaagaaagctggccttacctcagagctttcttcttcctggctagtcaaactgtgaaaatcctttctcatgcaacacaataaaataattggctccaaaatgtctcattctcagcctcattccctaatactggacacaggaatctctttcagccaagcagccaagctcaggccaacatgggacgtacctccactcctttaagataaagtcaaagcataacaccagctgattccttaactgtcatttcactccagtttccctcaattggcatcatgtttccctgatataagcagcgttaattaaagattagttattgaaaaggtggtattgtgctcaagaaaacagtgaaaaaagaaccaccatttaaaaaaaatgccaccaccttaacaatgacatttgtcagatatgtattttgttcatggttggttgatttgttaaggtagttgttactcttgttttctaatgactgctcatttgttctctcttctaggactagggaaggcactgtaacataatgattaaaagcataggctttggtgtcagacacgctaggatgcaaattctaactatgcaaccttgtaaaatgtgctgggcagctatctttcctacagagttggagtaatgttgactaatatatatgcatttgtataaattaagctgttaattgtgtgtcaatattgcattgatatcttggctctttaaggacatttgattttctggtttaagtagtacctcctgcatgaacttcctgacgtgttgaactatttcaacacctggatgaagtccaggagaagagaggtcaggcagtttaaaaactgcttctgtttcctactaaggatgttttcggtgaccttgaggtattatgtatgtattatgtatgtcatgcctcagagacagacttggcttcacaaccatttttcctgacaaccatccacctatctgacatgcatttatggggaactgaacaggagttatgaaaataagtccttaagtctgcaacctctcatacttaactgtcatctgtaggacactgaagacatatatcagaggatccacaccgtatataattcatgccttgtattggttatctatggttgtatcacaaatcagcccaaagcttagtgacttaaaccaataactattagtgctcacaagtctgtggttcaactgggtggttttgctgatttggttttgctgctgggcaggactgcctgatcttggctggtcaagttcctgtgatcggcagattgaaaaggtggtagttggttcagaatagccttatgcgtaccttggatggttgttgttggttcccacctggggcagaggggataaacgggccaggtgtgtttcatcttctaccatgctggctcttgcttgtttataggcagtcccaggttccataaacaagaaagcaagccacaatgtgcaagaacgttagtttctgctcattcattccaaaacacatcacaaggctaatctagattcaaattatggaggaaaatgctacttcttgagggaagagctacaaagtcacattgcaagggcatggacacagggagggaaaatcttttggctatgtttgcagtgtaccacatgcacttgattataatcttaatgcttttcccttcaaatctactgacatagtatagtgggaaatccttgactgagttcttttattttcctttactctgtcaggtttcttctgggtccattcaagagagtgtgaaagaccgagtgattgactcaagactgcagctgtttatcaccaagccaggactctacacatgcatagctaccaataagcatggggagaagttcagtactgccaaggctgcagccaccatcagcatagcaggtaggatgccccttcacatttgcgttgttccaggagaggggagagttgatactattctacaatatcgagcattggagaaaatctcccttttcttttatctcttatttcagttgcatttgggctatttcctcccccatggggatactccggaggtgacctagatatggattttggcagatttgctgcctggaaaactaaatcctcaatacctacccaagtggtaggtaacagcttccaggaactcacttcttccttccttcttgtttttcttatcttttttccttttctccatttctctttcctccctccctccttccctccctcgctcccttttttccttccttctttccttccttcccttattccctccttcattcctccctccttccctccctccctcttcccttccctccctccctcttttccttttctttaatttcctttccttttccccactcctcgttctctcttttggttgatcaaactttccaagtctctcatggagaaagttggcagacattcaacatggtcatgccaatttctgcatggctatttcttgcgggcatttttacctgtgagcatgatccctgtggtctttcccttccctgcttcagcaagccacagcaggtcttacaggtgttttcaagaaaaaggctgacacacggatttctaggatgtttgtgttgagttctaaaggtttatttttaaaatgtaaatgtcccaaaggcttctgagaacatttatagaattcctagagatggaaataatccctgtatcaggaaatgccaggcatattagattcatagcgtgcctagggctcaagggtcaggagagaggtgcttggcctgacatgtaaggcaagcacggatagagcttgtgcctagggccaactccccacagcctgctgtttcttattacagtgccacctctttgatcttccctgatggggaactttccagtaatgtctgtgatttgtaatatgaggtgaataaaaaccacagataaatgataaggagcactggacaaggctggccctctgggactgcctatgaaggaaaaggaagacttcaaaattaaggttccctctcctttctccccccagtgatatctctgcctaccatgtcttcagacaccatatcagttattctagcatttccacaggtgggaaattatttctcccagaaaatgaaaagtcttctaaaagtaaattcaactcaatttaacaaataataataatatcacataataagtaatagtataatcatataatataaatagtaataagaattactatttacatagcactttgctgtttataaagcacttttacatgcatttatcaaatactctagatgacgcccattgtgttgggtagagtaagagatgaaaagttaatttaaaaatgggtcctgccttccagggactctgcatctagaaggaagtcagtcagtcacgtatattatggcactggctgtattctattgcagaagcatacacaaaatacaacagcagaacaagagaggcaggatgtcagggaatccttggaaaagaggtatcattggagcagaagatgtggatatgagatgactaggttgaagtcaaacctttcaaacctgttcaaaaaacagcaaatcagtggtcaaggctagaccacgagagagacagcagggaggtggaaagtggaaacaaaagttgaaacatgggctctagccaggttatgaagagcctgcataggtttagtatattatttcattgatgagaagtcatttaatgatttagaagaaataagtgcaatagatatatcctctagcaaattaacagatgctgaggtgttaggaggttgagaagtgcggcaagctgtcaggaggctcttccaggtgtctcaaaaagtcatgaaggtctgaacagcagcagcagcattggttcaaagggaagaggagagatgcacaggacaaatcaggatagaaataaggtttgcaaatgcttgaaaatggcagtgggctagaaggatgagttcagatgtgtctgattttgaaaggtgcccaggacaagcaataatatataaacacaaagcatatgaacaggagaaggtccaggagataatagaatactcaaaaatgttgatgcctttgaattacctggaattattctggtctcactgtctttgtattatttgacatttgatcaagacctactgttaaataaacatatatttataaaaatctatcaatatatatttatataacatatatgtatgtatgtgtgtttatatacacacacatggagagagagagagaatcacatttaaatatgaatactccatccaagaaaataaactgatctactttaatttaacctgcactttcactggcagaagaaaaatactaatgttactaatcttaggagagtctcatttcaggtcattattcagtcactcaaagatacccgtgccagagctctttctcccttttcttccttctttctctttccctagatggcaaaggagaagaggatttgtatttaggcagtggtgtcttctggacaccccccacaccactgctaacccccggatctctagtgaagtctgcagctgaacttgtgattttatctcttggcttggttagggcccaggggacctccctggctggcttagcctgtttgagacatcttttggagcagcacagccctctgcatctcagccaaatccttcatcatgccattgtctacactctgctctgcaacctcagaagctaggtctccctgtctgtccctactgtggccctgtggctggcctgctgaattccaactcagctccttcagtactcctcacagggcctgaagcaacttctagatcactttcaaggcatacagaattcaggagagatttgggcttgctaactcagttctgctgtctgcccaaccttgtcatgctaccattttcacattaatgttgccatccatgttggagtaagggatccctgtggggtgttttacttatagcatcctaaataagaagttagaaaaactccatctgcttttggctttttccttaattgatcaatacacctctattctaggatttgcattcagaaaagggatctataaaatctataaaatatccaaatttttaatctccctaccttcctccttttcacagcatatgaagctggaagagcaggtggtcaggaatctcccccaaccttcagtgcagtaatctttagagcctactcatcataagtacaaaggtggttgtgaaggcagtgctataaccactgaggggaacctaataaaatgggtatatctactccacacaagggaagattcatcccatggacacaatctttaagatgccgagaggactacagggcatgattgccaccatactatatgcagcaacatcatgacttcattcctgtcctagcccagatgagaacctgatccaactccataaacggaacaccaacagggaaatctgtaaccttaaaaaaacggcatcttccagtggtagaaagagcctaaaggtctgagacaggcagtataggaaggccatgtcctagggtgtagggagaggtcatcttagatatcagtgttgagaaagaccagaatgaggatggggacaatcagcaatggccacccaggaaaaataacagtggaatttgcatgggggaagggatggtgggagcaatgcaaagattggcatgtggcagcagagagcaacttgcaatctgctgcagcagcagaggtgagtgcctatgaagagcagttatctctgtaggaataatggttgtgtagactagaaccagctatgacttttcatgagcttgacaatggcagtgcgatggaggtcagctttagagtggggagaagttggggaccctggaagtgaggcttgaagccactctggacaggggtatgtttacagtagctacccaaggaacttgggtagaggtagagaaggcagcataaggagagggttaacctataactgggacctgggactttgctcttctgaaccacaaaggcaacaattaaatctgaccatatacagaatcatagtgctgcacgatgttcggagtcaagtaaagaaatgagagttgttactcgaaaactgaaaaatggaaaagactaaaaaggtctagagtggatatgataaatgagaaacatgcctattaattaaaaaattgctacacatctagtgttattccctggaataagacccttttgtccaacccctgatttgtttgtctggttgattctcactgattattaggggacttgacactcctcgacttttcccaaaatttcccgaggcagacctaataagggtgtgtcatgagtgtgattgaataagacttctgaactcccatgagacaacttccattttctcttcctctttgacctgctcttgtgagttagacctgctagaagccccatgaaggtccctctggaatcactgaggaaactacctcccaacactggggtgctccgtggactgatattttagggaaatgaggctacttcgatgaaaaagggatccttggagcctctttcattcagggtcatttgaaagaagcatggccttatgctccccagatctcccagaactcaagtatggtatctgctttctccatttctgcttttggcccctctctcggcatccgatgaggctggccagaagtccagaacttcaagtcagacatggcgcctcttttgccattctggcaatgcttccttaatgccaaactctgctgtctcatttaaccatctccatcctcccctatgtgactagtacccctagtagtcaacagccccctctgtcatgttcctcgtgtttccctttgaaatttctactccatctgtttatttgctcttcccagcaggaaaactggaaatggaaaaagctgatcttatgcttatgcttaggattatgtctaatgatatttctagtgtttgaaggacaacaaaaaataaagatcaggcttcatttttccaaaacccttccatgtgtctgcccaaatccttatgcattgttttagaaatgtgatatatttctttctgactcatttacatttactgttagtcatcaaaaggagtcagaaaaacttttggaacctctccctatgaaccaggaagttgcatttcccctccagtcacaaccccataaagcctcaagttgcaaagtaaacttgccaggatgctgggcatttggcaagatgcttctctttgtcatcagaaccctcagccctgtggaagaaagcaagacagcctatgataccaatagtgagcatagtcctaaaacagccggagaccatgaaaatggacacagggattcagaagagaaaaatacaggccgggtgtggtgactcacacctgtaaccccaacactttgggagtccgaggtgggcagatcacctgaagtcaggagttcgagaccagcttgggcaacatggtgaaactccatctctactaaaaaatacaaaaattagccaggtatggtgacgcatgcctgtaatcccagctacttgggaggccgaggcatgagagtcacttgcacctgggagatggaggctgcaatgagctgaaattgcaccactgcaccacggcactccagcctgagcaatagagtgagacttcatctcaaaaaggaaaaaaaaaaaaaagagagagagagagagagagaaataaaatacatatttgtatttcccattctcaatggcaccaacaggtccttcatcagagagtgcagtccatggttctatccatgtttatccagtctcagagtacagggacgagcctatggtcacacacccctctaatgtaagccgctccccattctaccaacaacccccactttctatattgccccttctttgaatcgacctcagggtctaagccttttggtcactaaatttaaaagtcacatgaatacaagtagtatcaaaactgagcaggagggaaaaatctgatgtggtaatactggagtctcccaaactccccagatgaaccacatggttttatttttcttatttcaaaagaggtgatgtttcacactactacagaaaaaaaaaatggaactttgaacactatttcataatcagtatagctgattgaatgtactgacatgtttcatgctctttctcatgtctgatagccacactcctgtttcctcccaatgttggagataattcttgagacttggtaacagagcagtagcacgtaatttgctttaccactcagtgcttcaaccatcataggtaaagagtgttcttatcaacaaaacagacaccatccctggcattccatgctggctttctctggttttaaattaattaaagtcattttgtttttgttcttaataaaagggaaaaggataaatgagtaacagccagtagccacattaaattgctaccagatgttctgcagttaggcataaaaggtaagcatccttttacaatcaggcagctttcttatattagaacagttctgtttcagaagagagccaatgtttttgctgacttctagataattttaaagatactataatattggtggatattttaagaatttttaaatactacaaatattggtgggatattttgagaattttttaaaattgaattctgagcttaaagcactttatagttgcaaggttcttggaccccttcctcatctcctagccatacacccccacaaaaataaaagaaaatgcaagtggagacatttcctatagaagctcattatcccctcccaggtactatggctggattctcttttgcattggcttatctccatgctccttccacattacaaaatgagggctctatcatttacataaccttggcccccttgcttttcaatagatcttcctgctcagctgctattagaatctgcctttgtatttccaaattatatgccattttctctggaagaattttccagtgttccactgtctttcttcccactattgtatttgtataatggcagaactgccatgagatttgggggcatgaaggcacttctttcctgagttcagcagtgacatagagttctcttcattctctttcatagcctttggtcattttaattaagagactcttgcaggcctctagcccggttcactaaaatttaaattctctctaatttataatttgttgacatcattggcatcacctcttagatgatcaaaatgacaatcctataacccagcctgcctatctcagtaaaacagaaagaatctactagatgtttttcagaatgtaaatagatataacatttataatgattttcctattgtccagcaaattatctcgcagttggagtcctgcaaatgttagagacatcttgatgtttccttcatagtcactccagagtctgttagttcttatgtataaagaaatttcacaaagaaatccagcttttctcactgctaaaaggatgtggccttctgtccctaagcaaagtgacccatttaggggagggataaaattttagagcttattattggctaaaaccctactctggatcaaaagtttgtttttaaagtgcattgtagattgcagaacaactatgaatcactcataaagagaggtaacaaagacctgaggctatatgtgtaaccagtgtattgaacaatttaaacctgacaggtacacagagaaaatggtgttttctccaaccaatggggactgaggaattatgccttttagaatctccttgcccttctcaagagcaaaccctttacaaactttcaggcagattccataatttccaggtaatgtttagagattaaaaacccagcctgatctagtttaaaactctcctcttacataatttaaacctcatctgcttcactctctccactgccagccaatcttccattcaggaacatggagagtagacaaaatgggtctgctactattatacacccttcccttcttccctttcctcctgttcctcttcatctctggcatatttaaggagaagaggatttacaaggaaggcggcaaatgtgttttcctaaatggaatatgttttagttctttctctgttaattgttattgcttctctgactaataataataatgttaacaattgcaaggtacattctcagtgcccagtgccatatatatatacatatatatatatatatacacatatatatatacatatatatatatacatatatatatatatatatgaatttatttaacacccacaactcaatgaaatggatacttttattatccccatttcacagatgagcaaactaatgctcagaaaggtgcccagtctgacacagctagtaaatggcagaaccggtattgaaacccagcaggtgcagcatccaggcttttaatgccttgatgggttattaatgtctctctattgcaggtggtacctgaatactgactgtctcctaggacatttgggttctttggagggtccttcggaagactgtgtattgcacagtgccctgatgtgggagattctttactggttcaacctctcataatccccagtccttgatctcaatccctattgaggtaacctgcaattgcttatgactggggttctttgtctggtgtccagtcttcttggtaacttagctaccttcatagcatccactgaacacacaggaatgtcccatgtccctaccatcccaatggtggggagttctattcctggaccctctcactctgccctcagattgttgcaattctttttagacagtaatattattaaaaaaaaaaaaagacaaaacaaatgctttccttgtctctgagtcctagtctcttaattcttaggcagttgaaaaatgactccatgagatgtgttgttaccatttacattgtatcattcaagaatgagaagatctagggaaataattcatcccctttctccttatatttgctgagatgcccttcatctttacttgaaggctgagaaccaaagctatttgtctggttatagggcctacaaattgcaacaaaggttggggtgattgtgccttttagtaaattccaaggaaaaatgtcaagttgtatgtgtgtgtgtgtctgtgtatgtttacatatttcctacgtgtgtgtgtctgtgtgtgtgtgtttacatgtttcctataatcatttgtcttgctttttgagggcattccaactactggtggaaaaaataaataaatacaagggggtccatgctgtgagtagttgaaatgaaaatactggtgttttgatgggattaattcagtacatttataatagactaattcacccaaaatcaacttctaaaaccagtttgccttaactcacttaactcaatttcagttagcctgatgactattgcatctaatgttgaaaattcagaattaaaaatgaaatattggctggatacagtggctcatgcctgtatcccagcactttgggaggctgaggcgggtggataatttgaggttgggagttcgagactagcctggccaacatggtgataccccatctctactaaaaatacaaaaattagccaggcagggcagcaggtgcctgtagtcccagctactcaggaggctgaagcaggataatcgcttgaacctgggaggcaaaggttacagtgagccaagattgtgccactgagctccagcctgggcaacagagtgagactctgtcttgaaaaaaaaaaaaaagaaaaagaaagaaagaaacatttaccaaataatatggctgagtatttatgactaatttttgtattgctaatactttatcacatatagggaatcatgagattgttacatattgttgtgactgtctttttctgttccagtcattttgaacacttgcattattctttagccaatttgtcaaaaaaaaaaagtctttttctttacaattttgaatttctgctaaaaatatttagtggaatgaaatttattccattaaaaaaacgaaccttttgattattattgtctccttgctactttcctttattataagagtctatgaactctacatgtatgtgtatatatatacatatgtatgcattaaccaaattagcatactctcagagctcatttctgtttagtgaggtattcgtattttaaaagaataaagaaaaatgggtccctcttttgatcaccattccatgttatttatcaagagatgtaattgataaaggttttattttgttttgttttgagacagagtctctctctcttcctcccaagttggaatgcagtggtgtgtgatctcggctcattgcagcctctgcctgagctcaagagatcctcctgccacagccttccaaatagctgggactacaggtgtgtgccataacgcccagctaatttttgtattttttgtaaagaaggagtttcaccatgttgctcagactggtcttgaattcctgggctcaaatgatcctcctgcctgggtctcccaaagtgctggaattacaggcatgagccaccatgcctggccctaattgataaagttttaaaatgcaaaatgtgcatcatttccaaatgaatttatagtgagaatcataacattttgaaaaacagttttcaaaatgccactggagtgttaacaaattaataccatctgtgatgacttttccattctgccaaaacctgataaagctctgctgaagtaaagaaattggtttcacagagccagcacactgaatgggcaaaagctggaagtattccccttgaaaaccagaataagacaaggatgcccactctcaccactcctattcaacatagtactagaagccctggccatagcaatcagataagggaaagaagtaaaaggcatccaaataggaagaggggaactcaaagtatccctgtttgcagataacatgattctatatctagaaaaccccatagtctctgcccaaaagctccttgagctgttaagcaacatcagcaaagtttcagggtacaaaattaatgtacaaaagtcagtaaattcctatataccaacaatcaccaagccaaatcagaaacacaatcccattcacgattgccacaaaagaataaataccgaggaatacagctaaccaggaaggtgaaagatctctgcaataagaattacaaaacactgctcaatgtgcttaaagcaatttatagattcaatgctactgctatcaaacaaccaacgacattcttcacagaactagaaacaaaactattctaaaattcatatagaatcaaaaaagggcccaaacagccaaggcaaccctaaacaaaaagaacaaagctggaggaatcatgctatcttacttcaaactatactacaggactgcagtaaccaaaacagcatggtactggtacaaaaacagacatatagaccactggaagagaatagagagctcagaaataaaaccacacacttacaaccatctagtcttaggcaaagctggcaaaaacaggcaatggggaaagaatccctatttaataaatggtgctgtgatagcaggctagccatatgtaaaagattgaagctggatcccttccttacaccatatacaaaaatcaactcaagatggattatagacctaataaaacctaaaacagtaaacctgaaagataacttaggaaatacattttggccataggaactggcaaaaatttcatgatgaaaatgccaaaagcacttgcagccaaagcaaatctgacaaatggaacttaattaaacttaagagcttctacatagcaaaagaaactatcaacagagtaaacaggcaacttacagagtggagaaaatatttacaaaccatacatctgacaaaggtctaatatttcagaatctacagggaaattatacatacaaggaaaaaaacaaacaacctcatttaaaagtgagcaaaggacataaacagacacttttgaaaagaagacatacatgcagccaacaagcatatgaaaaaatgctcaatatcactaatcattagagaaatgcaaatcaaaaccacaatgagataccatgtcactccagttagagtggctattattaaaaagtcaaaacataacagatgctgtctgagaccagcctggacaacatggcaaaacctcgtctctactagaaatccaaaagttagccaggtgtggtggcacatgcctgtaatcccagctgcttgggaggctgaggcaggaaaataacttgaacccaggaggcagaggctgcagtgagccaagatcacaccactgcactccctcctgggccacacagtgagactccacctcaaaagaaataaaaaattaaaaaataacagacactggcgaggttgctgagaaaagggaactcttatacactgctgctggtggtgtaaattagttcaaccactgtggaaagcagtgtggtaagtcctaagataacaaaaacagaactaccattcgacccagcaattccgctactgagtatatattcaaaggaatataaatcagtctaccataaagacacatgcatgcaaatgttcgttgcagcactattcataatagccaagatgtggaatcaacctaaatgcctatcaatgacagattggacaaaggaaatgtggcacatatacaccatggaatactacgtggtcataaaaaataataagatcatgtcctttgcaggaacatgtatggaactggaggccactatccttagcaaactaatgcaggaacaggaaactaaatactgcatgttcccacttataagtgggagctaaataatgagaacacatggacagaaagaggggaacaacagacactgggatctacctgagggtagagggttggagaaaggagaggattaggaaaaaaaaaaatagaacaactttcgggcactatggttagtacgcgggtgatgaaataatctatacaccaaactcgcaagtcacaagtttacctacacaacaaacctgaattatgtacccccgaacctaaaatcaaagttaaaatattcttcaggatcactgaataaaaagctcataaagattcaaaaaagtcatacactcaaagttataaaaaccttctagttaccaaccctcaccaatctcaaagagaatgattagaaatacaagctcattgtattttaagaagattgacctctcagagaaattcatgttacagcccttaaaaatcccccccaaaataacacccaaatggatctaaaaccttcaaaacggagttagacctcaacattaggagaaattttaatatggcaaattggttttagacaaagcatatgttttactgtttattttcgtaatgagggttgagaggacaggacgaagtaaccataaagcacttggtaaagagtgtgaagtttttaatttacaagaaagaaaatggaataattcagaaatgctggttatatcacacccttgccgggattctcatgccttggcagagtctgagttggggctgtttgtcctgggaatcacataccaccagaggagaggcgtattctcctcagagccctgagtttttacatccgtgagcatgggcagctacataatttgcagggctaggtgttccaaaaacggtaaggatttcaaggtagggagagcagaacattaaattaagcccgaggcccttctgagtgcagatgccatgcagctacccagggcacacagccttgaggcagccaggtctatgagaacaaccattgcctactttctcttctaccctctctcctctgcatgttcttttcttttctccttctccttcttttttctttttttccaagtctgctttatgcatcttctctgttaacctccacatcttgcttttttttttttttttttttttttttgagacggagtctcgctgtcgcccaggctggagtgcactggcgcgatcttggttcactgcaggctccgccccccgggggttcacgccattctcctgcctcagcctcccacgtagcgggattacaggcgcccgccacctcgcccggctaattttttgtatttttagtagagatggggtttcaccgtgttagccaggatggtctcgatctcctgacctcatgatccgcccacctcggccttccaaagtgctgggattacaggcgtgagccaccgcgcccggcccacatcttgatttcttaatgtaaagtccctgggtagctaatggagggaaattctgagcttagatattgccttggtggatgttacccatgattgactcagtttgaaaagaacctgcttcctaaagatactcaatattttcttcatttcctccgaatctgcccattaatgcagcatctggcctcctagcagaagcggagaacttttcagaaacttagagatcagtagtatcaaaacaatctcagccaaagcataagatgaaaatgtactaacgttctttcttttctcctttaatttgacttcctgtgggaacttcctttcctgttaatagaatggaggtaagaaactgttattgtaacaattgtttccaatgttttgttttgtagggatttcgtttgtttgtttttgtctgtgagagggtcttgtgttgcccaggctggagtgcggtggagtatgttttgtttttgttatttgacatgccatttattgagtgtttactatttgctgagcactgtaacattttagaaactttctaatttctaatccttttagtaagtatgatgaagtgaaagacaggtaacctctactgaatacttactatggatcgggcactgtgctgagcttcacatgcattatttaaatctatcttcaagacatccccatggaatgggtattattgttatctctattttgcagaaaaaaaaaataaaaaaacctaagaaagtttctttgaactggagagttcaagtggcttacacagccagtaaatgataaagttagaaatggaacccagaactgccaaactcccccttatagctctaacctatatataagaaggtatcccttgcaatataaccttttgcaacttacagtgttttatttgcagtacttttaaaactgaccttcataaaactctatggagtgtaattaattttaagacagcattcttagcacatagcctacgtttaaaaacaggcagcaggatacaaaattttggttagatagcaaaaataagttcaagagatttagagtacaatacagtgactatcattaataacaatgtattgtattcttgacaaccactgagaatagattttaagtgttctcatcatcagaaaatggtaagtatgtgaggtaatgcatttgttaattagctcaatttagtcatcccacaatgcgtacatgttttaaaacatcatgtggtacacaataaaaaaaacagttttttttaactaaaaacaccttttaaagttttactgttaaaaaggtcttaagaaataccatttggatgtatatattgctctgaaaagcagtgaaaatcatgatacacattatatgaaaaattaaactagttttaagtatataggatagtgatttgtcataattgactgcattccagtttgttaatgtggtatcaaaaattctcagttcaaaaaaaagaaaaaattctgagtccattttttaatctaaatattgctttaataatttttattaacaattttggagctactgccttagcagagtaaagtttatctaaactaaaattaataaaagtgccatttaataaccctccttctgaaaaaaacaggcagcaggccaaatttgtcctgtgggttgtacttgctgacccctgccttggagaataaattatatacaaagacactagacgcgaaagaatagaaacagttcccgtttgctttgaaggttggaagtagcacagaatctgtcattacctttgttgggaatgttcaaggagagataaggcagttgctaaaaaagggaagatttgtctgaagcagaggagaggtacagctgtcaagtgtgcctgtgcagggagggagggaagtaaggtgtggagtttccactagagtcttggggttgtcataacacaaacatgccatggctggtcatctggaatgcccttgggacaaaatattatgtgttcaaagggagtagacatctccctcagagaaacttgaagataacattttaaaatgttctattgaatgtgattcatgcgtttcaaagtagagagaaataggagtaagaggtgcagtgagaattctttacctactccctttgaccacatagggttgtctgttataaaagaagttgaaaaggagatccgagatcaaatatccattattgcctctacaagaaagggaacttttctgaaagagaagtcaactgagtttatattgtaaggaggcaagagagggactgtttccatgtgcaatattaactagcattattagaagctagtctggctgatgattccgaaataaccagcattctgtgaatggatccctgtgacctctgtcccacggttctaatgagcaacaggaccagctgcttctagtgttgccccatcagcagtaccacgaactgcaggcagagaaacacaactttagctggacatggaggggtcttgtcacttacaaaagacaacagaagacaccaatggaaattatttgcatttatctcattccccagttcttgctgtgagctccttttaaaaatgtttgaagtgatagatttaggggtttgagggacaaaatgttccagttggcctctgtgtcttgcatctagaatttgatcactgtgtaaaattgaaggcttatatttctgcacaagaggagaggaaaaggaagtggttgaaacactgaaactataggtagttgatagataaacaaattcagatatatataaatttagatagatagatagatagattagatagatagatagatagatagatagatagataggtaggtagatcatcggtcttgtgtgtgccttaccttttagagctaatccaagcactgatataataccaaagccaagtccttaattattccaggaacatcatagaaatgaaatgtagaaaactaataataatcatatactttgtatgtgtatgttttttcccagcacataaagggtttgtataagctagtggtcatcaagctgttaggaagaaaaagcaaaattaaaactaagatcttctcatttctattcaaaacctattgtctttttttctttttcatttttattttgcattatatacttaatgctgtaaaactaatgaggattcaatactagcagaaattcagacagaggggttcattattagttgattgttagtaatccttatctctgaagttattttcattaatttttcttttgtgtactttttcttagtttccagttttttaaaaaagtgtgttttgatgtataattaaaggaaacatcatgaaatgtctattatttttaaaaatactcatggaaaatgagtaacagcatcattgaatagttaacacatgacagcaaaacctgaatgaataattctcagctcggagacactgagaaatatttaatttttacatggtggagttttttctgttaagcgtaaagagtcacacatgctcttattcatccccctttatgccgagatattacgtcaacatgtgagaccatttcgtaaaccagtttgagatatttctggttactccttattatatagtttcttaaagcacagtgtagaagctggttagggattaattcctttccttcccatcctaacagtcatggctgacacctatataacaatgacaggttaacaagagaagagcataacaaatatgtttgatcacagttttacataacatgggacccttcagaataaagaccccagatacagggaaagcaatcctttttttctgagacagagtctcgctctgtcacccaggccggagtgcagaggtgcaatctcagctcactgcaacctctgccccccagattcaagtgattctcctgcctcagcccctcgagtagctgggattacagatgtccgccaccacgcccggctaatttttatgtttttagtagagactgggtttctcgatgtcggccaggctggtctcaaactcctgacctcaggtgatccacccatctcggcctcccaaagtgctgggattacaggtgtgagccaccacactcagccaaagcaatccatttttatgcttaggttcaatgaagtatgaacagctgtgtagaaatatgattagacacaaagggtatgatctaatgctaacaggctgagtggggaaactagcccatcctgcttgttcagatttttctcagcccctctgtgcagcactcactcctcccaggcaagaggtaggatccctctggaatgagggtctgaatttctttatggccaggtgttacacagaaaagctgggggtgggtagagtaaatgtttaggttttatggctggccttgaggaaaaggcgttctggtgtctgatctgacttggagaagagggattctagtgtctaaggtttgcctgagggaagaaagagaggagagacaggagggcagaaggtctgtttctgaggctgcttcttaggccttcaccttggggtgtcgtttactgagcctcaacaacagcatccttgtttctgtctaattttctctgggggttttctcacctttaccttgagaaagtttttgtggagttttgtgctttcttattcaaggccttcattttaaatattcccaacaaacaaagggatacagtaaaactcatgttggctaattagaaaaaggccagtatgaattaaaggaagactctatattacaaaatattgttttaaagtatagctgtgtttcttggaagttcatcattttacctgaatgtattatatctcattccaatgaatttgctttaaagacctgccagtggtggtttgtaattatagtattaattttttaaattcaattggggtcacgtaacaattttaaaatttgacacaaattctaatttgtttaattttcttactttaaattctttatataaagacaatgaaaaactaaattcgatagttgtacaaatctaaatgagaatataacttaagagttttcttaagtcattactaacactatggaagatctgatagaacacataagaatatactgagaccatcacagtgcctacacataataagtattcaatatatgtttgtcaggtgagaatatgagttgttataattcccagcattatattaagggaacaagtagatgtgtgaagagagtaccaatagcattttccattctcccaattgtcttcagttattatagcagataagtttttaatcctatgtttgtgctagcactagcatttacaggtttctccctgatatatggcccattaacacacaataatccgagttcagagtaattacttacatcattcaacagaatagatcactgaggcactgggtgaccagttgactttccatgtgatgagacatgatgagaaaacagcaaagctgaaggtgctacttggctcctctggaagccatatttctgctttctcctccctacatcactttctttttctttaatggaattctaggaagatgtgtgagtgggagaatctgagtgtggaaggtgttgcaaagatgtatatgttgtcaaaaattaaggtaaactatcataacacataaataaactatgttcctaaagctgcaaactttttaggtgagagcaattattcttatgctcaattatttgttaaccatcatgatgaaatgtcttccagatgcatctttgcttatatcagcttattaactaagagtagtcagattctatttataatgtaaaatattaaaaatacccaaatctattcagtccttcatagttcccaaagctttccacatctatcgtcacatttggccttctcaatagccctgtggagtagctagagatgatataattgcagctggaaatgaagacaatattcaaatggagcgtgtcaaccaatttactagtacaattttctcctatttctgagacacagatgtgaaaaccaaaaaaaaaaagaaaagcagaatgaatgccaagaaatagcatgtgattagaaatgttgttcatttcttctttcagtaaaccacagaaagataacaaaggctactgcgcccagtacagaggggaggtgtgtaatgcagtcctggcaaaagatgctcttgtttttctcaacacctcctatgcggaccctgaggaggcccaagagctactggtccacacggcctggaatgaactgaaagtagtgagcccagtctgccggccagctgctgaggctttgttgtgtaaccacatcttccaggagtgcagtcctggagtagtgcctactcctattcccatttgcaggtaaaatctcaaaaataagtcaaaggaaaaattccatttttctatctgcacaacagaaggagtttttgaaaaatgttgtaatatgcaacagtaaaaggaaaagctggttttcatccaaaataggaggttaatgcctgggtgcagtggctcatgcctgtaatcccagcacttcgggaggccgaagtgggtggatcacttgaggtcaggagtttaacaccagcctgtccaacatggtgaaaccccgtctctactaaacatacaaaaattagccaggtgtggtggtgcacttgtaatcccagctactcgggaggctgaggcaggagaatcacttgaactggggaggcagaggttgcagtgagccgagattgcaccactgcactccagcctgagtgttgagactctgtctcaaacaaacaaacaaataggaggtaattaatcagacaatatttctaccatataaatcactaaagataacctaaaatacaagtacttagaacctctagaaaatatcataaatggtgtaatattccattactcttgttattgttcacattattatcatatccataaatatcccagatttctatcagatgaaaggagaaatcttaaacatggacctcattagtaagccaagatagagaaaataaaaactgtacattatttgtcaataaatgagatcatgccaagcatctctgaatgttattttaaagtacattccatccaaaattctaagttctgatgctgttgcctcatttgggtggttataggaaggaattagattataaatagatattttgttaaactcccatactttttaaatattgaaattgataaatttatgttcaatagaattatcttcatctttaattacttcttatgtagaaaaaaaagaatctagtttttgagctaaatagaacaaagttcaaatactgttagttctgctttctcgatgtgtgtggtcttggctaaacttcagtttcctcatctgcacggtagaattgagaggattaaaggaaaaatcacactcatggaatatgtcagaaactagatagacattgttattcctaaattttctgttgaggaaaccccatgacaacaaccaacacagcacatttccacttctattttgataaaaccagaaactatttaaatattgcaataatttgaggacactctctatttagcattcaataacaacagtatggtcattaaattagagttttgtattcctcaatttactgcaaagtttgagggtttggagacactataagagtaatataatttgtttattcatctaagaagattgtattgtgatcaggcatgttatctaaaaatctctagggacttcagcattgacagaataagaaggggaaagagaaggagagaaaaagtaaaattactgcaaaaaaaaatgggaagagtgggtgaggggcagtaaaatttgttttaatagaacttaagaaatactgatgctatttcaactgtccttgcagttatttgaaaaaatagtgtctctgttaattatcacttctttagtttagatttctctttcttgggcttctttataggattctccaaaattgtttatttgacgtactgctcaacagtgaaaatccttttgctagaaagtagcacgtgtataataaacagaatgtaaccagcaaaataaagtgacagtagattctatcagcttttcctttagtactactaacataatttgtggtggccacgggatagttatcatacttacacagtgacactcaggcaaatcagctcaacaccatggatagatgcttgagagaaataataattagattagaaaaattctctgtgtgtgtgacagccattgtggttttctgattacaaaacccacaagactccattgtataaaaaaagaacacagtactttcattgctaaaacccagaaagttggtcactactgaggtgtgtgtttacttatatttacttatatctatatttctgtactctgaattctatttcatggatggtttctctatttttgcattagagactttgggtttaattactgtctttataattaatttcaatttgtgctacgaatttcgcaggttttcatcttttaaaaaattattgtttactcattatataattatttttattacatgttgacattggcaaaatgtttctaaatttcatatttaaaaataattatataagttatataatacaattatatattaacttaacaataattatcaataataattaataattattatattaataataaataatacttaatatgatataactaattataagctatataattatatattatagtatataacttatataattgatataatttacaattatatattaattatataacatataattaatatataattataattatagtttataataatataattatatattatatagctcactatataattatttttaaatataaaatttagaaacattttgccaatgtccacatgtaaataccatttagaatttgatcagaatgatgctaagtttatacaattaacttagggcacagagctatatttacattactgagtattctcatttaggagtatggtatgccattctttttatgtagatcttgtattatgcctgctagtaaaatttgatgatttctttcttacttttttttaattaaatttatgactaggtgtgttttatagtcattgctgttgttgcaagagtattaattataatatagttattacaggaggctagaatgtccataaaacatagagatgcaattaattcccttgttccttattttaataaaactgccattaatttctttagaatttgtacattttagagttgaactatgtaattttttggatcatattaatcagatttctaaaaatgtattcttttttttgaggtagttagttgatagaagtataatttatatacaagaaactgtgccccttttaaccatatagttcagagtttgacaaacgtatacaacaatgtaaccactaccccaatcaagacatagaatgttttcaccacccataaatttctcttatgctcatttccttcttttttttttttttttttttttgtccctgggttcaagcaattctcctgtctcagcctcccaagtagctgggactacaggcacctgtcaccaggtatttttgtatttttagtagagatggggtttcaccttgttggtcaggctggtctcgaactcctgacctcaggtgattcacctgcctcggtctcccaaagtgctgagattacaggcgtgagccaccgcgcccagccctcttatgctcatttctaatcaacttcccattatctctaaaggcatcgtcgttctgatttctctgacaactagttttgcttgttcctgaatctcatactcatgaaattgtataatatatactgctttgtgtctgacttcttttgttcaacatgtttttgatattcatccacattgctacatgtaacagtggtttgttccttttcattgcagcttttatttgtgtggttgagatggaaatagttatgtgaagaagtaggtagggtcaagctccccttcatgctgcctaagaattataaagcaattaatttgaacaactgcagtatcaaaaggaaagttagtatagaaatgttaggccactcaagatgacagactcatcagccacaacaaaaaagtcagataccagctttagacacaaaggatcaaccaaataatttattcctgcaatttgtagtttattccaattttgtttggtattatacctcctaattattgagaggaatcaagtctcatcaatcataaatcattaatccttgccaacaaatgtgtattattttccattttgttaacgagttgttactactatataataaagccatttcattttattatatttatatacaacaaccgctttacagtattctattagatttttgattgatagtctatggttcctctgatggaaaaatatggtctataaattattatatatagtttatatataatataaaactataaatcttaattagattctactctttcttaattgaaatttcagaaatttttactagaattaaaattaaattttatcttcatgtgctagcacaaaatacatttattaactttccagcatttatgtcccagatcagtttacatgcctgagccacagatgttctttctaatcttgaaaataattcacctttttgaaagaaaaaaatccctttcattgaaatgttaaatttattagaaaatcatagttatttcctaaatctatgtcattcacagtatacatttaaattttttttctaattcccattgttatttaaataagtagttttattgggaaaatgttattttttaaaatcctcatcatcaaatattttgttcccattgaagtaagaaaatataatctaaaaatttttacattttaatattttatagaggttttttctctgatatataataataaaaattggcatttataaagacttagtctcttccattaacatacaaaattcatatatttatgttcaatcctttctgctcttaaatgagtattagctatttggtccaatagtttaatagtgatgcgtcaaaattttcacaattgtgtttccaagaatgttttcttgcaattctgactcctgctttttgcaccaagaaatattaaactaaaattgaatttactgctgataactggtaagtttgatcttcatttttttgttatatcttttgaaaaagtctctacctttattcatcaaactagttcagaagttgtcaaccattttatattctacttctacttgcttgtgatatttttaaaagcgtgctatcactcatggttttctaattattaggttggtacaaaagtaattgtgttttttttccattaaaagtaatggcaagaaccgcaattacttttgccccaacctaacataagcagtcattcaatgatgtgtgcctcttttcatgaacgacatggaattttattgtctaacaaatatttattgatctccttctgggctccaagtactacactgagcatttgggatatattaatgaacataataaacaacttatatataactttagaaggtgttaaatgtcatggaaaaagaaaaaaggaatgctttaaggaagaccagaaataacaaacggagaggagaaagttgtaactttaaaaataaggtgttcagggtagacttaattaagttagcataattgtactgaatcttccacacttgttctttgaaactttacctgaaattatcaaccgtatttgtattgttcaattatattttatttgcatatgctcaatttttggaacattattcttagcttttacatttgatttcataatcatgtataagtagatacttggaggagcttatactatgttacttatcattgatactcattgtcattcatttcaaataaaatatttctttttcttaaattcctaatttaaattcacttcttgttcattcatctcatctttactcatctctcattcagctggagtaggtgtttttcacatgtaaaaaaaaattctgtcattgtacatatgtgtttttgactgggtatttaagtctgtgttaacacaagtgttagcttttgcgttagttctcctcacttgtgttacttatcctcaaaactgtggactctgaccaattattttctggccatgttgtaataaagaggaagaagaaagcaatcctgacttttgttcctttgtaaggaacattttcctctctccagattgtagaaagattatttctttaattgttgagattcaaaatatttgtaaaattcatttggggatagatttattctcattgttttctttcatgtaatataaataatataaaaataatgggtaatatgccctaaacattgtgcccttttcatcttaaaaatgttttcttataccacatctttgattattttctattttttatgtgctctggttctcttgctaagaaacactattatttgattttgaacttcttacttgctccaccttatcagttatttcacacattattttcatctgtttagcccttcttgcattcagttaggtcctttctttctgcattcaattgaatatttaattcaaatttgtttatttcttgcagtgccatttgttttctattttcaatgaagattgttaagtgttggttttattttttgtggtttctattttctgtagttacttccatgttcaaattatcctactttttagtctatagttcatcttgatttgttttttcttgtgaaaaactctgctatagagggcatgctttagtgcatggcaatgaaaacaaagcaaaccaaaagccattcattaatgtgttcttctgtttagaataaaaaaatttcccaggtatttgcttcttctgcctaatgtggagtatggagttgttttcatatgtcccatattgatttacactttaactatgctgtctgcgtgcaaaaaaatgtgcttatacaacccaggggtggaaccaagctaagcaactctcctcaggtcctttacctgctcagaagtcttgaaagccccattatactcccttctcccttacgcacaccaagaattataaatcccattgttttcttcatataagaatatatttgcatctcatcacattcatatgcacagccttttattctatgcatactcaattagcacatattggcaagttaggaaagtaggagtgtgggaataagtatgaaaaaagacaccattgtggcatatatatacacacacacacacacacacacacactcttacaatttcctcctctctgaatccttcagatactgaataaaggacatctgctattattatgtttaatttatttaattatctttaatttcctcttattattaaccccaaataccttaatttgaaattaaccaggtttttcctatgcagtttgtcctattttctatcaggcttaaacaaatactaatctgcaaaattccaagtagtccaattagtgtttcttcagccccttcactcataatacaacatgtagatgaacataacagcttcatattcaaacagataatactttggctttctcagatggaagcacgcagagcaatgggacaggattccgtgcctcaaagtaagggctgagtaaggacccagatgccctcctataagctgccagggaggtggtggtgttctgtttcagaggacaaagcacacagaggcccagactgtgttcctcgagccctacccattagccccaagatcatagaaaaatcttccaagctggaaactggttgacaatgatcctgactttcagtaggtgtgttttttaaactctgtatacctttttcctctacctgtgttgttatttgaatatgaagttgggagaagacatatcagagattcccaatctaatacgttttaaatttgacgtttttttcccttagactagcattaattgtgtttcacaacaaaacgagatagcatttcatctcacgggacagtacactagatttcatgaggtctcatattatttacagtaaaaagtttctttcataaacgcgcttttttcaagaacaatttaccatgatgatgtcttgaaaacacagaatttaggctctgccacaaatttgctttaacatgtaatgattcatcaagttttgttctccatatactattttagagagtactgcttggcagtaaaggagctcttctgcgcaaaagaatggctggtaatggaagagaagacccacagaggactctacagatccgagatgcatttgctgtccgtgccagaatgcagcaagcttcccagcatgcattgggaccccacggcctgtgccagactgccacatctaggtaacacagagttctcccaagactttggaggttaagagaaatttactattttgaagaaactaaggtgtgaacttaaagcttctaatatttctaggcatttctaattttttttttttgagttctgccttccttagatacctactagcggaatcctaatgctatcctaattgtacagattagcgtaaagatttatttcatttgctctaaaataaatgaaacagcacttttaattactgcttgacattttagattctttcatagggaatcttatgagagcttgtaacattttctggagtgtgtagaaaaatggctaagaaacatcttatattttgtcagcagagtggaataaaggaataaagtcctttttcttagccaagaaagcatgctaaaataagacacatgtttgaaaatgctgatctcacaaaacaaaattgaattgcttcatgttgctttaatgaactttgtttgtaaggaactatgttgttatccctaacagctggtttaatttcaaagacccaattctttcacattcgaatgcaaagaatgttttccagttgtatattaaaaagctgagagagaacttgcatttcttagcactcactctctcacagaatatgtgagatatctggatgctcacttaaaacaaatttttatcctttccccttcagattataacaaagaaaacctaaaaagtaagtaattgtgtttgtgcccttgaaaccttatgtgtatgtaattggattcatgcatgtgtgtttacacttatatttcctgatgcccagaacagaatgtacagccgctctcaaagtcttctcaccatactcatccagggtataacatgagggaaaatcatggaaggtctcagtttataacttttaattagaccgtagagagtaccatatttagtgagtcatacaaatgctatctcccacctcaaggtttttagtctgttttatttcttatatggctataagtaagccaaatttaaaatgtcaccttttgattttatattcttgattcagtataatctaattatgtatagatgaaacccaacatttatttcttcattgagccaattcatgatcttcatttgtgacaatagatccctcttttggaagttaggtatttttttaagacagctgatttccagtataaagtttataggatcaaatcaaatggctttaaaaaggtcatcacaaaaatctctgggaaagaattcaagaaggttgcttgaaaagggatgtcgtacaaaataacttgtatcagatagtgctttaacctgtcagaatgcagaaatcctcaggatgaaattagaaaagcttttcatgtcaactaacttcctctggtctcagcgttctaaggcttaaatcacacttacttcctgtaatacatattccagccctaatctcctctgcatttgactaggtgccaggacttgattttaccagcttgcttaaaggaccaacacttaaaagtattaaaagcaagaatgctactggtcctagttgaattactcagaggtattaaacaagaagagttatggaaaccttaaaaatctattattctggtagcctgtcaaattgttattcccaaatcgaaggaataaaaaaaaatttcaattctttgttatatgagcagccaaagtttactttgattggactttgaattgattactgtgctctttgttatccatcgattgctcactcatccattcaaacattcattgagggtttgctgtgtggaaggaccagaccattcatcttaaattagacaggaacaatacacaaaaaagcatccacatttctgcctttcacactaattataaaggaattttgagcagcacaaactagctacaataataaattttctagtctttaaaaaacagctttatgaaatcttcgatacatgtaagaaaatgagctcctaatgtcatgaactaaccatttaaactgaaagtagggcagggaatatctgaaagtatgctccttgagttaaggcaattattattaaaagagttggctttagcaggtcaatagtggagcaaagaaaacatccttattaggcagtgtcccatattttataggggtgtgtaaagaccttaagtattttccaaagagtgtcttgatttctgagtaaactctaaagaatatcaccagctcatttggaggggtcacaaaagagctgttaatcatttgtttatctttgcattattttcttcttccttgagcatagggactagaatttcagtagtttttcttttttataatttctttggctgaagtgaaacatctttttgagcaggcaatgcctttgtgctatttacattatttgtaagcaaggattacactattcctctcttccgtgagacttcacatactttattacagaaacactcagcagtgaatctgtcttctatttcagagcttctgtggagaaaaggttaatttgtcttaatcattgaaataattacttttctcttgaattctctttttccttccatctttgctctttctatacatatacatggagaataaaggacccaatgaatgtacccaaatccaaactgactagtgtgatacatacattatctctcttaatactcccaatagttctacaaaattaagtactatgaacgtcctccattttacttacaacccaacatgagaaagagagattaagcaatgtgtccaattttacccatctagtaaggtgataagccagaatttgaactgaaatctatctgattctggctctgtcttcagagccagaatgttatacctgatgcatttctgttattactaatgtttcttaaaaaattccaagacctcatgtgtaataaagcttaactgattgtttaactgattcattcttgaataaattccactaccttttcacatttgttataattgattattcttaagaagctctaattgataaaaattttattgttcacaattttaaatcacccaggccacttgatgatttgactttttgttaacatttaaatgaatacatgctttgtgtcccagaccatttttccataatgatcagctactattttgcccacgaatgaaatcatgaagcgtcagtgtctctgtgtgtgtgtgtgtgtgtgtgtgtctgtgtaaaactcatgaattatttcataatttgaaatgtggtttgggtaatttttgtggtaatattaaagttacaagttcttagaaaattggagtttaaagtaactttaacagttatttaatctaaagtctcccacaatgaaagaatcttttctagagcatctctgacagaaacattccattttccctcctgaatttatttctcaattcctttgtagaatacattaattatttcaacaatttagctatgtagaactaaattctggttctctagaactgtcaacaactgatcttcactctatttctttgatttatttataatctgtatgatagtccttaaaatatttggagacaggcactcaatctctctgtagtcttctcttcttcacattaaatatctccaatttttaactttttcttttgcaactgacttccaaaatcctcacctccatgtttactttttactggctgccacaagcttgagaatatccagaactgaacacaaagcacagaacatgatctgatcagaattgcaatgcaaccatattttctgtgataaggccttgttcttttatgagtatagattaaactcatgctagctgtctaataatttcatgacattaatagcccttctatacacatatgggtttactgatttccttgattttctaataaattttctactagaccaatccaattcataattatttttattacattcttctagcatttataataatttgtactttacatgtttagttactatgttctatgaggcatagtgatccaagacacttttctttttatatgaagctctttaccaatgtaaaatgtcactcttgtcttgttttagtgcttttagctttaaatttctagtattaataatggtaattttttccttgtatttatgttaacctagcacctctttgttcctcttttatttttcttttcttataaacaacatatacctgggtttactccaatcagatagccattttctattaataggaggatttagcctgttcatattttatatcacaactgatatactctattttatccctactatcttaactgtatattttctattcgctttacgtttttgcttcttctttttctttttctttacttgttactggttatgttttctccactgctaagtgaaagtcagacaccaattctttctacacatcgcagtgctctatttattcttcatttctgcccaccccatgggactttcagaatctccaggagatcctcagactgcttggatcttcttccttacctcccctggtactcttaggtttctctttgcagagtgattctcaatattgagtcttacctagcgaattagccaagactccacccatcacagccccttcacatgtatcctgaagttattttctgattcaattgttattaagagtctcctcatgtatttccttagaagggaaagtgtcttgggagacagaatccctgaagccttgtgtgttatcaaattgttttcttttatttgggtagttgaaaagtgtattaactgggtatggaactcctgagtgacatttctttgggtggtttatagatgtgatttcactcttttctagcttctagtgttggaagcaggtagtctggtgtgaatttatttttttcctgtaagtaatttattctttctatctaggcagaaactttttgatttttccctttatccgtgatatctgtatgataaaaattgtttaatcatgtgctattgaacatctctttccaactccatgatagggcttcatgttgggagcttgagataagctatgatgggaatctttatcccattgaaatcaggatggtagacagacctttctaatgcaaaaagttgatcatgctattccacctcgtaaaacactcctataagaccctccatttgctgcagggcatagtccaaattacttaaattggtatacaaggacttttatcactaaacctgatatctgcagctttacctatagatactccccaactccaacaatgaaacttctaggtgcacttttagaaaggcatcacatctgcttagttcagatcttggtatatgctattacttctttatagaatactatctctctaccctgactccattctactctcttaattcccccatcccacacacacgtttgtgtgtgtttttttgttttgttttgttttgttttgttttgttttgtttgagacggagtctcactctgtcgcccaggctggagtgcagtggcacaatcttggttcactgcaagctccgcctcccgggttcacgccatcctcttgcctcagcctcccgagtagctgggactacaggcgcccaccaccatgcccagctaattttttgtatttttagtagagatggggattcaccgtgttagccaggatggtctcgatctcctgacctcgtgattcacccgccttagcctcccaaagtgctgggattacaggcgtgagctactgctcccagcccacaccttttccttagtctgttcaggttgctataacaaaatgccacagactgggtggcttatacacagaaatttatttctcacagttctggagtccaagaagtccaagatcaaggtgccagcagatttggtatctggtgaggacccattcctcatagacatagctgtcttctccctgtgtcctcacatggcagaacgggcgagggagctttcttggacctcttttataagggcattaattccatttatcaggactctacccttattcatttcaacacatgaatgtgggggaaagacacaaagactcagatcatcataaccttcaactggttactggctactcaccatttatgtttaacttacagttactcactctagaaaaccttctcagtatgtctaaacctgagttagtgccagccctgaacgagactcacaagcatcgtgttcttactactcctataatgcttcttatattttgttttatttctccatttattcacttgtgtctcatgacaagcaaagacttctcatgttcaccacagtgttctggatacctaacagtcactattgatttagtgaatgcatttacatatggatgaatgagtgtataaactcccgtagtgttcagaggaaaagaatcaagacagaaaattggtgagagaaaagataaaaaggaaaaagaatgacgattcaaagtgatcctttagacccaaagagatcattgatgtagttcaagggaagatcagatcaaatcagaagcagtcatcaaggaataacaaaacaaaactatcttgaaggaaagaaacatttaaatccataaagcaaaattattgttccaactatgtcatttcttgcattttaaaaaaactcactaaatcatcatagatttttcttttaacatgacagtaaattctactttctgattctttttagaaaaactaaccttatatttaccagtgaaattacactaccaactttactaattacattatattccctcacatgttatatatggtgtgagatgctctgtaaactccaaatacaaaaatagttatttctccctatcttttaataattgttccaactttattattagcagaaagcaaagctcgtcaatttaagccaccccctaccaccaccacccacccatcttagatcgagaaaacttgggatgactcagtccaaagagaatcagactagctttcaagtcagtcagagaggaacctggtcagtctgttgagtccaccactcctgtggtgccggatgaggcatgctgtcactgatcttgcgcagatgttttattgctgtgctgatgttcttccagttccaggtgcctgcctgagtcacagtggtgaccaggcctggcatccgcaggcttcagaatcacttgcttagccattggtactcagggcataatcactgggtccacttcatgtatgactaagaagtcatacatgagcgtctcttgtagcctccaattttgcaagtgccctatttcaaatgctttaggcatctactgccataaaggttttattttgactttgtaatatgttatattaatatgtccccttctattaaatcattattctctgactatgatgtagtcagttgctaatatttcgtttaggatcttctaaacttaggttgtataatctatgtatgctcttttcttctgtgctaacattgccaggttgtgatattggtattataataatttctaaaataatttgaaagaattttctcttactggaacatattataaatatggaaattttatctctttcaagactaaaagaatgtcttttataatgtgatgacttaaaaatctagtttcctgcctatggtaatatttatattttctaatgcttcaaatttggggattaatatgttcctatcattttccttaaggtgtgaaatataataattacacattattttaattaactttgaatctgttataacttttttatcatttctaattttctgtttgtaccttttctctttaattaaaattccattgattagactactatatgaatatttataaaaccaactattgatcttttaattctatcatttgtgttacgtgtattctaacttattaacttctgcttgtgtatggctgttactttattacctattatcttttgttttctgtagttattgtttcttacccaaagtcttgggttaaatgttcagttcatttactttcattcttttttatctagtggaaggagataacactatgactttatctttgagcacaactttggctaaataaaatacacactattaagaggcttgtgtctaatctataactatagttactctctagtttttgatcaaaaagtcattgatttttttctttttaaaaatgtcccattggattttatttaatctattattaattgcactttggccattaagtagatatgcataatttctgcctttaaaatttattgagattaatccacaaatatttgaaaggaaggtttattctctatttttgggtacaaaggtcattcttagctattaaaacattgttgctgattattttaaaatactctgtatccctgtttttgtctttactcaatctgttaagaggatttaaatgtgattaataaggttcttttaatacatatacaatggactttgtactctacaaatagtggtatgagtatggcatcttttggtttccaacagtaatgctgattttactttatacatatcacatcggccttttaaattgaagtttgacaggagttcagtttttagatgaattaacttctcatttgtctcctaatattttcatttttcatcttctttcatgatttttcttctgtttgtaaactgacagtaaatgtatataaaagctcagctctagacaatcctgatgtcaagtgtaattatgtgaaaatattttatttgataatttccatgatttatgtcaggtcatagataatatgattcagtataaatggcaccagcccaagatctacatttatctcagaaaaaaaaaacctatttcctctctctgagtctcatctttaaaattctattattctataagctggatttacttacaactagaccttactgaactttataaatatataaccagggagaacctgatacataaatatattattatcatgaaatttattttactgattgcttaaatacaaaaaattgcttcttaaaggtttgagaatgaatgaaataattattctttacttacagcattcccaccaatgacgtcctcaaagccaagtgtggacattccaaatctgccttcctcctcctcttcttccttctctgtctcacctacatactccatgactgtaataatctccatcatgtccagctttgcaatatttgtgcttcttaccataactactctctattgctgccgaagaagaaaacaatggaaaaataagaaaaggtgagattctagtttcagctaaccatgtgtagtaatattttaaagccttgtgttttatggagttggtatgacgtgaggaatatatatgacactgcaactctctaaatatatccgtagccctgctttaaaattaagcacccccatcatgatctttacaaatgtcaatgactttttggcatgggatcaaatcaaatgccctagggttactgtttcacaaaaggtaaaatctaaacaataatttggaggaaaatggctattcctgctccttgtcttctcctcaggcctgttgccattgctggcttggagagctaaacatttctgagaaaatgtgccttttgactctagaccaaacaaaatattttattgctctcaaaacgaaggatctttggctgccttagtataacttgttttcattactcttaaatgccatatttcttagaatctaagtctaagtacaaagatctaacctgcttctgagctcattcctgatcttgcctgtcttgcctgcagagaatcagcagcagtaaccctcaccacactgccttctgagctcttactagatagacttcatcccaaccccatgtaccagaggatgccgctccttctgaaccccaaattgctcagcctggagtatccaaggaataacattgaatatgtgagagacatcggagagggagcgtttggaagggtgtttcaagcaaggtaaagttacctatggaaaaaaaaactccattgaaatatgttatgtctgaaaagctaccaaactattagcttggtatatatataatattagctttatatatatatacacacacatatatatatatatatcaagctaatgatatagtacatatatatgtacactgtgtgtgtatatatatatacacacacacatatacatatatacacacagtgtaatatacagtattatatagtattaatacaatattatatatgtattatatggtaataatatactatataaaatagtttttatcaagttagttaattctggccaggtgcggtggctcgtgcctgtaatcccagcactttgggaggctgaggcgggaggatcaccttagtcaggaattcaagaccagcctggccaacatggcgaaaccccgtctctactaaaaatacaaaattgagccaggcatggtggtgcacaactgtagtcctagctactcgggagtctgaggcagaagaattgcttgaagccggaagacagaggttgcagtgagccaagatcgcgccactgcactccagcctgggtgacagagcaagactctgtctcaaaaaaaaaaaaaaaaagaaaagaaaaactagttaattctttacatcattaaccttatttgtattgcataatacacttcaaatcttaatttcccctctttgctggaaaacagtagcctatatggagataatatattttactgcacttaaaataggtaatttattggagatgtaaatgtgtcttcacttctacgatttttaaattataagaaattagtaatatagttcaataatatttccttttcaggaaagaatttaccatatatttttaatcataatttcttacattgttttaaataactccttacattataatataatgtatagatattaagtagatgttcatgaaatgacaaacagaaaaggaataaaaaggcaaaaatttataaaaaatgagctcaagaaaggagtatgtattagggccaatattagcctatgtatcacctttgtgcgaattggaataaaataccctttctgctgcatggatatggctccacagacacacagctgagccagagaatatgaatttggttttaatctccaactggcacttcggcctggtgctcttgggcaagacacaacttaatctccacccatggtggccctggcgtagaggttacatgaatagtgaaaatctcacacaaacatgtcttggaaaccaaaatttgcaaggcaccactttaggctcaatggagggtacaaagatgagtaagccatagttcctacgtcatggaatttagattctggacaaagattaaaaggttaggatgtggctgggcgcgatggctcacacctgtaatccccgcagtttgggaggccgaggtggtcatatcacgaggtcaggagattgagaccatcctggctaacacagtgaaaccctgtctctactaaaaatacaaaaaattagccaggtgtggtggcgggtgcctgtagacccagctactcaggaggctgaggcaggagaatggtgtgaacccagtatgtggagcttgcagtgagcctagatcatgccactgcactccagcctggatgacagagtgagactctgtctcaaaaaaaaaaaaaaaaaaaaaggttaggatggcaatgataatcctattgggggtgtatacttcagaattcctataatttgtaaataatgcatctttcaaacttcattgtttgaaattgttgaaaataacaccagtgatttttattagttgacatcaaggagttttaagtatgttgtctttctttgattctgtggctctgggaaaggctgcgtgagacttaaccagccttttacacaggggaggtgggaggatatgtataaatgtgggtaggtataaagatatgatgtccatgatctttggtttctttttcaataaatgtatctctcagggcaccaggcttacttccctatgaacctttcactatggtggcagtaaagatgctcaaagaagaagcctcggcagatatgcaagcggactttcagagggaggcagccctcatggcagaatttgacaaccctaacattgtgaagctattaggtatgaaaatacaagtgaggatatgtatttcatcagaaaacagaggctttccaagtttttctccccttgttcgtgctttttccttttctccttgatcagtgagacgtttcagttccttttcaaatttagcttcttcaccttggtctatcccaaccctataggacattcatggcttaatggattatccctctttaaattcatcacttcaatttgtctctgtctttgctgcctcctatttataaaaatgtttaaaatgtccccattgtaaaaaattaatactgcttctccatcacaaaatttatcaatattgaaaagtctatatattttacttattttgtttctcctctttcttccctaactagaatgtcatgagcagcgatttgtatcttttctgttcattgttgagttccagtttattcccagattcataaattcaacacaaattttacaaatatttagtttgtattaattacacagcaattaataaaacttttcaaaaatctgtgctctcggctgggagcagtggctcatgcctataatctcagcactttaggaggccgaggcaggcagatcacttgaggtcaggagtttgacaccagcctggcgaacaaggtgaaatcccatctctactaaaaatagaaaaattagctgggtgtggtggtgtgggcctgtaatcctagctactcgggaggctgaggcatgagaatcgcttacaccgggggggcagaggttgcagtaagccaagattgcaccactgcaccacagcctgggtgacagagtgagattccatctttaaaaaaggaagaaaaaaaaaatctgtgctctcatagagcatacattcactctatatgaggagacagataataaaaaaaaaacaaaaatatgggatgctggatattaagttctacagactttttaaagtgttaaagcagagaagttggaatgtgagctacaaagtttgaagacttcagtgaaaatattacatttatataaagacctggcagaggcaagggaataacagtgtggatatcttgggaaagaacattccaaaaagaatgagaagcatttgcaaaggtactgtggcaagagcagatgtggcatgcttgaggaatagcaaggagatgaatgtggctggagcagagtgaaagatggggagagttatcaaagatgagatcagagaggtaatgggggaggtaggcaggtcctgtcaggccttattaaaaacattggcttttaatctaagttgggaaacaaatggagagtttcagccaagacatgacatgacacaactcacattttttcagatcttctctggctgctttcttgagcattgcatgaagggaagcaatgaaatcaggaagacagtaaacaggtattgcaatgatgcagcaagagaagatgatggcatgggccaggtggtggtagtgaagatcgtgagaagtgattctcttccatgtgtaatgtgaaagtagagccaaataatttgctgacagaccaaatatgagatgtgcaaaaaagggaaaagtcaaagatagtatcgaagtatttggctgtgcagatgagtgaatggaggtgccattggctgagttgaggaatactcagaaggaacaggttcctttagtggagagagtgggaattcatttaaagatgtggtttttgtccaggcactgtggctcacgcctgtaatttcaacactttgtgaggccgaggcgagcagatcacctgaggtcaggaattcgagactagcctggccaacatggtgaaaccccatctctactaaaaatacaaaaattagccgggtgtggtggcacacgcttgtaatcccagctgcttgagaggctgaagcaggagaattgcttgaacctgggaggcggaggttgcagtgagccgagattgtgccattgcactccagcctgtgtgacagagtgagactccatctgggaaaaaaaaaagacgtgttttttggcgatgcttattcaacatccacatgatccacatgaagttaaggatgcatgtggatatggaggcctagagttctggtaaggatgatctggttagacatgaatccaaggctattgcagtacacagagtatttaaagccatgaggttgagtaagacacctaagtatggagaaagcaagccagaacagagaagaggtccaaggaccaaggcctggagcattccagtatttagtgtgagaaagaggagatgaacaagaaaaacaaactaaaaacgagcaaccaatgaaatagaagtaaatcaagagagtgtggtgtcctggatgtcaaatgaagtattttaaataggtgaaagtgagcatgtcatatgcattaagtcaagtgagaggaggactataaagtgaccttgaatttgtaaacatggatgttcactggtaaccccgagaagagaggtttcttaggaatgttgggggcagaggaaatgtaagtgagctcaaaagaagaggaagagaaaatctggagaaaaagtataaacaacttgttttgccataaaggtgaaccaaggaacatggatagagctgaagggggcagaaagaagcatgcttcctttcatgtggaagtaatagcacatttgtaaattaatgagaatgatcccgtaaagagaaaaattgatgacagggttggcaaatagtggaagtaacatctttgaacagtgagagggaatggaatcttggcactgttggatggattggcctttgtaaagagaatgctcagatcaaccatagtaataagagagaattggctggagattgtagccagtctcttctgattgatttagttttctctgtgaggtaggaatcaagatctcatctgagggtgaggaatgggagaagagttgaagatttgaggaaagagaagaaataaattgtcatctaagaaaatccatttttacataaaatataaaatggactagagaaacataatatgattggcaagaacattaaaagcttacttgaaattagagattacacatttaacatgagactggtcagcatggttgtgtatttatccaaatgctgccagctgggcatagactcgttaagaggagttaaattttaccagaattagcattttgccacacaagtaagttgaagtcaaattgaggcaaataagagaggtgtatgcaaaggagtgattattatgattgatcaaggaacttaagctgtttaaggaaggaagacaaaacgtgaagaaagtagggatcattaaaagggggtaggatcaatagattaaaagtttcagggggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttctgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagaccaaactgcaaggcggcaacggggctgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcatgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacaagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccactcaactacatggaaactgaacaacctgctcctgaatgactactgggtatagaacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaattggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaacttccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaagagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcaggggaggggggagggatagcattgggagatatacctaatgctagatgacacgttagtgggtgcagcgcaccagcatggcacatgtatacatatgtaactaacctgcacaatgtgcacatgtaccctaaaacttagagtataacaaaaaaataaaaaaataaaaaataaaaaataaatgcatgaatacccaaaaaaaaaaaaaaaaaaaaaaaaaagaaggcatttcagcatgcaaacaagtaatacttttaggaattacactgacttcattgtaatgcataggaaaaataaataattcacaaataaaaaacaaacaaacaaaaaaaaagtttcagtggggtcaaaggatttttagagttagggcagtcgaggcagtgaactagggtgaaaaagggaggaagtgatgaacaacaggtagagtaactgaaaatgagattatgggaggtatacaaatgtatggaatgacaaagtcaggggtatgacaatgtgagtgattagctgaagttgggcagaggtctaaggaaaggaagtaaagtaatttagtggtcaggatattggaaggaatctagataaatattaaaagcaagaatttctatagtagtatctcgaatagtttctggcacattgtaggcactctataaatatttgttcaataaatgaataaacgatattaagtacataacaattcatcttgaaaacacttcttccatttcctcaactcctaaacattcatttattcattcttcatcacacaaaaatctgaatctggcttctgccccctaccctccttatttactttctcaaatagtatacatttagtcattaaacaaacatacatacatgcatattttcaagattatcaagcaattcctgtttcaacttttcttaaaatgttgactctgtattcgtatacagtttataacatcctgaattcctgaaattgattcaaacagaaactatgtacagttttccaatttaaccacagtagcatgcttatacatcactacttggagttttctctcatttttattgtccaacaagaactgaaacttatgttgccgtttgttaaatgctatatctaaattccatttggatatccaatgaacacaggttctattttttatcaagtatacataagcagtaatcattcatgcaagtgattccactactctcatagtttcttgtaagttaatcccagtgaaataagatgacaatagtggaagaaaggggaattgggaaaatccataaaattcacttctatcaataaaagaaatctactttgttttatatatttgatacatcagccacttattgaacatgttcgtatcttaaaaattgtttcccttttattgaaatcctagtggataatggttttgtagtcataaattgggaaaaatggtataactaaagaaatatgcagaattttagaatgggagtaggcattgaatattatagactcttacggaatattctggcagtggagcaaacagtagaacaatcaggtgagattattcattgaagatgtcatgctaaagtttaaagacatggcttgggctaggcatgaggttttcttatgcccatccatctatgcatccatccttaaatctatccatgcatccacctatgcattaattcatccatccacccatcaacatatattgaaaacccatagtgagccatgtgtagtattagacctgaggttacaaggatgaataaaatacagtcttcctctcaataattattatattttgaagtcccacctaagagttgggttggagtaattacaatatagaaaacattttgaggtcttaaataaatgtatatacatatataattgtaaattatatctatacacatgtatatataattgttcataataatcacaaagtagaaatcttttgtatagtattttctttatcagagtggaaaatttcattaaatcaatttagttcaaaactttatttctcagagaaatattttgtcatttttttccagtataagaaattatttttaaatcaactcaaccagcataacaatggtaaagccagttgatgagataggtaagtccctgttaactaaagattatccaaaaaggatcccacagaagaaacttctaagtattatccagttggtatttctttattttttccctttagtttacagaaatgtgctaattgaggtccttggaattaaaaattaatgccaaaataaataagccaagatagcagtattcctcatttctcctctttttcaaacagatacttttaacttttgcctgaaaaaacccaatagatctaataatctatttttaagatgatgtgaaattatgcccatcttatctaatattccaagttctccagtttccctctcaaatatatcaagactttaagatttgaaaatgatcttctggctttaaatctaagactttatttatattaacttttttggtagcatgaacattgtaaaacctaaatttcaaaatgttttactgcagcaacttaaatacttcatctaagacacttgaattgtatttgttattgtttccaaacttgatacatctttcttattaacatccttcatagaagtaaacagaaacagacagcaattacattacatactcagagcaagcatccattcataaattaactcaccaaacattatgaggcatctgctctgccagacacgtggtaggtgtggggaatttttaaagaagaataaggttcaatctctcctttcaaagtgctaaaacgttggggagaaacctcaaatagtcaaatgattataaaataggatggtaggttctctgtgaaaggatgacagtaggaaaatctaacagttactggaaggatcaggagctgaggcaccctagggagagtgataaactgaatcttaaaggcaaagaggagatgtttaggcagagaaatagggtcagggttcaaccatggtgttgtcaacaaaaaaccagggcctccagatttcagagagaagagccactccagagaactgatacaccatgtacttatatgcaccatgaacttgatgcaccatgtacgatgtacttatgacaagtgcccaggacaacagcgctctgctggaagtcctcaaaaactttagccaagggacagaaaccccactacccagagtgcatttcctagctgagactccttttgtgttgtgattaaaaggatacaaatattaaaaaacaaacatacgacaacaacaacaaaaaacagggcttcatatgttctgacatggtcgtttgcttttggagtgctctttccattgtttcattgtagaaactgagactaacagggatggtcttttggttccaggagtgtgtgctgtcgggaagccaatgtgcctgctctttgaatacatggcctatggtgacctcaatgagttcctccgcagcatgtcccctcacaccgtgtgcagcctcagtcacagtgacttgtctatgagggctcaggtctccagccctgggcccccacccctctcctgtgctgagcagctttgcattgccaggcaggtggcagctggcatggcttacctctcagaacgtaagtttgttcaccgagatttagccaccaggaactgcctggtgggcgagaacatggtggtgaaaattgccgactttggcctctccaggaacatctactcagcagactactacaaagctaatgaaaacgacgctatccctatccgttggatgccaccagagtccattttttataaccgctacactacagagtctgatgtgtgggcctatggcgtggtcctctgggagatcttctcctatggcctgcagccctactatgggatggcccatgaggaggtcatttactacgtgcgagatggcaacatcctctcctgccctgagaactgccccgtggagctgtacaatctcatgcgtctatgttggagcaagctgcctgcagacagacccagtttcaccagtattcaccgaattctggaacgcatgtgtgagagggcagagggaactgtgagtgtctaaggttgaagacgttcaaataaaatgctgcagtttcctctcagactctgtgagccaggggaatcctacaccagaggcccaacaagacccacataggaaagagtaagagtaaacatgagtagtgtgttgtttgcttcccagggagagcaaagacagtgcaaaacccatgtggtagacggacccattgaaagccagtgattggaaacacaggctaggaaatgtgtcagataatggagacaactattcttcttcatgaaggtttgtaatacacactgcacagggaagaatgtcatcctgttcagtttccaaagtagctggtcacagagtaaagctctgctgtattaaattttaatatgaaatgggattcagagcttcattttttaattgagttaattcctgtccattgtgaaagtagcttaatcgtcatgtaagacacttaggtgaagtacagaaaactaaaaagaaggaaaagccactcattctgtctccccccaaagacgagtcttagtgttttattaaatctttcttgcatttaatgcataattttatatttgtttgtattctgcagagttgtggttacattttattgatagagggtttctaaggaatgaaacagcaaatcagcaagcctgtaactctgagttcccttttctgtcctgtgcccctccttttttcctttctgtgcatttgtcatgaattaagtctgcttattttattcctccagttttcttgaaacaagtttttgtatcttactgatttaccttttcctttaaaaattgtattggtatcttttccattgctttaatctttatttcttcttctttccaggacttctgtccttttttagttattaagctatttttttcttttatttcattcatgtaataaacactctggcagaaataataacattttaaataccattgtagattgatatgtatatgccttttgcaaagtattactatttttcctgcatttgcctttgaagccacacatttcaacattctcacctattaatattattactagagtctatttaaatctcttaaaccataatttataatatgagatttcacaagatacacttgtggctctgagttatttcaaaactgatatttctgtgcattctgacattttattccttttagaaacaaattcagttggctgtagaattaatatcgttctgcttaacaactttgtgcatgacatattaactgattttgttgtatttcatgatttaaaaaaaaaagcagcagctctggaactcagattcctgggggttcagattttttctcagtggatcctcacacaatacatctttatctaagtccatacatgatctgagtttatttctgatatagcaggaacccaaattctcctgaaaacgaacagggaagagaaaataacagtctactctataccagcttatcttaattcagactaattggtagttagggcattggaggaatggtgtgaattcttgaaagtagattttcgctgtctgctggaaaactctgcctgaaatccccaaatctgcctcatgtaacagcttgacatctttggtgggaaacctgccatttcttattcatagtgtctccaggcaaccaagacaaaaatgtagaaattttcctagactttgccctctctttcatcatcagttttctattagttttacttcctaaaatcctcctgctgacatcctcttcccttcaacccaagagccaatgactcaacctctaccgttgcccaccctgtctattagctggccttcctctcatttcagacctgaacagattctgtaggatacaacgacagtaaggcggtccttagtcacagttctggttcataaatagcgaggtcagcatttaggactgagacctaaagaagtgcttcagataaaaatcatgagtctaagtccaaaattgatactgtaatccaaatgactgaataaagaataaagttgcagcgtgtgtctaaagcagaaagtcaagatgccaacaaagcagaaaagttggagagggccaccagcaagtctagaacttgagcatagatatccatggcttattttagatggttcatgtatgctctgcaaaattcaaagacagcttcgggctttctccgctgataaagttttgttgtaaaagacagacatagaagtcaggctgacagaaaatagagtaacagtaatcataaaaattataatatcagctagcatttattgaaatcttaccatgtgtattctgaggcctttaaatatatgaacttaaacctcacaacatccctgtaatgttggtactatcattatatacattttagttttgctttgttttgttttgtttttgagacggagtctcgctctgtcgcccaggctggagtgcagtggcacgatcttggctcactgcaagctcagcctccaacagtcacagagagattgtgcaactggcccgagtgcacacagcaacagagcctactttttgaccaaaagaggccgaattctcaaccactatactgtagagcctctgtacatgatagaagcaataactgaacctcagtaactctgtggaagtgatttgtaatttgcatgtcgtttcaagcacactctatatctatattttattctattaacttcctaagtctttttaatgaatagcaaaaaaagtatatttcagcattatcaatttaagttaatcataacatctaataggtgacatgtttattttttcatgagttctaattacattttcaagttaagatcactgacttattccctaagtgctcgatctaatgttctgaatcacaggagtatagatgcattattcaccaatattgtttacttttttaaataagattttttttcatggtagaatcatcatatacattcaaaaaggtagacaaaagagagacactcacagtgtcactgttaccaagtgccaggacagatatcagtaaggcaccagcagtcatttttagtgatcaaataccaaacatggtaagataccagagtatttttcacatgacacccaaaaacatattctctgctatcgtggtagagcagaaaaagaacactttcttttcattttacagtatattacgaacctgttccacgtcattaaatattcttctaaaaacccaattttggaataatattctattttattcatatactgtaatttagctaatcaatcttgtatttttgaacatttaggttttttccaatttttatcattataaaaaatgctgtaattaacatccttatttgttcatgtccacatttctttttatgaaaattcagagaaaggaaatgtctggaccaaatggcatgtacaatattaacacttctgttatgtggtttcatattctgcagaaatattactgccacttctacattgtacaagagatctcatagccctaaacatttgctttcatagataattttctgttttttagaaatcttttgtctctttggttatagaaaaagagaacctctttttaattttattttttaaattactagtcaggttgaatgtttcttgttcctaggtcattaacagtttttattttggcaattgtctacagcccatttttctgctgtgttcattttctaatcgaattatgggatttatcttgtaaaaagcctattaagcctttttcatactttacacaagagatcacatctacttactttaccttaaaataacatttacttattttcttataaaagtaatatattatgtttgaaaagaaaaataatatgcaataatatacaataatatgtataatcataatagacaataataaaaatgaaaaaacaccaaccagaggtaattaacattaacatcataatattcttccaggctttttcagatagacaggtaggtaagtaggttggtaggtaaatagatagatagatgatacatagagagagatagatagataatttaaacaaaaataagatcatactgctacattacttcaagccttgcttttatcacttaatatatcttaaacatcttctacatgaacaagtattcatgtgcaacattaattttgatggttgaatagtattatacagatttatcgtaattgacataactattctactgttagacatttggtttatttctatttttccattataaaatgtaatgtttggatcatcctgttgctaaattttgtaagcatttatcttaagtgatttctttagctataactcctagaagtgaaatttctagattaaaggataaatgcacttttaatactttttaaatatattaaaaaattaccttcctgaattattttattaacatgtacctctcctagtcagataagacagcccatttatttcagtctcaccaatactgagtatagcattttaatcattgccaatataatagctaatagcttaaagttatttcatagcttatatttacacttctttaaatactaataaaattgaacattgtttaatgttttgaggatacttgattggtgatttgcctcctactattatttttctactgggtatatctttttcttgttgctttgtaagagcactttatatattaaggagttaaattttgtgatatatgtttcaactacttttatcatgttaaaaatatagacttctatttgtcttttattgtaggttttatcaatcagaaaagaatgttgacttttccgtccattcagatgattgtggcttttttccctaatggatttgttaatatgttcaattgtatgaatttatttcctaatgtagcgatatccttgtcttctaggaataaactttttgggcgaatcatatcaatcttctacttaactaccaaattaatttacatatatttgcatcaatattaagttcataaaattaaaagtttatcattttcatctctgttagagttttgtattggcattagcatttgtattagcattgtattaggaaaaactcaggagtttttctctataatcttggttagtttatttttaaataattgttatttatgaaagtaatacataaaaatgttgtttaaaaaaactcacaagagggtaaaaattaaaaaaataataaaagttcccttcttccttttcatctctagtcccagcctaagtgctaaccacttcacccatttatagtgttagttcttctggtgattaccagtgcaattctaacaaataggtttgcatttctctttctgaattgatcaattttttaaaaatatgcagcactctgactcaaactccctttctttttcctgagatatgttaacttctaatgttatattgtttatcacaactttcacaaatatttctaaataaaggttacctactgattctggattgtgctacataaaattagagcttccaaatttccctccatcacttctccctgctctctactctcacaatcagtcaactatacacctatttctacgctgtcaactatatgttcatttctatgaatctgtaatatttgcattttgttctggaacaaattaagatttaggtgctttgactagattgattctaaacatcaaaaaacaaaaataaaatatctgcaattatgtgatcatgtatttatgcattgccaaataatggtattccattattttaatttgataagataaatttaatatacattaattcttatttcctctattttatggaagaaatatttttaaaaatcacaaaacttttacattcgcttctcttcctgatatttatttttcctttttcttctgcctctcttctttcgtgcccttttttccgaaaattattttgatgattttttttattcaccatacataattacaaatgaagagttgctctggttcgtattggtagtagaagtggggtccctttgctgttttgttggtatattcacccagtgtgacctcttttccgtgggatggctacctctgggctctgattatgtggctcatagggaagtataggcagcctgagtcagaatccccacagttccaaagtgatggaagactgtactctgagatacaatattttgacgtatttcactcccagggagagctacttgctattctttcactgcttccattacccaaaagagtatgatattctccccattttctgtattgcctcacacctaggacccttcaaacccacaccaacgacctctcaggcaaattgatctattcagatagcagtttacagggatagacatgaggcctcttggcccacctgctctatacacaatcttctagtcgaccatcctgattgacaacccacagcccacccctgtctctgtatttgctgactcagagcatggagactttatacatgtgaaatcacatctcccctcccctcacgcttggcttgtgtgtattgcaaaagctgcaatttagtttttcctgtgccttgtcttacccatggataagaacactaagatactttccgctttttgaatatttgtcaaagtgatggcacttggattggtttcagcatgtacatagattgattcttattcatatacatttactgtcatattggggaaatcttgaggggaaaagaaaagcctcttactaccatgttcatcaagagtcctctctggaatagttgaaatagtttaggagttatcggttcactccttcgtcttgtttgcctccagatttcttttttccttcttttcctgtttcttaatgttggaacagcccacacctcaatccttggatgacatctcccttttatctgtattcatccctagtgatctcttctggttgcaaggctataaatgccatctgtatgctgagatttttttatttttagttcaaacctctctccccaactttacactcacatttctaactgtgtgttatagatgatagctttagattctcctcctcaggactaggctttctgcttgatctaggagcaaagctgaaaactgctatggagcttggtgttgccttgataccgaggaggagtctcagagcctctccagtgcaaatacacacttgcagtgtcctagtgctgctgacttacgtactcattctaaagagggtagattgtatccattttaatagctctcaatacccttgcccattcccattacagctggcagaaattccccagctgcaaatgggttgcatttatctgttacccattcctgatttgcagcacgattgactgtttccttttctgcgtggtctatgtgtcactccatgagaatctgggagaggagaactcgatatggtgctcattccatcattttaaccatagtgttctttattgtgaagaggtatcccggttagagtggagtcaaagctttatagcaagtgtatttcaggtaactattcttttacttgtttcagatctatttcagtagcacagccaccaagatagaacacttataagcccttattttggtatagatcaccagagaaaccactcaccactcgcacttggccttcagtactgagtcattacatattggaaggtcagaaactacatcaacaggaaagacccataggtgtgggggtctgatatatttgccagtacatttcttatcattacaaacaaagatttatgtgtgtctagatgtttaccttgccttctaagaggtcatgtcctctgaatgaagcaaaatcaaggtaagcctttacctgtaagccgttacatgtcttctttacagaatccctcttaattaaaaacttctaagagattcaacagggttagtttttcttacaaccttcatcgtcagacctgtaattatgcaactggccagcattgctctttcaaaccacagtctctggaaagtacacaccgtatatagcattttgcccataagaagagaaaccacctgtagtatctaaggttacgtcagagagatgttaaccacaaaaaaacccagacttagatacacactatcattttctgggtgtgttcttgaccatttagagctgtgattaaaattagaagtgttggcatgacactgctttctgactttcttttttagccatgttgacaccgtggtggttagtgtgatgctccttcttatttcaattgatgctttactcaagtatggatgaaacataatttaaagtcacctcttcttctgctatcttgatttttaaaattatttggatgcattatatttaagaatcttaagacagtccattagtattatgtatttatcttctcttcactcgtttaagtcactttctgactcagatcaccttctcaggagactctcagcatcattctgcctgacatcactcagttgctttgtttatggcaacctaaaaaagcagctgccctaattttagcccattcccagagtaccctcagaagtgacaggtaagaaaaaataaactgatcaaagatgagagaaagacttacagaggagtgacactgagagagcaaaaaaccacaaataaatttcatttctaagaacaaagcaaagatgaccaggaaatgcctgaggaaacacattttttttttttttttggaggcagagggtattatattccttttttttcttcaactttcattctagattcagggagtacatgggcgagtgtgttatgtggacatgttgtgtagtgctgatgttttcagtacaactaaacctgtcacccgggttgtaagcatagtacccaatagatagtttttcaacccttgcctcccttcttcagagacctcccccttcttgtattccccagtgtcttttgttcccatctttatgtccatgtgtactcaatgtttaactcccacttatacttgaggacatttagtatttacttttctgtttctgtgtccattttgctgcaaaggacatgattttgttctttttggctgcatagtattccatggtgtatatgtatcacatttactttatccaatcaaccattgataggcaactatgttgattccacatcattgctattgtggatagtgctgcaatgaacgtatgggtacaatgtgccttttggcagaatgattgattttcctttaagtgtataccaaaggaaatgggattgctgtatcaaatggtagatcaactcttatttatttctcattcatttctcaaataatttctcaattatttgagaaatcaaggagacactttttttttttttttttttttttgagacagagtcttgctctgttgcctgggctggagcgcagtggcgtgatcttggctcaccagaactctgcctcccaggttcaagcaatttggagacataatttttaagacatttttaaataataaacctcaaatattttagggaaaacatctttatctctgtttctataactgtcaacctctttctaataagctttgcaaagctatatgaaactagtttttaatttttgtatacttgagacaattttggaagaaagtaggtatctactcatccaatttcagagaactctgagaaaatttagttattcttatgaaagatctattttcttattgcaataactgtgaatttatctggcacttggccaaacttagcattaacaggtaatacattatattcacaacagaaactagaagatgattccagaacaacacagccctaaaggaaaaatcattaattgtttgacataaatattctacacttcaaaaatctacacttagattttttttctaagattgttttgtattatttactaacctaacagctttccattaacaataaatttagaacttttttatattttaaatatcaatgtgtgcattattttggtgatgacataataaatcattagatgttgcatacatgttatcaaatgtatatggaggttgcgtaagtgttatcaagacaggcagcagatggagtgttgaaatatatggactcagggctgagtctgctgcctgtcaaatcctagcaatttacttaacccctttgtgttcaattttcctcatttatgaaaagagaataagaatagcaccaagctcataggttattggaaagattaaatgatttaataagtagaaaaggcttagaaaggtacctaatacacagtaaatactt

SEQ ID NO: 325 - DNA, 42902 bp, Homo sapiens
gacacctctccctgagacacgaaggcgtagtcgtagggattgttggtgaccagcagcatgtctgcaccaggcaaggggtgaggcaggggcaagggggcaggcggagggcagggaaggggcaggtagagttgggaaagggagggaggggcagggaggggtaagggacggggtgaatggaggaagggaggacagggagcagggagagaagagaagtcagcaaggaccaaggagtgaacccagaggaagtgaaagggtagaagaggggccctggcaggggctccagtaacaaggaggagggagggtggcaggggagtgacacatgggagatggggaggcaaataaagaggagaaggcaaagacaagccgagggaggagtggagagaagggtggagaaggagtgaggtgtgtgactgcacagggaggcgagaggagacgcaggtggtcttgggagggaagcgagagggagctggcggagtgagtggagggagaagggaagtgagcagcaaggtggggcacagtggggagcaggagggccctgccctgcatgcaggagtcgttggggtgtgcagcagggacagcagtgggtggggggtggcaggcaggttcacccagcaactccggcttcttgttggacagaatctggtagaagatgtggtagtttctctcagctttcagctggaagatcacccgggacttctccagcaggtctgaggtgggtggaggggaggaaggcaggtgaggaaggaaagagagtagagccagaaaaaggtggccatgggggcagagggcagggggcacccacagcttgatgaagagggccaggcgagaagatgtggcttaaataaaaaggatcctaaagcccagaggcaaatgcagacaaaacaggagatggcaggaatgatgagactggccgccaggcagggagagaaggcagagggggacctagagggtggcagcctccctgctggtactcacaggtctctatgtctgcagaagccagctttccagtggccccaaagtggatcctaatgaatttcccctggggacgaatgggacagagtgagggaactggcgggaaggacagagtgaaatcctggccctctgttcagcccagaagccctggatggttctggaaatgtaaacgacctctttggtgtctcagttgagtataagtgaagccgggcagaggatgccaccctcacacactgtgcagggacctcctagtggaacctcggcccagaggggaacacatacagaatgcctcctgctcatacctctcatatgatctcacctaatcctcccagtaatctgcagggtggatattagtccccctgtttcacaggtgaaggaactagggctcagagaggtgtaaggacttgctgagcaagtggaaagtcagacctttggctccaaagcctatgctctcttcccaccaacgtgtgcatgttgatatcccaaagccagatacagtacaatcaactgggtgtggcaaaacagcaccccctttttcttgtcaaggctggatgaggccactgggagtggtcaaaggcactcacaaagcgggaggagttgtcgttccggacagtcttggcattgccgaaggcctccagagcggggttggcctggatgatctggtcctccagggtgccctatgaaaggagcagaactgcatgggttcatcctccatccacctccaggcagtggtgagagggcagggaggctgccctggccctgaggaatgggggtgcggggctgggtgaaccgctagtgggtctgcgactccacaggatcctacccagacctcagggtgagtgtctcctgtcaggaaggtcttccatactgggctgaccatcgggagcccagctcagtgtggctgtccccaccacgtcacagggaggggagggttaggggtaactcgggtcagcctgccccccaacccctgttctgccgagcctgtgtcccccatggcaccttgttcgcattggcattgtccttcttgccacggtcacctatggctgcaatgctggcaaagtactggatgacacgcttggtgttcacagtcttccccgccccggattctcccctgggggccacagagaccaatcaaaactcaggattcctactgttctccatacagggctcagcatcacatgctccccttcccagcctggccatcagagcccagcacccagcaggatttgcctgacatggttcattgctctggcacccctctaatgagagctcagtgccccatgctccctgcaatcccagccttaaacctctcctcccaactacaccctaggcatcagcgtgtatgcccccagcccagtcccttctgtgggaggatggcactcgctcacgtgatgaggatggactggttctcccgatctggaagaaaaaagaggagaagcaatggggtcagggctgaggatctgggtgggtgtctgggaggaggagcagagaccaggggccaccaggctcacctgtcagcatgtactgataggcgttgtcggagatggagaagatgtggggcggggcctcactcctcttcttgccccggtaggcggccaccacctcggcattgtacaccggcagccacttgtaggggttgacagtgacacagaagaggcccgagtaggtctggagcaggagacaaggctgggcatgaggttggtggggagagcctgggacaggcagtggtggcagccaggcatgtccctgttcactccagctggctctactcctcctgcagctgactaggggtggaggggggaaggggacttgggtcccttgggagtctctccccctcttcttgggagagcccccctggcttatttaggcctccacgcagcacaggaagcctctgcagtgtgcaggagccactcacatatatcatccaggccgcgtagcgctccttgaggttgaaaagcaccgcgggctcgtgcaggaaggtcagcatggccatgtcctcaatcttgtcgaacttgggtgggttctgctgcaacacctggtcctccttcacagtcaccgtctggagggggcgcataagcaggaggatgagtgaccacaatccctccgggacccttgccagcactgcccactgacctcctcccaggacacagggacttggccttgctccccttgctctgaccagtgccccggcccctaccccgatgtcccctgggacactttccccaggtaatttcccttcccattgtatctcccatcctagagactgtcctagggtacctttctcttgccagatccccagaccatcctggggacaccctgtgcccatgaccatcactcttcagtccctatgttccaagggtcttggggcagacctggagattggcagctctcagatctgtgcacaccttatgctgaccccgaggctgtctcccgcgggcagcgctttagggtatctgttgctcagggcaaaccttcacccctgctggaaaagtagttcacccatctactccacactccccatccatcactgttggtgtggtttgattggcagcagtcagtttgccatgccctgatgtcattagatcctgccagtaggtattccagtgttttttatagtggagaaatccgtggctctaaatgactaaatgatttgcctgcacagtgactagcgggtggcagagctgggatcagagtcaaaagccccaggggattgtggcctgttattctacacttcaatgggttgtaacattcagtcaacgagttcatgaggcacacagccctgagccgcagctggtaaccaggggtgattctcttggctggtgtgagcaaaccagggaccagagcttctgagtgccagtcaaggagagtgctcagctcaaaagtttctgatctttgtgttcatctgggtctaagaattactcttgatttgggtgaacggaatttgagaaagtggactcatggaggaaactgaggcacagggaagagggatacaagtgcaagaagggggcatcatttaatgctgtgtctgtgccctctttatctacaagacccctcttaggcgaacactgaggttcttcttcctcagcatcctctctggcagggggaacatggccctgggtggcacctgttgcaccagctcaggtcaatttgagagggatcagattctgggctcctcaaaggagcatgtcctggcatccccactggccttggcttttctccagccctctcagctccccctgcaagtggctccacctctgcatcttctttcccagacctccttcccttctgccccggcgccatgccctactcaccttcccattctcggtttcagcaatgaccttgcctccctcccgggacaaaatcttggctttgacaaactcttccttgtcatcgggcacgaagcactcagtgcgaatgtcaaagggccgggtctgggcctctagacgctccttctctgacttgcggaggtactgggccgctgccccaaagtcagccatctgggcatcggtcatcttggtgcttcccctgggtcagagacaggagggctatgttactcctgagggagcccaggctccagcgagtggctttgtcctctgcagcccccctccctacccccgctcctctcctccaccctgggagaggcacctgctgttgcaccctcccctactcagggctctgcttctcctgccctctgaggtgatgctgaaggacaatctctgtaaggggtttccctggggtggcattggctggagtatgctaagggttggcgctgagtgcttgggacagcagacccctggtccagcaatccggctcccaggagaagcatgccccagtctctgcagagaaaatgggggcagttctcacctggttatcccttcacggagaatcctgaagaatctggaccgtgggtggagcaaggaacaacagaggtagagccgggcagagagaagaacagatgaggagagtgaagaacaacagaggcaggccacccggggatggaggcagccccagagcgcagacaggcaggacagaccagggagtcagaaagggaaagacgcagaggcagaaaagaaagggcaccgagtcaatatgagtgcgagggacggggtgtggaaacagggttagaagcagagaggcagggaggtgagaacacgtgccaagaaggaaggacaagggagagagacaaagaagcatgattgtgacaagtgtcgatgaagaccaagaggcaagataaaaccaggatcaagggaaggaagccatccaaaggaggaaggaagatggaaagatggagacaacatgtaggagactcagaatgatgcagagaaagaaatggagagtcagagaaggagaaaagaggtttctgggtttcctgtggaacctccttgtgtcagggggaacttccctgggcctggagataggcagttttaatagagcccttaggcctccaactgacctgcaccccactcctggtgaaggaggtccctcacggtgggggctctgtggacgggctgcagggcatcccaccccaaacctcctcttacctgggccgcaggagtctctctatctgtcctcaaagctccagttcctttatatcccgtttcccccaccctctgtctaaatttggagtccttccggagggaccctccctcccacctctctcccctcctggctcctcctcctttgatcctttggctctggaggtgacaggaggacagcagggccccctgatttgcccaagaaaggtctgctgccccagcctctctggctccacggcctttttttagtccttgggcacattcctccccttcaaagggctgatgagcagatagtgggaagacaggaccttctcacaccgcctctcccaccctgccatggcccttacctcagttatttttaacccgaagggtgaactgaaaacatgggtgagggtcaccttctcctgcaggccaaatgcctgtcctccgcctcccaaccatgggctttcctcccctgttccccagcctctccttcccattctgacctccctcacacagtcccaggctgggagcatcttcctgctgttagtactggagcccccagtgctagggactaaaagctgcagtatggtgcccagggaagggatctgttgtccatctccatggctcagttttcttttgtcaggaaattctgtcctggcctcagtctgcataagtgccatgcctggtctccttctgttccccaagtcttcagacaagtgttctcccaaggtcttgaggccaccctggtttggggacacgtctggagtccccaccccttccctaatgctcctgatagagtggccaacatccaacctgctcacgcaatggcagtgattctccctgccgcctcaggcagattttcacacagaaccccagttcagcactctcacatacagacttgaccgtgtctgtgcccatcttcagccacacatgcagatttttcacacttacccactcaagcttgcagatttcttttctactttcttttgtgtacatggatgcacacatttgcacatccgcatttgcacacataggcttttgccctcccctgctaccctctgctcctggggtggggtgggcagaagaagatggtgctaatcctagggcctgagagaggaggggggtgggtgaggggctgtccccttctgcctcaccgggctgccagagggtgcaggtgcctggcaggcctggggatttacaccatctggtccccaggcactgcattccatcggggtggggctctgccacctgccccctccccaggcagaattttgttgcccctttccaagccctccagggcttatactcacattcccttctttgtgggtgtcctcaagcaccctaggccctcaaggccccgctccccatcctccaatgctgccatctctcagaggctgtaggtgtcaggtcttcagcaggctgttcctgttatgactaagtggacattgtgttcaggaaacaaagccagactcccctgctctggccttccccccaccctcacacccaggaacaccctcccagcccccctcccaccagtttactgtcacctctcaatatagctccagggtgtggaggtgggtaggacgacaggggtcagcttctctgggtaggagcactttccattaagatgtggcctctcccctagctccctaggacgctgccaccccattcctgggctcaggaacacacctctctttccagagcatttggaccttttctcaatgtccttggagggaccttagttgaccccacatccccatcttctgcaggtgcttatgccaaatcattacccccaggggatgcaggccacctgtccccagctctaggttactcgaggccccagaattcgagccggggggttagcccatggccagtgcgtcactgcttggttcccatagctctggggacatgataaggagctgagaacgccaggtcagtctgggtcggggtcaggtgacaaagaccaggctttgtcctcagggaaccctgtgctctgagcaggcctcacttggtataggtggtggtggcagggcagcggggagtggaggtggtggggggtagtcccccgctcctgtggaaggaggaggaaggaaggtgttcactcagccccaggccctgcccgtctgctccgctgtaccgtcctctcccttccccaggctccttctctccctgctctcacatattgctctccgtcctccctaagctgccttgcacacagctcctcattctgctgggagtcctggaatataaggacagggatggaggcttcggccacaggtgagggtgccaaggaggcaaggctggcctccctggcacaggttgcctgtcttctgcctggctccccgttgcatctgtctctgtctcaccttcattccctctgcctgcttctccatctcagagtggggcctgcctccgattctccctggcccgtgtctccacccggctcagggtctaacatgaggctctgccctctccgagctggcctcttctctcgccctgggcctccacatcttgctccaggctcttcctcctctccaatctccttgcgccttcctgactctccttgcatttgcaagtgacccaggattctttccttcactcgggatcaccacccgcagctcttcaagcttctccctccaaggctccctctcttttcctctctccccatccccctcagcacccctccttctccctggcttggctctcagacctctctcaaccctgctgtctgcatccagcccccgaccattctcataggatctgtatctcttgcggtctctcttgctctggttgcttaggtgccctgggtctctctgcatagctcccttttcaagggttctctcctttgtttctagttatctcttcattgctgtccaagtctgttcctagccagaggaatggccctagggatctcggcccaagccgaggttgtgccactgcactccagcctgggcagcagagtgagactccgtcacaaaaacaaaaacaaaaacaaaaaggctgaaagaatcctagaaatcacagagaactgaattaccttggcctctggggctgtgtggttcaattgagctggataaatgaaaaggaagcatccctggtttgagggagctctgtctgggttggcctagggaaggagaatggaggtggctatgaggagaaaggtggcggcgcctgcggatctttctggggcctcctcatttcctgcatcttttttccttgtctctgtttcctctggttaccttgtcctgtggttgctcaatctctttgtccactgccaccccctcaggtctttccttgtcccctccctaccccctttttctcctctgctgtcacctgctattgtccagtactggtttctccttctccggcttagggcccttggctctggctgccgcagtcctcagagctccgagctcagagctgggtacagagcaggagtgggctccgagtgggtatgttggtgggttgggggagatccagtccagggctgaaccactgcttcccaggttcccagtggggccgacagccccagtgcctttcaagcccctgacctctgtggcccacagtcccaggcctgcctaagcaacccagctgtggcaggaactccaaaggggctgaacttgtttagttggaggagacttactctttcctccacctcctggccctctcgggagccatcccttccctccctctccccagagtcctgttcacacataaccttccccagcccctcatctgtctgcctcccctcaagatggcttgccataaatgggccaggagaaccccatcttcccacaagcccagaggacaaagggcttggtaatgggaattacaatgggaagaaatgagtgggaagaagggagcaccctgggccaagggggctcggcaccaggaggagctgaggaggacggcaggtgggctgagggtgtgtttctcccacctgtggtgggcagggggtatgctggcttctggcggtggctggagagggtggtggctctatttaaaaggggatgcaggctacagctgtgaatccttgtgtactctcagagactcgcctgggactggcacttaggcagccattgcctcacctggcccagtggttcacacttctgcgggctcagaaagggcactggccagcacccacaccccgaaccgctgccctttgcccagccctgggcagtatccatggtggtgggtggggcagggttgacggaagctggggtgcaggtccacagtagatgggctcagggtgctctaggtgaactttaggggtctccctaaatctcctttaaatcctggctggaccagggagaaggctgggaggagaggtgtcgcctctgctgcatttggctggtttgggggaagtgaaaggggttttcagtgctgctccacgaaggcctcctaggccaggcctttgaatttgcccccactcccctgcatttccacctcccctagtccagaccccatccccgggtcctcagggcagtgaagaagagtctggagtcaggatctcggcttcaaggaaaattgctttattctgcttcctcccaaggagctgttacacaggctccagcatggggctttgctggcacctccagggctgagcagatcaagatgtggcaaagctactcctcattcaagcccttttgaaaggaaacaaagtccaatcagtccttggagagatggtattgggcagggacagggcatgggaacaaaggtgagaggggtctgatggtggggggcctgctttgtgggcaggtggaagcccctgtggcagcagcacatgtgtttccagggatcgatgttcggggggcaagttctggagggtagggttctggggttggtcagagggaagttgcctgggcgagaacaaagccaggcccgggttctctgggatgtccattttaggtttgagttacaagattgcaggacaaaattaggtggaagggaactggaaactagcagttggggggaaactgggatatactggttgtatataaattagggtcttctagggtggcacccctccctaaggctgaaattcccagaaccactgaaacttagagctgagctgggagtggtggctcacgcctgtaatcccgtactttgggaggctgaggcgagtggatcacaaggtcaggagttcaagaccagcctggccaacatggtgaaaccgcatctctactaaaatataaaaattagctagacatggtagcacatgcctataatcccagctacttgggaggctgaggcaggagaacccaggaggcagaggttgcagtgagctgagattgtgccactgcactccagcctgggcggcagagtgagacaccgtctcaaaaaaaaaaaaaaaaaaagttagagctggaagaatccttgaaatcacagagaactgcattaccttggcctctggggccatgtggctcaagtgtgtggaataaatgaaaaggaagcatcccgggtttgagggtgctctgtctgggtatgcctgctgtgggggtgactagcaaagcccaaaagagggacccaccttcgtgccaatgtcacggctcttggcccgcagcttgttgacctgggactcggcgatgtccgcccgctcctctgcctcatccagctcgtgctgcaccttgcggaacttggacaggttggtgttggcttgctcctcctgcgggaggtgggagcatgaggtgagagggggcctgggttctcagactcctggcttgggggacgagctctcctatgcctcccctgggcctagtccccagcagggtcactcaccgcctcctcggcctggcgcttgtaggccttgacctttagctgcagcttgtctaccaggtcctgcagccgcagcaggtttttcctgtcctcctccgtctgggggccagagggtaggcagggggtgaagatggcacagtcatagaaggtagcatcccctccgccctgccctgcttcatctgatatcctgacccaattctactttctgatcctcactaaacacttgaattctccttataatttcttaccaaatatgtgtaaatattttaaatgatctgtaccaggaaagagtccaaagaactagtgggactcctgaaattatgcacaaaattgtgtgtgtgcagtgctccagggagcaggtttttcagggtccggggaccccatgcgggatgaagtcccctgctctggacctcggcacatgctgggagtgactttggggctatgagtgtgatggaatttcctgggctgcaatgcaggccaggaaaacactgacttaatctaagttaaggacaaagtgtgcttagagagatagtgacatcctggattggaaaagaaacaaattctaattcagagtctgattctagaaaacacctcagaaagctagagtccacactgccctgggcaatgaaaaagtttttatgcttgtttgaatgggatgggtgtgtttttggtgtcttttgggggtgaccctggctacatatttgctttctggtgagctgtactgggtgagctttgtctggaattctgtgtgtgtcccctggcgatgggctaagagtgggtgttgagatggagctcccaggccaggaggctcagagactgacctctgagctaggggacattcagagtggggcagggctaggcaaagtgaaacgggggctgcattcccatcctcgccctggaagaggctaagagcaaactcttcattctcctcagctggttgtcactgtggctatggtgccagggctctgcctggagtcaccgcccgtcgcacctggtaggtgagctccttgatgcgccgctcgctcttcctcatgcccttcaccgactctgcgttgcgcttctgctcggcctccagctcattctccagctcccgcacccgcgcttccagcttctgcagctgcttcttgccgcccttgagggcgatctgctcggcttcgtccagccggtgctgcaggtccttaatggtctgttccatgttcttcttcatgcgctccaggtgggcgctggtgtcctgctccttcttcagctcctctgccatcatggcggcctgtgtgcaggagagaggtggcacatggtctggtcaagtcctcacacacttgctgcccagcccacggagagacactggtctggatcgggtcggtggagtgggggacttacatccgtgatggccttcttggccttctcctcagcattcctgcactcctgcactgcctcctccacttcagtctggagctgggacaggtcagcatccatcttcttcttctggttgatgaggctggtgttctgggttgggggagggttgggcagagcaggaaaagcattgagcatctatgcatagctctcaagccttgcttgctgagccccagcctgtgctcccttcaggaatgagcaggggagctgctcacctgggaatgcagcagctgcacccgctcactagtctcaatcagctcctgctccgccagcttccgggaccgctctgtctgctccaccacggcacgcaactcctccagctcagcctgcagcaggttgttgcgccgctccacgatggcgatgttctccttcaggtcgtcgttggcacggactgcatcgtccagctgaatctgggtgtcctgaggatcaggagagtgggcatgagcagggagccagcctcggttcccttcactaaaggcacctgtcagaggtccctgcagtaacctaggggcaggaggaatctggtgcctgtatcaagacactactgcttcgccaggccacgtggaggccagtcccctctgggtgagtaccttcaacaagctctggaggctcttgacttgcttctgggcctcggcggccatgcggttggcgtggctgagctggatctccatctcattgaggtctccttccatcttcttcttcaccctcagggcctcgttgcggctgcgtgtctctgcgtccagggaggtctgcagcgagtccaccacccgcaggtggttgcgcttggcctgttccatctcctcgtccttctctgccagcttccgctcgatctctgccttgatctggttgaactccagctgggcccggaggatcttgccctcctcgtgctccagggaggcctgggaaggggttgggggaggggatgcaggcagacagtcagggcacagggcagggtgggggcctgctcactaatcatggatacgaagtgacttcaagagtggtgtaagtggttcaaagaagcagaaggtggaggaaaagagaatctaagagaaaataaaaataagcctaagagaaagtgattcaggccctcacaggggagagccagctatgaagacaaggaggaaaatgaagagaaaagtgttgccaaggaaacagaggcaatcaggtatagagtataaaagaaaacagagggaggcagaggtgggaaccgggaggtatgtggaaatgggaagctcagctaagatgcaatgggtaaaatgtttatgtgaagagagttcagtgactggtcattcattcactccacaaatcttcactgaatgcctactatgtgccaggctctgtcctaggctctggggatgggacagtgaacaaaacggacaaagcgggggatgagaacagggaccaaaagcctggagctcagctccctgcaccccgtgccctgcacacacacacacctcggcctcctccagggctgactgcagctccatcttctcggcctccagctgctttcggaccttctccagctcatggatagtctttccgctggaacccaactgctcagtcaagtcggagatctcctctgtgtggggaacacggtaactcggttgagggctgctgaggtccagtggagttggagggacacgcctctttgcccagacgcctcttggagcccttgggtggcaccatatgggaacactgccagtgcagcccctccccagcctcttgggcccccagcacaccctgcaggtttttgttctcccgcttgaaggtctccagatgttccagggactcctcataggcgttcttgagtttgaagagctctgtgctgagggagcgagcctccttctgcgaggactccagctccgactgcgactcctcatacttctgcttccactcggccaggatctgcccggggacaaggctcactcttcagccccccagcctcagccccatgtccagggtctgtctcaggacctgcctgggctcagccctcctcccccacctccaaggaggatggctctggcctctcactgaacccctcatgcccccttgccctgcatgctggctgcggcccccacccagggcccaccttgtcgaagttcctctgcttcttgtccagggctgcagcagcagcattggagcgctctacgtccaccatcaagtcctcgatctcattctgtagccggtgcttggtcttctccagcgaggagcacttggcattaacagcctccacggcctcctcagcttcctgcagccgctgggccagcttcttcctgcccaggggagggtggcagagggtggggaggatggagggtgtggatggggacaagaggaaacaacatgaaccttctcaaagacaatccttgaaacctcagaagtgtagctggagaagcctgaggacaggtcccaggggccgagaacatcaggcagaggatcccagcagggcgtggagacccaggcaccctctgaccctggcccagcctctgcgctatggacattgaggaggtatgggcttctgcagccctccccactgcctttccctgccacagtgccctgccccagacggaagcactctgccctcagacaaaccttttgttcgtcttatattcggatcagaaacataattcgagcaaaaagcttccctgagaggagaaggaggtggggccggggcagagtcctcctgtgttgtcaaacactagctaagcatcgcctgtgtgggatctgctgaggctggggctgggctgagtcctgcctgcaaaggggcctcagccagaagtcaggctgctcagaactcacttggcctcctcgagctcctcagtccgctgaatggcgtccgtctcatacttggtcctccactgggccacctccgagttggccttggaaaggacgcgctgcagctcggccttggcctccgtctcctcctcgtactgctcccgcagcaggtcgcagtcatgccgggccgactgcagtgcgtgggccagggcgttcttcgcctggggaggggtgggcaccaggaggtgggttcagctttctccataaagcaaccccacccttgcccttctcctcaccccaatctcaacatcatcccttggcctcatctatgtccaaacccccagtggacctgtcatggtttactgtttgctgataacaaagaatgccaatacagcagtgaactatttaagaaaagcttcatggccattggccctgagctcctccccacaccagacatggtcatcatcaccgccattttacctggctggggagagggaaacaggctcagaaaggttaggggacttccctaacctaagatcactgagctataagaggcaggttagtatgaaccctggagttttttaaaaatcatgttctttctcctttttcatgagtccagcaaagtgctaggaataggctccagttgaatttctttctccagttttcaggtggccctgcaaatcccaggacccatttgtgcagtccctacatcccctagccgtgcccgggcaaggccatctcgtgcctccctagttcattttctctcctccttctcacaccctgcctcccgtccagggatgcagcagaagcagagggcctcagcctggggagtagatggcatgtggcagggtttgggctgtgatttctttttagaattcttggagaactgttggtccacagccagccttattgctgggaagggaagtgatttgatgcaaggctagtcagtgtgctccttgcttgggccaggtggcccgagtctagcccttaccttaacctcctcctccagctgcctcttgaggtcctccagctgctgggtgtaggtgagcttgcctcgggtcagctgggagatcagtgcctccttctcatccagctgccgggacagctcacctggggaagcaccattctagatcagcactcctctctatccccacctcctcctctagccctcaggccccattttctggagagactctgtgtctgtgtgtgcgtgtattggcttgtgcccgaggctggagtggctcaggaggttggggagactgtggtgggaaccatggagcccctgctctaggctcaccattctcggtttgcaacttggcccgctggctggtgaggtcgttgacagaacgctgggtctcctccgccttgctccggtgctcattcatctggtcttccaaggtccggcacatcttctccaggttagcctgagaagggaaggagagttatatgatggatgttgggggcggggggaatgaaggggtgtaagaggtgcaactgaaggagaaaagaagagggaaggtgtgaaaagaaggaggggatctgagaaccaggcagaggaagggaagtgggaaaatgaaccatgaaggaagagacactacatggacagaaaggggaggtgggaggaggaagttggaggaggggaggccgagcagagcctgccttggccttgatgatctgctccatgttggaggtgacgtcatccagctccagcttgaactcgctcttctccttctccagcttctgcttcacccgctgcaggttgtcgatctgctcgcccagctcggccacgctgtcggcgtgcttcttgcgcagggccgcggcagtggcctcgtgctgcagcgtggcctcctccaggtcccgccgcatcttctggaactcggcctcgcgcttcttgttcatctcgatctgcacggacgtggccccgccggcctcttccagccgctcgctgatctcctccagctcccgagacaggtctgagcgcagcttctccaccttagccctggcggtgcgctcggcctccagctcctcctccagctcctcgatgcgtgcctggtcagacacaaagggctcagacccaccgcctggacccctccactggaatccccccggctctaaaaggctctcggcttctctggaacagcaagtcagtttagctcttccagtggagaggtgggaattaaaggatttggggaagatagtttgaagagccttcctttaggcgagggcctgacagtctacatgctctttattggaaggaaagtggttgaaacttgctcttaaagatggacaaagagacctgtgttctggggatattttaagcagtttagtcataaaaaaataacaaaagttgaaaatgagagagccgtatttgtctgaccagacaactaaagacctaacacagcttctgctctagagtaaggaggaaagtcatgccatcagagtcgaaggactcttaaaaacctccatgtaacaggggagggcatggagacccagagatctggagtgggctcccagaggtcacccaactaaggcagagctgagacaggaagccaggaattctgccctccaggcctgtgaccttttcagggtctctgtggatcacctgaccccttttggatgtatccatgggcacactgtgatagctgcgtgcctgcctccatggacacataatcagttcctgtaatgctgtgaacaggacaccctagaggagggggcaggggaaacagaaccagcccagggactcagcatcccgcgtgggtgtccagacctcacctgaagctccttgagcttcttctgcagctggctgccgagggcctgttcatcctcaatccttgcgttgagagcattcagctcaaagtcttttctgtggggaaggagggatggtgaggtaagggagactcgtggggcctcaggagggtccaccagtggttgaaaatggtaatgatacaggtaaagagtaggatttcattagaaaaacagcttctgggggtgatgtaggatccctggaagtgtaacacctgcggtgagattgaaatccaacaagaatgtaatgggaggagtgctgtagacagggtgatggggcctgggctctacaggacattcccatctttggtccttgttttctcataatgtaaaatgagggggtcggactagattgtttcaaaggtcctttttagctctgatggtctttaattttgtcactattgctttgggtaactcagctaacctttctgaaacttattttcctctttggtaaagtgaaattaaagataccatccttaaaaggtgttttgagaatcaaataggatcgtgtatttattcatttattcaacacattctgtgcctgggaaggtatgaagattcctgtgcaaacacaaacttgatgaggatgtagattatgatgattctcaaagcctttcaaagtcctgagcctgaaacaccataagaccttcaattatcaaaatatgttctgcaagctcactgtttaccaagtctggaaagtctatacattttggaagaacttacactaagaattggaaccacaagttaagcaaaacaaagaaatggccctgatcccctgacttctttaatgtgagggcatttcttggtgccctgtgggctctctgtgaaaagccacaaagggactttcctaagaggctctcatgtggagccttcctccatgtcaaggaactggtctccaaagagagatgtgtatgaagggggaaggctgttattttcattcccactgagtgcctaacaagaagaaaggactcatgggatacaatggactttttgccagggaggaccatctaactaaccctgatatctgggactaggggaggaaagcccttgcctgggaggccttttcccatggtttgcgcctccacttgtggaggctgcgtgaggttgttgcctcagaggatggctgtcttgggtctgcttgtactgttatgggctggggaggaggaagggcagcagggaggggacacagtactttttcagccgctcatccagctgctgcttgtcattctccaggtccatgatgctctcctgggtcagcttcaggtcgccctccagcttccgcttcgctcgctccaggtccatgcgcaccttcttctcttgctccagggatccttccagctggtagagagaaggagccaggcccagtgaggcaaagcatcctgacttggtgattttgttgttcagttacctcaggacttggtaaatctttgtgttcaggacttgggaaaccttccccagagtgggccaaatgttattaggggactgtgagattgcctagatataggggatgctgaatcaatattttatagataaaggaataaatgactgtgggatgaaaccccaaagccgtattctttctttctttccctttctttctttctttctttctctcctttctttctctccttccttccttccttcctccttttttttttttttttttttatggagtctcactctgtcgccaggctggagtgcagtggcgcgatctcggctcactgcaacctccgcctccctggttcaagggattattctgcctcagcctcctgagtagctgggactacaggcgcacgccaccacatccagctaatttttgtatttttagtagagatggggtttcaccatattggccaggatggtctcgatctcttgacctcgtgatccacccgccttggcctcccaaagtgctgggattacaggtgtgagccaccgcggctggccgccgtattcattctttcagcatcctataaacacctactgggcatcaggctctgtgctaagcactgcagtccccaaattgaatagatctaagttcctatctaaaggaagcttgtagtcttatggctgagatagaagcttaaataattaaaatacagagtgataagtgagtcaacagacatatgtgcatcagagggaacaatgatcagattctgccttaaatattggaatttcaaaaattctacttggggagcctcacaaaatttccaaagaaatttatcatgttcttatgagatgaccctctaaatcttgtgtcaaaggcagagatatatgggattgcacttaaattaaataagaaaactcatctctattattgatcataccagtgagattagatacataattcagaattgatcaccacctctgacttttcattccccagctcctttctagaaagatatcagaaaagttaacatcctctaaccctacccccctctaaacataaacacaaacacacacacacacacacacacacacacacacacacacacacacacacacagagctctgggcacagatagacatggcatatctaggccccacaactctcaatctactcacatcatccacttgctgctccagcttgactttggccttagtcagggtgttgaccttgtcctcctcggcctgaaggtcatccagagcctgttggtgggcctcttgcagagctttcttctccttggtcagcttggcaatgatctcatccagcccagccatctcctctgtcaggtttttcacctgccgaccaagaatcccatctcctttagggtcaaaggtcaccagcttggtgccatctgtggggagctccatgtcaaggtccatgctgctctctggatgccgagtggctagcctgggtcaaggtcagtatggtctgagagtcctgatgagacccgggctggagccaaagggagctgcccttaccttgttctctgttgcgtgtttctccttctccactttggccagtgtcagctccagatcatcgatgtcccttttgagctctgagcactcatcttccagcttgcgcttcttggcagtgagctcagcattcatctcctcctcatcctccagcctctcgttcatctccttcaccttggcctccagctgaatcttgtttttgatcagctgatcacagcgctcctcagcatctgccaggttgtcttgttcctgaaggtgaggaacagaggggaggctgttcagggggtaaggtcctcattcttgcaggtagagggaaggagaggcacatcactcaaataggagggtaactctaggatatccccacttggcaagagcttcagaagtatggggaggggaagagtttcaggatagtataacttgggaacactggggaggggagcagagaggaaaggaaccagaaatcttcatctggacctcttcctctggtctcctccatcgaagggtgggaattgcatttgctgatgccaagcacttatgtatgatggcttaatgaaatggacagctttattccctgtctagaggaaattgaggctcaaagatgatgcatggtctgcccaaggtcacaaaataattaagctgtgtatctaggttgaacccaagtagaaagcctgtgcttttaaaagtcagctcttttccctctgccctttcctcctcctgagggacctctttggaggtctttagaagtgttgatcccagagtcctctgactgaaggaacaagacagtgagcccctgtgcagggaggtgcagggttgtgggaagtgaaggcagagcagggtggaagagccaacagtagcccaggagcctcaccgcctgcacttggagctgcaggtcattcttctcctgcagcagggacaccatcttctcctccagctccttgcggcgagcctcggacttctctagcgcctctttgaggcgtgtgaactcctccttcatggaggccatctccttctctctttctgcactcttcagcagcggcttgatcttgaagtagagcttcatccagggccaattcttgacccccatgaaggcccgaatgttccactggattaccagcagggagtctctgcaggggcccattgaaaggagtgctgagcctcctgcctccttcctacctgaggtcctgaaaccttgggaatatcccatttccttcatccctcccacccttcctgaggcctctgaccctgtgactgcagtgtgttcatatgagcccctcctgcaggtctctgtgtttgaagatctgctgagctttttttcctgacactgcccctgaaccagcctgggcctcagagaagcgggaaacctcctcttgagatctctcacctacgttccagcagctttttgtactccattctggcgagcacacctcgggactgggcctggatacgcgtgatgatgcggctcagcctctcgtccctcatttcctccagcagccccagcagcccggccttgaagaacacctgcaggcaaggtgtgtgttggccatgactagggaggggtacgagggaaagagatggtggggattaccttaggaagggtaacagcctagaaaaggattgcagggaggaggtcaatggcagctggagctgggatgaggggagtggtgctagatgttccactgggaggggtagcatacaggtaagagattttgctaagatgattacaacaggaaaagcatcagaggagtcaatggaaaagagatgtcttcctttaattaattagtctcctttcctcaccttggtgtggccaaacttgtactggttgtgatcaatgtccagggagctgagcagcttctctgcccccttcctgctatcaatgaactgtccctcagggatggccgctgggttcaggatgcgatacctgaggagggaagtgtccagagtcacccatgctctgcagtgatctgctctgcccatagaattccagggtcacctgcagatcccattcccatcagggcagcctggctccccctgttctatgagctctggtgcaccctcatacccacctctgccggaagtccccgtagaggatgcggttggggaagcctttcctgcagatgcggatgccctccagcacaccattgcagcgcagctggtgcatgaccagggggttgtccatcacccctgtggcaagaaggaagtaggaggagtctgtgagaacactggactgaagttctgggttctgatcctggctttgtcactgattagcttgtaatcttagcaagtcagttagtaataatcatttgtttcattttcttctagccacatttttaactaaaaggctttcacattccttttttatatgattcacacctattatcataggtggtagccagaacagatatatccaatgttctagatgagtaaattaagcccagaggggttatgggactggcccaagttcactaagctgatcaagaacagagccaggtcttgaacccaggtccctgagcctctgtctcctaattagccaaaaatggattaacaatttgaatatgtctcattgggggattaagtggttctgcaggtaaatttaaagttgaactaagattctgtcttggacaaccagctatccaaggggttgtagggccactgatgaggtaatgtccatcagagtgccttacacatcaccctcattacacactgcaagtgcaaggtagcgctgagagggaggtaccctgggaggcctcatgcgggatgggaggagaagaatgtggtttggaaaccactgtggtggtaggtagggagatgtcctaggaggtcctgttcccagggcggtgtatgcccagcagtgggttggcctgagtttgtggcctcacctggagactttgtctcattagggatgatacaacgtacaaagtggggatgggtggagcgcaagttggtcatcagcttgttcagattttcctgtggccaaaaatgcaatagagaaaagtaaagaaaatgccagaaagagatgcaggaagaagagaggagaagaaggaaggaaaagagagatggagagaattcgagaagtcacagagatgaaggggccctgggggcagacagggataaggagagagggtgggagacagaagggaaagaggagagaagggagatgggaagtaaataagtgaagaggccaggagatgacgggaagagaagacagagtgaaaatggtcccgaatgcaccaaggagacagggaacgggaggagtaggggatgaacaaggcagggaagggtggggctgggtggggttgggcagatggggagccaagttggctggggctgtgtcccactcaccctgtgcagagctgacacagtctgaaaggacgagcctttcttggccttgcctttgcccttctcaatagctgcaggaaggagagtcaacaaaagaagcatcagtgtggggaggtagggtgtgagtaaagaatcacagcccctctttacatccttgctggcatttggcccctgggtgagggccttcaatgtggctgcctcagtttcttcacccagttccatcccactgagtctgtaaaccttggggtacaacctgacattgaagtggtggggtgtagcaattgacctggctcagaaccttggcagaatccctgctcctctgtaccgggagcctcagtccctacttacgcgcatcagccccagcatagttggcaaacagggtgctgagcagcttgagggaagacttctgatacaagcccacgacagtctcattgagaggatccttgttcttctgcagccagccaatgatgttgtagtccacgatgccggcatagtggatcagggagaagtgggcttcaggcttccccttgatattgcgtggcttctggaagttggcggatttgcccaggtggttgtcaaacagcttggccttgaaggtcatgtcggtggccttggggaacatgcactcctcttccaggatggacatgatgcccatgggctgaggaagcaggagagagcatcactgagtgtccttcacacaggtggacatggattctgctctatggtcaatatacttgctcgtggaggtgccatgttgggtgttaaggtagtaggctcagctctgagtacagttatctactgactggaaccggttcaaggtggaggattttgtctgatgacagaaggacctttgtgaaagtctgggaatatggattctatcgatgctgtacacaccactccacgacccagatgcctgagatgctagggttgaaaataggtgcactcttatgatcccctacaccaccctcacacttcctgatccttggatgcataaaccaggcccaataaacatgcaggtgtgggaggtcatcatgcaggtgcccatcctccatgtgtccactttcaagcccctgggaaatcagctgtccctggtgccaccctgtcctgggtgctcagcacaacataggctctggaaccaagggctcggatccttcagccccttctatttttatattccccagaagggagaggggctgctattttgtctatggtgttcttgttgggtgtgcagggagaattcaggtggtaaggccaaagaggcaccttctcgatgaggtcaatgcaggcctgcaggtccatgccaaagtcaatgaatgtccactcgatgccctccttcttgtactcctcctgctccagcacaaacatgtggtggttgaagaactgctgcagcttctcgttggtgaagttgatgcagagctgctcaaagctgttgaactgcagggggcatgaggggtgggagcagtcagaaagtgggtgtgagtggccattggggctgtgcccgtccactgtgcctgagcccagcagggcgtggctggtcccctccatgtcaaggcagtgaaggagggcttcccctgaagacagagaaaatgactgcctctgtcaccacacagtccccactgccttcccatgtctggtccacagctggctctaagcaaatagctgttgaatgtgggagcgagtgagtgattgttctcccactcccaggggtcccaactcacatcgaagatctcgaagccagcgatgtccaggactcctatgaagtactggcgtggctgcttggtctccagggtggcattgatgcgcgtcaccatccagttgaacatcctctcatacactgccttggccagtgccccagtggcatatatcacctgcaaggtggaggagagacccatattgagcagggttgttgggaagagtgaacttgaaaactctcatcccaccatgccagtctccctaccctgcccacccattatcatctgaagatggacccacctgctggacattctgccccttggtgacgtactcattgcccactttcacccgagggtggcacagccccttgagcaggtcggctgagttcagccccatgaggtaggcagacttgtcagcctctggaaggaaaaggcaagtagcaaagttggtaaagagatgactgctggccaggtgtggtggttcatgcctgtaatcccagcactttgggaggccaaggcaggcggatcacttgaggtcaggagtttgagaccaacctggccaacatgatgaaaccccatctctactaaaaatacaaaaattagccaggcatggtggtgcatgcctgtaattccagctactcgggaggctgaggcaggagaatcacttgaacccaggatgtggaggtggcagtgagccaagatcgtgccactgcgctccagcctgggcaacagagcaagactccatctcaaaaaaaaaaaaaaaagaaaaaagagaagagagatgactgctgagcagacatggccctccatgacttgacagctgcccccaagaatccctgcctcccaccttcagtgccgtctggctccgcctgctcctcccgctgcttcagcttgaacttcatgtttccaaagtgcatgatggcgcctgtcagcttatacatggagtttttctcctctgaagtgaagcccagcacatcaaaagcgttctgtagggaggccccatattggcggaccccagaaaaagaagtatgatgggtaagtgagatcccttgtaagttggagagaaaacttgtctccttaatccctgtgggttctgagactcccatacccagtggggagctccaaaacaaaggatgtaagatgcagggaactccaaaacaaaggatgtaagatgcaagagcagagcagacgtcagttggccgcagccccagtgtcagtggccacagcttttctgagttacccacttatgcttcctggccctacacttgcttcctgcctggccttccatacctgtctgcatctgttcacctaacagcccctccagccccatgccgtctgcatggccttccctcctcgtcctgctccctcggtgatgcttgtttcttggcttgtgtgtctctctgtctcatggctttcagctcttcctggtttgatagaacaccagatactggccagtcctgtctcacctcatccattccccagtacaccctgatcacagggcacattctggctctcaggaggtccataccactttaaacaaccaatggccagcgtcttagctctgcttttggacccctgtttgcccctcactgccaatcctcccaccccctggctgggtcctcacacactcacatcagtggccatgagctcctcagcgtcatcaatggaggccacggtggtctctccttgggagatgaatgcataatcgtaggggttgttggtgatcagcagcatgtctaggggaaaaaacatggttagggtgggacacaagcccccggctctcatggaggctgctcgccacagcacatggcctgaggaagagcacaggacagggcttggcttggccccacatcccactgaattgaatccagcagtgccatgaaacccagggcatgccagctgagtccagccacaagcagaggggaccaggttgccatggagatagttggtctcagtcggtggctctgactcacccagcagctcaggctttttgttagacaggatttggtagaaaatgtgataatctctctctgctttcagctggaaaataactctggatttttccagaagatctgtgaacaggtggggagaagaaggagagaaagaaaagttagggtttgggcacaaggaaaattaatgataaatgtagcaagcaaaaggcagagggaagggaagagccagagagactagttggacagacacaaagagatcacacagagagatggaaacagagacccagaaggagagaaatagtctcagagagaaatcccagagaaagacacctagccatgcagagacagaaatggagaaagatgcagaggaagtctcagagagagacagatatgtagacctgaagacagagacacctacagacagagacttaaagaggagaaaaacagagggagggaggggagagagagagaggtcaagaccagatggtctagagcaagggtgagcttaggctgagcctagcagattcatggcactcacaggtctctatgtctgcagatgccaactttcctgttgccccaaaatgaattcgaatgaatttcccctggagagatggaagagagtggtgatgagttgggggaaggctcatatctgagaccattcctccaccagtccaagtcccaaggccaaggtcagggaccactcacgaagcgggaggagttgtcgttccggacggtcttggcattgccaaaggcctccagagcagggttggcctggatgatctggtcctccagggtgccctgcagaggccaagaaggaggcaggtgagagctcttctccctccctttctgcggtacaggaccttggagggcagcaggcctaccttgcccgggctctggtccttcttgctgcggtccccaatggctgcaataacagcaaagtactggatgaccctcttggtgttgactgtcttccctgctccggattctccgctgtgaagacaggggcttattgggcagtgaacaatactactggagaccagcaagcctcaaatcaggagagaatgcctgggcctacccgagagtaggagccctgggcaagaagctgccaggttatctacacccaaaatccacaactgtcttctgatgcacagaggtcagggctggcaccaggaaggatgccaccagaaggcactggtttgggcaggctgagcctgtgcttggctgggcaaagtaaacaggggagatgggcctgggctgttttgggaaaagttggtagggctggaagaatgggaaatgtttctgaagggaaagaaaatgcagaggtgaagacatggcgataatgagcttctggataaacgcgtgatgagttggagagtgggtgaaggaggtgggagaggaaaaacatgaaggggatggaaagcagaaaggaagagggagagcaaagagaggggtcagggtaatggtcagagaagaaggagatgggcacgaggttggggggaaagaggctgagtctatgcctcggggcctgggacacctgatggggctggaggctgggatcagggagattctgaaagggaatacagtagcagctacactcacgtgatcaggatggactggttttctctgtctgtggggagagggtggggaggaaaggtcaggagctgcacaggatgctctcgtggggcttctcccttccttctccctctccctcccggcctatcccagttcccttcaggaagacccttccagggcctctcacctgtcagcatgtactgataggcgttgtcggagatggagaagatgtggggcggggcctcgctcctcttcttgccccggtaggcagccaccacctcaggagtgtacaccggcagccacttgtaagggttgacggtgacacagaagaggcccgagtaggtctggggatagaaaaggagcagtgacttgccagttgcgaagggggagggctggtgattttgggagttagagaaagatcccaggagagaaagaagagaaaggaaaacctctgcatgcactcaatctgagtaatgccagtccccagagtgttggaattgaaccaaggatgttgggacgaggttagagtgtaaccctgcctagacacaaacagaagacactcttggctcctggggtggacatggatggagcaagaacagagatcccaacgtagggccaggtgcagcactcacgtagatcatccaggagccgtagcgatccttgaggttgtagagcaccgcgggctcatgcaggaaggtcagcatggccatgtcctcgattttgtcgaacttgggtgggttctgctgcatcacctggtcctccttcacggtcactgtctgcaagagcccccacccaagccctcctgtcagcctgggctttccctccttcctcaagagggttaggagttggtgagtgacagggcaatagtgctcaagagagaaggaaccaggatctcacagggaagacagaagggatattgggaaggagagggctctttggagggtctggattcttccccaaagggaaggagaatgggaccatcctcaggtctgcatgggcatggggcatgggtgtacccctctctgtccacccaggtgtacaggtggccagggtggactctcacatcagcctgacacccaccttgccatactcggtctcggcagtgactttgccaccctctcgagacacgatcttggccttgacaaactcctgtttgtcatcaggcacgaagacatccttcttgaggtcaaaaggcctggtctgcgcttctagccgctccttctctgacttgcgcaggtagggggcggcagccccaaagactgccatctccgaatctcccatggctgtgcctggagtgagcagaagctggctgccctcccatctgcccattcttcccttccctccctgggctctccccttcagtgggagccccaaaacctagcaccatgctcaagagtcaagaggagttaccagtgagtcccttcctctttgaggttaccccttaaccagaggagcagcctagcaaacctgccagggtaaaaggaacaactaactattgttcaagctggggctctcctaggggaaggaagagcattctgagctccctgtaggagcagaaatctaactatttccatctctgaccctcatctatccctggaccccctggtcacaggtaagtagctcttgatagccaagatattctctccagcacatggcagaaactagagttccataggctggctttggggctctaatgcccagtcttactagattttcaacactctagcttcagcttttcttacctgggctactcaagtgtgtctacagatgaggaaaggggccaaggcctgcaggggacctggagagagggaagaggctgtgtcagggcaggctgtgcccaacctgaccagtcccaccttcctgcttctccctggctctgttcttcagcatccaccctcttccaaaacaaggtggaaagggtggtcagcttctctggtcccatccttcttgtttttcaaaccctattccctttttcctcaagaactagttctaacagcttcctggtgtcaactcaacctgaaccctaatcctcttcactcctgcgagatggtcccacccctgcctgtacccatctagtggtacctttctttgagccatctgagagacaactaatggtcacatttgttcggcactttccagtctaaaagcacttcaatgcactttctcctactcagtcttcaccccatttgacagatgaggaaatcgaggttaaatggcttgcttggccaagagcccatgacaacaagtgggagagccaagacttgaatgcaagtctgatgactctaaagagacttcttttccatcctgtccccattttgttgtcagactttgtggacattctcagagagaagacactgtgggcttcctctcacagacacacccatcacatagccaaacaccctccacaagccctctgatgaacactcatgcctgctgcttgggcatgcctctcacatgaagacaggcttccttcccatacctcaatccgcaccccaaccccagggtgccatatatgcctcaacagcaaatgtgcacatttcaggatgtgtgccacgtaagtagatcacatcactgcgtgttcttcagtacacaaagacctggaacatcctacacccccgtgcctgtgagttccttctgcagagggtacagatactataacagtcatgactcgtggaggcatagacaagaacctctgcatgcatggacaggggtagctacacattccaggcctcacagaatcacatgaaggcatacacacttcctagaatccttctccaccattctttctccctccctgcaaaggaacctcctcgttcacagacgtgatcatacacccacatctcccacttgatatttctgtatcagtcagtgaggtacataccctttctcacattcagactatgcaggcttgtccacacacacacacacacacacacacacacacacaccctgtaatgcatattggtcccatatgctcagatgcagatatcttcccctaggaactcctgtggcacatacgcccatgtttagacctgcacatgtgtgcccagtgactggacctggtactctgcatgaagtcctgcatgaagcttgctattccaagaggaatcccttcctaagcctggagcccccttatcccagagtaaagcctccagctcccgctcctacctgagagcagcagggaaagacacagagcaggacagagctgtggagccagacctggtctcaggggctgtatatatggggcagcagggcacccccacccccaacggcacccagtccctagccggatttagaaagggctgttgtcactagaagcatttcccccaggctcccccccttcccaaacagtgctcccctccccgcctctccagctaggaaacaattggaagtggtcgtcattgttatggcatggactgtgcagggtctgagttccagggggcggggtggctcaaagtgcagcaaaaatatctcccaggccaggcctcacattccacagctggcaggagagggaactgaccacgaccaccaagaccacaggcagccaatgtcctggctctcccgcagggcacttctggccctggacactgctccccctccagtcccctgctgcgaggcccctgatggcctggccgcatttccacagtgtcctccctgctctcctggcccaggtcctgtatccaactggaagctgggaaggggctgagtgtcagcagcagagaagggtaggacagagttgggggcatggccccagggtgaggcagctagactggggcagctggaaggacatttcctagccaggtggcaagaacaataaccatggagcttagagatggggactctggctcaggcactgatttccttggaccagcaggcaatgtgttgaggtcaccaagcctccgagccagacaggcctttagcaatccatccaagcacttcatttaatggagagggacagtgcattctttaaggttatacagctaatcggggcagcaggattcaaggtgggaaacctcagcagatgggagtggagcccggcctgtggagggtagcctggaaaggtgggctgggattccaaagatgtggggaccccctatgcgcagagagcaggacccagctgcattggtcctagtttggagcggtttgcctgactcacgttcctggctctgccccacaggtactaaaggcctgagcccagagacagaccctctcagagctatagataatacaactacttggagctggaaggagacccctaagacagctgttgtctggcccacccagcctcagctttatccagagctggaggcgactagtgttctggcaagtgaggcagagtaacaggacaggaaaaatcttcccctctgcaggcctgaggaacagccacaaaggaggggaggaaagggagctggggcccagcctacgagcacagaacacaaccgatgccatgctcttctagcaacggggcatgcaagcttgactggctccgtgtctaggcaaccactgcacgatttggtgtgaaatctcccccttcttcccaagcacagctcttccgcgcatgcggattagtccatctgattagctgtcagcttggaaggagtgaggcaggcctgggggatgggtgcagcaggtacattttgaaggtggggtgggcatagcagggaagggaaaatccaggaggaggcctctgtgggggttgcttggtaaccaaggcactaaggtacagtctgaggacattgagcagctataaggggggtgcaggcaagtgggggtagaccacgaactgcaagggctgtgtctgacaacaccgcagctctgcagtgctaaggtatacagttgctgaggttatcccagtagtctgtgctactaacatgcccggcagaacagactctggcagtcccccccaggccctgccaggtgctgaggaatcagccccattgacagagacagaccctctcaaagctatagataatacagctgcttggagctggaaggaaacccctaagacagctgttgtctgaggttccctgtaggaacctcaaggattggcgatgaggggcaaaaactcctttcgtccccaccttccagctttccaagctccaaactgccacccctccctgatttcccagggcaattaagatgcacaaagggtgcttgggacgtagttgagccatttcaaagccagtgtcttcaccacaggccagcgtccttccttggctggggacttgggtagtcttttctgcatttgggaaatcaatcacactttgtttctctcctttcgggtttgggaggctctggtctgttggtgtttgggtgttactgttctccacccatgccccctctcattgcagatagaactcacctccctaactaggctttgcctcacagctcagacagatcagagggcctgctgtccttaaagatccccactcactccctagctcctccagcacctgctcttggttacatcatgattctcttcctgctgcttgctgctgtctgaagactgagcagctttgcagattcctccattcaacaagtatttattgagtgcctactatgtgccaggcattattctggtcaataaggacataacaatgacccaaagaaagatccctgctctggactgctttagtcaactgtttgtagaaatggcatccaggcctaccctttgcacacatgcacattccttgtggggagagtgaggggccaggggccccaccatgctggggtgggtggggattgtgcagagtgtgctacaaagtgatagcaagataaaggagagcaaagcaaaatgctataaataaagagaggctggaaggagggccgcttcggcaaggtagaccaaataaggcctgaagtgaaaggaaggtgatctgtcccccgtcctcccctccccgcattgtgccggctttgtctgcactctgtcaccaccctgatcaagtgtcaagccaaaacaggggccatttgctgtgaacacgccagcggtagttcagaggaaaagttgctaaaattactcccagtaattgtgagggagggagacaccagggcgaattagaagcgatgtcagcatggagagaggggaatcagaaaaaagctccggtacccaaagggaaggaagaaacggggcaggaagaggcagggcacttggtgcaggggaggaatgaggcactcgttgtttgtgcacagggcagaggggagccacccaggagtggaggctgactctcccatccgcctgcccccagaatccctgaccttggggggaccctgccctggctccacacgagcctaggattagggagctgagctttctgcctgtctcagatttccctttacaaacagctgctccttcttgtcattcttttgtcttcctgctggcttcaaaatcttttgtacttgtgcaccccctctcattccctactctaggtctctgctttctgatggatgtgaacaaagagagagatggagggccggagacaggcttggggctggcctagttcactttggggtagttagggcaggttgatcttgccttcagggagtgtttggagggacacaactcaccaaaagggagactttgtggggagtgaccggtctggagggccagaggcctcagaagcatacaggatgagcagtctggtcagctttggagtcagtcacaaaaatccactttgaaacccagtgattccattttctagctgtgtggtctacgtcagtcatataattgctttgagccagttttgtcatctgtaacatggggatagccacattttgtttccagggctactcaggccattagagattgcacaagcagagtctacacacagcagacacactgtgggccctcactgaatggcagctcttaggttaggaacacaaaattgaggaagccaggctgcagacaggagggccggttgccctgccataggttctttgtccccacacctccttcagccccactaagtccacttggttcaaaggatggtctggaccagagtagatcagaaatcctgcagtcttgtggtcggctctacccagactgtgactgcccttgggaacgtcatgccaggaggccaaggttctcagactgtcctagactcagtctaggcccacagtccagccctgagctgggataggcatcactgcttgactgctgcccactgagcttccctcatgacaagccagtgtgtcctgaggtccagcaggagttgacccaggccaagtggtgacattggtcaggccaccagataggagcaggctgggcgttggtggctcacacctgtaatcacagcagtttgagaggctgaggcaggcagataacttgaggtcaggagtttgagactagcctgaccaacatagtgaaaccccgtctctacaaaaaatacaaaaattagccgggcatggtggtgcactcctgtagtcccagctactcaggaggcatgagaatcgctgaagcatgagaatcacttgaatctgggaatcggaggttgaagtgagctgagatcgcaccactgcactccagtctggacagagtgagactctgtcccaaaataaaataaaataaaataagctttcaagatggggacatgacagtggagcttggtgaggggagggctttaagaagcactgagtatcaggatatgttctgggcaatgagaatcacagagtgaccaaaggcatggaaggggaacggtgtggtgagttcataaggactcggaggacacatgcctgatgaggctatgcgtatgggggatctggagacataggtggaaggaaaaaaaggtagggccccaatgtcggagaggggaaagggctatatacatattgagtgaccacctgtgccaggtgcacagtgttttatacaccatgatctcacacatgttcacaattgtgtgtcactttaattgtgttttatggaggagcaatggggttcagagaggctaagatgtttgctcaaggtaagtagcaaacgtggcactgggattcagacccaggtctgtcttgctcaaagggctttctacggactctgccctgtttcccaggacagcaaaatggataataccctggaagcaatgaggaatgactaaagttctaaaccatggcagtcattgtgatgtcttgaaaccagagtttgatgggcctagcaggggtattattgggtgctttgcggaagagaggctggaggcagggagacccgagaggaggatacagtagccatcaacgttggcaggaaagcgagaccagcagcatgaagcggaaaggcaaggctggaaggcctttctaaagaaggaataaaatgccttgctaacagcctggacgcaagaaatgaggaagggagaggcatgactgcacgatgtcggcaaggatgggaataatggcaaaagggacacgtaggaggaaggacagtgttccgtttgggggaaatggaggtaagagtggggcaaccaatggaagatgttttgctttcctgaaggaagctggagctatgagaccagtgggcagaactggataaagagggctgactacctcgggggatgtgaaagaagccatgaggttggagagaagaggaaaggcctgggagatacccacagtacagcgatgggagaaggaagagaagcccgcagagaagagaaggagattcaaagacagctaaggagagtgagaaatgggcagtttcctagaagccaaaagaagcatttcaagaagagcaggtggccagcagtgtcagatgccaaagaaagcctgtgtatcaggaagacagagaaaagaacttggattatcttggagcaagcagcttgtgtagtgtcacaggcaaagccaggccacagggagttaatgaggaaaaagatgagtggacaggaagtggaagcagtgggtgtacaccatgcatttgaggagtttggcagtgaaatgaatgagattagacaacaactcaagggaagagggccaagtagcacggtttgttttgtttttaaggtagggtattccagaatatgtgaagagggggtaataaaagatgcccttgttttgttcaccattttcttttgcactttctggttgttttcttattctcatctccctttttggaagcctggggggtgctttgagaatgcctagagagtttgggtacccaccaccagaaagtgggcttgcaaacatgaggctcagctggctccctcctcatcttcagatatgcacgtagggagctcaaggcagagctcgatacagccctggctgtcatcattgggcccactcactggctggagaagggtctcagcctcctgagttccatcgtataaagattaaagtagggctggagggcagggagtagccctagcgaatgatctggaaacatatgtagtgctcagcaattcaatgtcttctgcttgtttttgcttcactatttttactttacgtagaaagacaatgtccctggtgtgaaggtacaggtgcctttactgggcccaacctacaactcagccccaagagagcttcctagtctcttagggcagggcttttgctggtgctccaggagaatggtggaatgctgacccttctgggatgttctgtgctgtagcagacatttgagactgcagcagcacttgctgggtgtgcaagcccagcagaaccttaattccactttagtgcagaaccttaattccagtcctttgctatacatgcctcaaagttctccacaagagttagaaactgagtaagtaggcaacagatacacacattatgcaggttcttccagccatgggagaaggtggtaagtgacctccctgggtctgagagtcacaaagtcagatttggaacagaggggcctggggagctggctggtgcttttctccagggaaacttttccagggcagctagcagtcccagtgccagactgcctcttgggtccatgaatcagattggaggctgagagctggtcaggctcctggatgtctgaagggaccagtgcagaggtttagcttccctacctgtagcaaggaaagaagggcctttatcaaaggtctgggagtttactagattaaaacagctgaaccattctaagcaggaagagtgggaaggaagcaagatgggacagtagttggtttgctgggagtgaggaaaagtcaggaaaggggtccatggagaggctgggagaggggcagagggggagatatgcagagatattgcatagtagcggggctgggggagctgaggtccggctgtgggaacaaagacagtggagtgacgaggctaagactgcagaaaaggtgcagagctgtgtgtctgtgcatggtggaggagatgaccttgcccaagggcagagccttgtggctctgagaagccagggcagggggcacaggctccagcctggtctccccgtgcctgggccccttgtctctgagattacagccttggctgccaagagcagctccatgggggtggtgtggaacaaagcgaacggcccttttgtgattctgggttcctaagaatagcttggctgtgtgtggggaggtgtctgtagcctgcctgtcctgggtcttgttctcagaggtgttcgaatgcctggtgttggcggggctcattgctagttgctggggtagtggaggccgtcagcccacctcagcctctgttacctgtgcttgtccagctcagctttgggagaaggctcaaggcccagggacagtggaggggcagacacggagtggccccaaggtgttaagggagagaagacaaaggccacaagcctggaaaacaaatttgatgcctgaaagtgaagacagggagggttctgggaaggtaggggttgagggacagcagccagaagaggccagagcagggatggacatgtgggaaggacttgtgggacatggaggagaagcagagagaataggtgcacgcggaggccagaatgtggaaagcaaagggatgaggaatggtccaggggagggggagcaggatggacgggttgacagagaagagcagatggaaggagagaagagaacgaagcgggaaaggcagtgggcacttccacagagattggaggggggtggcatgactcttggaagagcttggaagcaaggctctcaaacgccattcctgtgagataacaatgcagtcaaatccctccctaatctcccctcctattattagcccagcgtcctctcagagaataggccacaggtccctgggctctgtcctttcccccatgcccttggctggaattagacagacgtgcctgcatggtcatctgctaaccacggtgtccggacttctaggcaatgtcattggacaagaggatagagaggtagtgggaaggggatggaaggtcaccggacaccctccgtggacgaggcagcagctagacacagagaggggtgaaggggtgcactagaggtctttgtgctcaaagacttttcagatcaatagaataaatacacaagcaacatgatcacaagtacaaaataacatggttaacacgtgcaaaataactggaaagtcaaacacatagccatggggatgcaaaagagctgtcatgaaagggcagagcagagaggggagggtttctggggaaggtgagcttggaggtgggtcttgagaggatggatctcgaggaaccacgtccacagctgctggccaatgctgtgggcattccggaggaaagaagggaatcaaggagacagtggcttctatgtctacttttctggcccagcctctaggggcaaggttgttaaaagcttaatagcagactcctgggtttttaagcacactggtatttgttgctatttatttaaaactgctgtttctttcttgtccagcgtggtccttttacgttttccccttagcctccctcttgcctctagtatccctaaatactgtttatcattttgatacttaaaatggccaaaagttatcatacatatttttattttgagctcttttgactctgacaaatcgaaacaaaataaatacttgatgaataatgtaccaaagaaagtgagcagctgctgttctgtgttcctatgagggctccaattgctcttgcaggatgagggacatagatgagattctctggatcatattcagggagagggtggaggagggtggaggtagcttgctttctctctctctttttctttctgttccttctctctctcaacttgcttttttcttcctctctccttctttccttcctttctttcctttctcccaaattataaaagtaatgctcattactttaaaaattcaaacaataaatcttctataaggcaaaacaagtgaagtcccttccgctgttcacaatcccatccccaaaggttaatagtcagagtgtatcctgtgcttgtccatttggaaccttttatgtatatgcataaaatacatgttgggatttttttttttttttgacagagtctcactctgtcactcagcctggaatgcagtggtgtgatctctgctcactgcaacttctgcctcccaggttcaagcaattcttgtgtctcagcctccccagtagctgggattacaggtgcgcaccaccacacccaactaattttttagtagagatggggtttcaccatgttgcccaggctggtctcgaattcctgagctcaggtggtctacctgcctcggcctcccaaagtgctggcattacaggcatgagccaccacacccgtggattaaaaaaaaaatagagacagagtctttctatgttgcccaggccggttttgaactcctggactcaaacaatcctcctggcttggcctcccaaagtgctggaattattgggatgagccattatgcccagccacatgggaatttttttcaactgggatataaaaaaatgaaacatatatattcaaccagggaatgctgacttaaaaaaaatgtatgtagtttttggaagcttctcaagtcattaatgattccaggatccctcttcaagtgacacatgtggacagttaccagagtcttcagaggctatatagtaatcagcactcaaaagtgaatcaaagtgaattttgagaaatgaatgaaagaggccaaggaaggataagaaagaggatgccaaccccttttaacttcagcccttctttgttcctggacatcctcctctcaggagaggtcacttggacaacatctgtctggggtcagaagtgacagtaggtgcatggtagactctcgggtcatgggag

SEQ ID NO: 326 - DNA, 308888 bp, Homo sapiens
attattgcctgtcttttcaataaaaggcattttattttatttcttattttatctttggagacagagtcttgctctgtcgctcaggctggagtgtagtggcgcaatctcaactcgctgcaacctccacctcccacattcaagcaattgttgtgtctcagcctccctagtagctgggattacagttgtgtgccaccaagcacacaacttgccaccaagtcctgctaatttttgtattttttgtagagacagggtttcaccatgttggtcaggctggtctccaactcctggcctcaagtgatccacctgcctcagccttccaaagtgctggggttacaggcgtgagccaccacactgggccaataaaagccattttaactggaatgagattagaggctcatattaatgggtctgtaatttgagaagggaaatgggaaacgaaggcagagaagcacagcaaggaagcattttgcatagcttatggatatccgaaatgactggattttatttaatacatttttatattttaaccatagtgtctgggtaaaacacccggtttatcatttacccttctgggtgtagacacagtccctatttgatagcgtataaacccaatctctgcctgggggtaatatgtggcagaaggaagtggagtcagtttgtctaggagctataccaagctcctcaacttgctcccagggtgtcctgaaaagtagctcccaggaacccccagggacctgcaccgtttcatctatacaacgggcatgatgataacacacaccccacatccattacaggttttctgaggaggttgtaagtagaaacataccaagcgctcagaacggtgtgcaacatacagtattctcacaatgcagattgactttttatttctatgaatattttgaactgtttgtagatccaccacagcatattttaaactacagctcactataccaggttggggaatgccatgaagtctgcagcccaggcattgaagggtacctcttgtctctcattttcagaagtgataggcaaagccggtgcttcctgcagaaggcaggagggaatgggggtgccgcccttcctcatgccctcaaaacctacccagtgggtcagtcaaggtgcagctactaggtaaggaaagatctacgcttaagatctatgtaactgaaatgtgtttaaatgtatagatttacaccaatcacaactcaaaccacatgtggtgtgggtgtgccaggggttcaaacttagctttgcgcttgggtttttttgtttggttggttttggtttttgagatggagtctcactctgtcacccaggctggagtgcagtagtgtgatctcggcccactgcagcctccatctcccaggttaaagcgattctcctgcctcagcctcccaagtagctgggactacagttgcgtgccacccatgcctggctaaattttttttaagtatttttggtagaggaagggtttcaccatgttggccaggctggtcttgaacgcctgacctcaagtgattcgccaacctcagcctctcaaagtgctgggattacaggcgtgagccactgtgcccggccacgcttggaatttttgatgccgctgcctttggatagtctgtctgcttcagggagaagcagattcaaggtgtcctttctggccgggcgcagtggctcatgcctgtaatcccagcactttgggaggccaagacgggcggatcatgaggtcaggagatcgagaccatcctggctaacatggtgaaaccctgtctctactaaaaatacaaaaatcagcccggcgcggtggcaggtgcctgtagtcccagctactcgggaggctgaggcaggagaatggggtaaacccaggaggcggagcttgcagtgagccgagatcgcgccactgcactccagcctgggccacagagcgagactccatctcaaaaaaaaaaaaaattcctttccacctggtagaggtgccgttagtattacctctttgtcagctggtctcttaaaatttcctttagtgtttctaggggttgcacctttcagattcttattgtcttgagctcattcttcaccaggcccggaagatgaagtcacggacgcaagtccctggtatttgattcttactgcctttcagagttgctctgaacgttgcacttggaggcagttccaaggttcatcatcaggtttcagaattggaggtttaagctcttagccccctcaccaaagatcaacatggcagagggaaccagtaatgaacatgagtcataataaggtaactgcaaaaaggaggaagcgttttcttattcattatgattcaggctgcctaactttaaaaaatgtcaactgggtaaaatatggatacattttggacttgaagttcaaaatgcgtattaaacattctatggcaaccactgaaaaaatagaaagagtgaataactaccaaactagtatcaagaaaagttgaaaattaaggctgggtacagcggctcacacctataatcaatcccactgctttaggggactgaggtgggaggatcacttgaggccagcagttctagaccagcctgtgcaacatcgcgagacctcatctctgcaaaaagttttttaaattagctgggcatggtagtgtgtgcctgtagtcccagctattccggaggctgaggtaggaggatcacatgagcccaggaattcaaggctgcagtgagctatgattgcactactgcactccagcctgggtgacagagtgagatcttgtcataaacaaacaaacaaaacagaaaataaaaatggaaaattagaaaggaaaacccttcctccccaaaaatgcaaggaaggataagtatttaacttttcttcactgaaagacacacagaatgaaagacaagccatgtaactgagcgaagatatttgggatatgtatgacgcaaggactagcaggtataacatataaacaactcccatcaatcaataagaaatcagttcatccggtgaaaaaatgggccaaagacacaaagtgacagttcatagaaaagaatccaaaagtggcccaaaaacccaaaaagatgcacgatgttatcagtaaccagggaactgcaggttactaatttccacttcagaaagacaagagtttaaaattaaagtcagataattttcttttcttttctttgtttcttttttttttttttttttttgagacggagttttgattttgttactcaggctggagtgcgttggcgtgatctcggctcactgcaacctccgcctcccaggttcaagtgattctcctgcctcagcctcccaaatagctgggattacaggcatgcaccaccacgcccatctaattatgtatttttagtagagacggtgtttcgccctcttggtcagctggtctcgaactcccgacctcaggtgatcctcccaccttggcctcccaaagtgtggggattacaggcgtgagccactgtacccggccaagggatttattttcttttagcttgtccacagtggacttgtggtacccatgtaatatgcttaaatgttttgtcccaggagtcttgcccatgtggactagaacagcaggctcccttagtgtctgacttttgctggggttcagaaaaaggaggcctctcaggataacagagggcaagaggtgaaggaaattgcagtcacagtccccaggctcctccctccaagtaaccttgagccagctgttcctgcagctgtcagccgcagctcatcaggcagcccctctctgcagctttcctggccacatactccttcttccttcaggccaagaagtggaaaagactttctgccactgctagcccctgaggcctctacactccttgttggttttcctaaacgcaaatagtgtcttttttttttgagatggagtcttactctgtcgcccaggctggagtgcagtggcacgatctcagctcactgcaagctccgcctcccaggtttatgccgttctcctgcctcagcctcctgagtagctgggactacaggcgcccgccaccatgcttggctaattttttgtatttttagtagagacggggtttcaccgtgttagccaggatggtctcgatctcctgacctcctgatctgctcgcctcagcctcccaaagtgctgggattacaggtgtgagccaccgtgcccggctgcaaatactgtctttattaaactctgctcagattaaccaatttgagggtgtctttactgctgtgacccccagacgaatacacacatacttcctcccacatcctgccctcaatgtgtatggtatagacttcttgatagtactggtgggctatgacaagatgccctctccctcctcaggagcctggggttataactgtgtcaagagggtttgaccacaacaccactgacagttgaggccaggttctttgttggagagaaggtggttttcctttgcatcatggaataagtagcagcaccccagcctctatctgctagacgccagtagcattcccccctccaaatcttcacaaccccaaatgtcttcagacattgccaaagaaaggtaccttcagggcaaaaattactctcccccaccaaccgccgcaccaccccatttgagaaccactggtttagatgataggagattctcggtgtgtggcagataggattgaggttgaaggctgatgccaggtgtagggaccagggctctaactcctcagagagcacgtaaaacatgaatctaccctgtagttgctgtgcccagattcattgccattccaggaaatgagcttaccacattgactgttgaagtcacgccagccccagcatcaaaagcgaaggagtggatgtttcagttaaaattgcgggaggggacttggtccttcctgttgcttcttctgacacctgcatcaccgctttctttttttcttttcttttctttctttatttttatttttatttttttttgaggtggagtctcgctctgtcgcccaggctggagtgcagtggcgcgatctcggctcactgcaagctccgcctcctgggttcatgccattctcctgcctcagcctcccaagtagctgggactactggcacccgccacctcacccagctaattttttgtatttttagtagagacgggttttcaccatgttagccaggatggtattgatctcctgacctcgtgatccacccaccttggcctcccaaagtgctgggattacaggcctgagccaccgcgcccagcctgcgtcacccctttcttgatgtccatgtatctgatatagttttctagacagcagagctgcagatccagaagacacagttgggtcagggacctgaaacgccgtgctggtgagcttcccattcagctcagcctgtgctaagggaggttgagatgcaggattcctgcagtagacggtgaaggaagagatcaaagagctcagagacgtcagcatacttgaggggatatattaaataaggccagaccacccactggggacccaggacacacgaaggccactgggagagagggcacccacattgctaagaattttagtagtggctctcccccgcagacagcaccagtggtaggaaagccttttacagacctaaacgcagccattcagtcattcaacaaacatccactgagcacgtactatgggcctcgtggactgtaacagtcactgtaacagccccttcagtgggactttctctgcatctcttcctcctccacactcccagttgcagccctttgttcactcattactttgttcaccagagagtccatgagcagctactcaatgccaggaatgaaccaggaggctagagaccgctggaggatagacaggtagacagacagacagacatctagggaaagcacagtgcaggactaggtcttcagacactcgctccagtccagtttccatgcgtttactgtaaaccagcctcaagagacacagagacagtttctcttcattgctacagggatggtggcacacaagtgaggcccctgcagtggtcacagggatggattttcatgattgttgtacatacgaacacgcataggcctgttctccagtttattaacacacacatccatgcacatccatgcacatatactcacaaacttccatgctcactgtacagtcatatcctacccatgggcacacaggacagcttctctctctctctctctctgtctatgcctgtctctgtctctgctctgtctctctctcttacacacacacacacacagtagttcccccttatatgaagggaataccttccaagcctcccagtggatgtctgaaactgtggatagtactgaacctccctatacactatgttttatcctatatattcatacctatgataaagttttatttataaattaggcacagtaagagattaataaaaataataataaagtcaacaattataacaatatacctgtactataataaaagttacatgaatgtgctgtctctctctaacaccttaatgtactatactcaccgattgttggatggtggttgactgcaggtaactggaaccttgtaaagtgaaaccacgaacgaagggggacttgtatacccacacggctccccgatagcaatggagatgacaggaccccggaatgatagagatcaggtggcagcactcatcctagtgagtggcaaggtggaagcagctcacaagacgtatggagacgattaacagaatgtagcattctaagggcagaatagatgggccaccaaaaagggtccactccatttgtaccattaaaaacattaaggatgggctgggtgtggtggctcatgcctgtaatcccaatgctttgggatgctgaggtgagaggatcacttgaggccaggagttcaagaccagcctgggcaacatagccagaccccatctctaccaaaaatttagaaaaattagctgggtggtgtggtgtatgtctgcagtcccagctacttgagaggccaaggtggaaggatcacttgaggtaaggagtttgaggcttcagtgaaccgtgatcaggccactgtattccagcctgggtgacagagtgagacccagactctaagaacatttaaagaaaaaaattaggggccgggtgcagtggctcacgcctgtaatcccagcactttgggaggctgaggtgggcagatcacctgaggtcaggagtttgagaccagcctggctaacgtggtgaaaccctgtctctactaaaaatacaaaaattagccaggcatggtggcaggtgcctgtaatcccagctactgaggaggctgaggcaggagaatcgcttgaacctgggaggcagaggttgcagtgagcagagattgtgccattgcactccagcctggaggactagagcaagacttcatctcaaaaaaaaaaattagggatgatcaagagatagaagtcaattgtccatataaaatgtcacaatcccttggctgttttgtggatccagaactccttagcctaaggagaggccaaatctccaggggaaaggaacaacaaccccacagcaggtatgtaaagtgatgattcccttggtctttgcccagacaaacccacagccacttgaactgtcctgacacccaacagaatagcaccacgatccactctttccatgacaccacgccaactggatcagatgagcccaaagcagccggttctctggatgccttgataagaaagcctccaccttctcgtcttttcccccagcctggggaatgaagcctggagactggacagtaaatgctcagctgggtgacaaaatcttgcttataagggctgccctaaatcaccgtgtgctcaaggtaatacttggtcatcttgtgtagcaaaaatccacccaccacaggtaccaacaaggtgaatggagcaaacacatgccatgttgactccttggggaacggaggtcccttcaagtcaacggaaccatcactgcaggtcatggcctatagagagtcccagccctgggcccagagaatcatttctgcatgtcaactctaccacttcagaccaacagcgtcggaaagacagcaaggacagaaaagcccaggagccaatggttcaggacttgtgatgcaaggggcgggagaagggaggttcttgtttcaatgtcaaatgatctagcacaacctggagaaaacagctcaccgggacctgtctccaaactcttcccctggtgtggcctaaatgtcccatgccactctccactgggggccgcagggacccctcctcaacctcatgtatattatgtatattgtattttctttttctttcttttcttttcttttttttttcaaaatgtagttttgctcttgtcgcccaggctggagtgcaatggcgccatctctgctcactgcaacctctgactcctgggttccagctattctcctgcctcagcctcccgagttgctgggattacaggtgcccgccaccacgcccagctaattttcgtatttttagtagaggtggggtttcaccatgttggctaggctggtctcaaactcctgacctcaaatgatccacccgccttagcctcccaaagtgctgggattacaggtgtgagccaccatacccggcctagactgccattttctaagcagccttcccttagtgtttcaatgaacttctgattgaatgctaattttcaagacctcggcagaagtgagtactttgggaaaatattgctcgatgagctctggggaaagaggagcagcaccacatagcaattattgaaacaattctcacaggagcagtatcatgctgggctgattgcggtctttggaaccagaaagacttggatttgagtcatgactctaccctttgctagctgcatggacctgcatggtttatccaatttattgaagtctgtactttgctccttttaggcagtggacaaagcactttttttgttgttgtttttttgagatagagtctcttatcgcctaggctagagtgcagtggcgtgaccttagctcattgcaacctccgcctcctgggttcaagcaattctcctgcctcagcctcccaagtagctgggatcacagacaaccactaccccacccagctgatttttttttttttttttgagatggagtctctctctgtcacccaggctggagtgcagtggcgcgatctcggcttactgcaagctccgcctgtagctgggactacaggcgcccaccaccacgcccggctaattttgtttttgtatttttagtagagacggggtttcactgtgttagccaggatggtctcaatctcctgacctcgtgatatgcccacctcggcttcccaaagtgccgggattacagacgtgagccaccgtgccaggcccaaagcacttttttatagcccctagtttgctgttgtgtctgtttcctctacggcccgcacagcctgggtttgaattctggctctccatggccttgggcaagttggttaactttttgtgtctcaatttccccacttgtaaagtggggctggggaaaaaccctacctcatagggaacattaagtgagttcatgaaagccctcggtgtgtggcatgcgataaccactacctaagcataaggtatgtttacatgcactggttgtttaccacgacgcaccagcattcattcaagttattttcttccagagtctgcctggaatgtagaaccggccagctctcctcctcaaacagttcctgcaacctctggttatctgtgtgggcagaggcgggagtgtgggtgtgtggccctgccctgggacagggatgacgagagagcatgtgcttgtgtccagagctgtccccttccctgctcaggggccaccaaatatgtccatggtctctgctgcctggtcaacggccaccccgggctgccgtctcctggccagacctggagctcacaagctaattttagaaatgactggtcgactcagctgctgctatcacattggcccagaaggagggtggggggaggacgggtcggggaggggcagtaaggggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaaggtactattgggctgggttttagacgggcaccttgcgagcggatcggcgagttttaattttccggaatgcgctgctgggggctgcggtggcaggcctccggtcttttggtctattttaggcctttctggtgttgagagcttccgaggcctgattcctttgcctgttgcccgtgctgctcactttgaaaacaagagtgtttcggtggaaggatttgagaacaaaatgctggggcaaatggacattcgtaagaatcactctcctcaggccccagctgttcgctaataatttttaaaaatgtgtttagaatcatgagttaatctccactgtgaatctttgcccgcagacgtcagggtttatatttttcctcaactaccagtaatttctgcttcactggtgttcagttatggtcggggaagagccaggcttcccctttcgtgttaacaacgctgttgagtcgaaatgttaattttaatgttcttttttaaactgcaaattaagcatgtatgagtgttgggggaagggcaatggaagttcatggctgaaggtttcaatttcatgccaccttccttgagctctgtctgagggaaggtgtcttatctggcaccccggatagcaggcatttctctgaatgaagaagattcacaggtcccagtggccccatagtggggcagaagggggctatgctttgacatggagctctctcccaggagaggagaagacctcaccagctacaggcctctgggctgctgccttcctgcagcttttccatggaggaggccaggagtggggaggcccggaatggggagcccagtcggctcccagtcggctccaagctgtccagtctggcctcaacccgcaagtgtggggatctgggcttctatcctgtagggcctggaatacgacgaggctgttactttcactttgtggctgtccaaaaagatgctgcctcattcagtgcaccagctcatggaggctgagtgtcccactagggcttctagactccaacaaggataatggtggccttgggtgctgtatccattgctgacctaagttgtattctcctatgcctgggtaccatgtccagtgtgtaccttgggagcagaaaagagaggggtctatatactcttaggctatggatgagttctagaaaataatagtggagaggagagagagaaaagaaggaagaggaggaggagaaggagaagaagagaaggaggaggaggaaaaaagcaggaggagaaagagaagaaggaggagaagaataatagcaaaggaaaaggccaaaagaaaaggccaagtgggtggaggagggaggagaaggaggaagaggaggaggagagggagtctcctggtctcctggcttttgaagggctgcatgttaccaatcaacaaatatttgatgtcacctgcctccaggcctggtcaccttgaatatcctggtgtgggctctgtaaccttggatgagtactctccccagtcggaacttagtttctccttctaaaacctgagggggttgggctagaccacctctgggatctttcctaggattcagcatccaggaaggtttttcttgaagtgacggtcgttgacgacctacccatcagactcatgtggggcaggaggcggggggctgttttaaaatgcagattcctgggttcatcctagaccttttgaacagtcttgggggaaggggcccagaaatccacagattttaaacctcacaggtggttctggtgcccacccaaattggagaagagcttttcctttcacttgagctaacaaaaccacagaaggctgttgctcagcacctgccctgtcaaaactcatggaatttccatgtttcacaaacatggaaaacgtgcacagcactttattagggtctaactatcgcaaagattttattgggcaggtgttcctccaggggtaagatcaagactttctatggcattttgaggtgggaatggagggcccccaaactgagcagaaccacttccagctgccaaaagatagggacctggggctgtgagcctacaaggctatggggagatggcccttcactgggtcctgctagatacaaacaactgtctgaatggcccatttgaagcacatggtcagctgctgtggtgtgtggcatatctttaatatttaaacaaagtggccgggcgcgggggctcacgcctttaatcccagcactttgggaggccgaggtgggcagatcacgaggtcaggagatcgagaccatcctggctaacacggtgaaaccccgtctctactaaaaacacaaaaaaaaattagccgggcgtggtggtgggtgcctgtagtcccagctacttgggaggctgaggcaggagaatggcatgaacctgggaggtggagcttgcagtgagccgagatcacgccattgcactccagcctggggacagagagagactccgtctcaaaaataaaaataaaaataaaaataaacaaaatgaaattaaattttctgaaaaatggaggaggtgggtttgagaccagggaggatccccctcccctccagagtgctgccaaatccaacccctcctgttgagagatggtgcagctgaggcacagagagggaaagccacttgttcaaggacacacagccctgcagcaagagcattgggccaagatcagcccctgctgtcacggctggtgttcagggagcaaccacgagccccttatgttagaaataatagtcaaatccaccatatatattatccccccgcaccaagatcttaaggaaaggataaacctcagctctcatttgaatgggggcagcaaaaataaattgcgtcttattttatttttattttgaaacaagggctggctctatcacccaggctggtgtgcagtggcccaatctcggctcactgcaacctctgcctccgaggtttaagccatcctcccatctcaacctcctgagtagctgggactacaggagtgcaccaccacgcccggctaatttttatactttttgtagagatggggtttcaccatgttgcccagtctggtctcaaacttgggagctcaagtgatccacccacctcagcctcccaaagtgttgggattacaggcgtggaaccactgcgcctggcagaaaatgaactttatgacacaaacaagggccttggacatcaaggtagatttctctctctctgacacacacacacacacacacacacacacacgcacacacatctcattcagtctgaaggatccagagacaccattagcttcatatgaatctctcctctcccacagcctgactcatccagtttcataattttccctatctgcttcttttttactgtgtttctccctgatgctgatttacttttaagaattgtagtttctggcaacagaggaaagatcctcaagaatcggcaaagtgagtttaccccttggccagtgctcatgtgtagggtagcaagaatttcaaggttcagggtttcaagtgaatttttctctgcccataaaagatggaatgcattttcagctgtttcttgggtaccagctggggtttgagtttcaatttcatggagggcagctggattaactgttgcgttgaggtagagatggttgcttgatgggattaaatgtctcattcacgcttaatattccagtgagcttgggcgtgagttattagccccattttacaggccaggaagtgagatttggagcctggagtgaccccaggttatccagggtgaaataaaagcaggactgaataccttcctgccagagactggactgttcagcataatgtaataaacaacatccgttgagataataaattgtgtggcattgtttcacagagacagataagaaagctttttcacattcattacctcatttaatccactgatgatcaaggcaggtagtgatatagtcccagttttatagaagaggaaactcagcatcagagaggtttagtgacttgcttttctgcttgtttttctgccaacagtggatgactcattttttcagttctttccctgttacacctagttattattcaaagcaaagatgatattgccctcttcttctcttgatgctccttcccatttgtcatgattcttccagaccagggttctagaccagtgtcagcgtagacactattgacatttgggttgcatatctctttgttgtggacctgtcatgtgcttggaaaaatgtgtagcagcatccctgtccttgacccagtagatgcaggtagcacctcctctccagttgtgacaacccaaaatgtctctaggatgtttccaaaaatgtccattggcaggcacaatcaccacttggtgagttctgtcccacacaactttctgcgatgataggaatcctctgtatctgtgctgtccaacatggtagccatgaaccacgtggctcatacaactgagacgctaaatttttgatttaatttagttagaattcatctaaatttaacaagccacctgtggctagtggctactgtattagtacagctctaggtagcaacacagtagtggatagaaaattagccctttgaggctgggcgcagtggctcatgcctgtaatcccagcactttgggaggccaaggcaggcggatcacgaggtcaggagatcgagaccatcctggctaacacggtgaaaccccgtctctactaaaaatgcaaaaaaattagccaggcgtggtgatggacacctgtagtcccagctactcgggaggctgaggcaggagaatggcgtgaacccaggaggtggaccttgcagtgagccgagatggcaccactgtactccagcctgggcaacagagtgagactccgcttcaaaaaaagaaagaaagaaaataaaaaaagaaaattagccctttgatggagcactcaatccctaaaatcagtcaggggaacctgttaccaaaagtctaaccagcttcttgcttcatggtggccgggaaacactaggttggaaatggcaaatacttggcacaggttccatccctagccattcctatacccgtgccagacattgctagtcaatcacagcatgctgtcttgttcagcccaggcacagctcagaatgtttctcaatacaacactctgggcagcccccaactacagatcagttggtgctggcaggtgaaagaaacattattggccatcctggcactcagccacgaggcccatctgtgaggtccagcatctcatcagcctgtaggagtggcctgatgactcaccgggtggccaggagtgtgtggccagcctaggtcagtggagcaaccatgatacagagaggggagagccaatgggctggaggagctgagattttttttttctaatttctcatagaaacacccactgcatgatttagcaatggaggctggcagggtggggtgaggctactggctggtcagccactgatatgcaaagcatttgaagattttaatctgcctgggactgaatctgagtcaaccggggacatagctgctgccaaggacatggtaataacgtcagaaatggctcacaggcctacggagcatctagtactcaaaccgctccgtgaagtgggtgagaaaaactgcatccccatttgacagacagaggagttggtgacctgagaggtttgacaacaggcatagtgaggcccactcttagatctaagacttccagggctgctgtggacccatggaaatgcaggaagcctgctgtgtgtaccctcatcaaccctttgcagagtgaaatgtccacttctgcggcagaaggcaggttagagaagtcccaggagactgagcattgttctgaagaaactaggagccatgtcccctgagaaaaggctgaaggtgacagatgagaaaactgggggcggattccatcatttcagttggaaaaggggttaacctcgttgtctgttgttccagagagtggaactgaggccactgtgtgactgtcctggggaggtagctctctgagaaggaagaaaaagcatcagactttactcattgggacatgaggaccttagttctgctattgtcgctgtaggacctcgagaaagtcacttcccttccctggtctatggatgccaggatataggagaagtaggttttgtggcttctgagggcctttcggagctctggttccaaggaagaaacacaattagagcagactccaaatgtcctatgtattagtgacctccctgtcaatggacatgaccaagagggaactcattgactgtctatcctggaaattccttgtgaagtgagctgggtctctggggtttctccatgtgtaaaggccccaggttctgatgctgaggggcatttctggcagccttcacacctgctgctccctgcccgccattcttcttcatctcaccaccccatctgcttttctcttccttcctccctccctcttcaacatttcattttccctccatcaaccttcctgcccttgcttctcactcatccctctccctttctcaccttcatgtgtattgttgtgagcacggtctgaatccctggctatagctggctgtgagccacccttgccctgattagggagaggatctgtgtgctgggcaaagtcccttttcattattgcctggctctttggccatcaaactccaggcttgggtgaagtaggctggactttgtatggaatcatgagtctcttttgtccatttagcctgtggatggcaatagatagcacttatgccccattccctctttccacgcccagggcagacattaataaacaatcagagcacccttcttccactcagcccagataaaagctcacagtccttcccatgtaacccacgaggcagccactatccgtctatcaggattgatatgtgaattaaaacctacttccctactgactgtatcagtcaagggcccactagaaaacagcaccctcaactggtatcctggagagcctttttaatgaaagaactctcccaagaaatgtgtgcagggttaggggaaccaacaaagcatgttgaagccctcagagataagcagtggtgggaataccttactagccttggggctgtatgggacaagggagaggaggggtgatttaggaacacagagatagctggagttggtggacagggaccacttgaagggtgttgtggttgtagatggagaaacacagcatttctaaaattagggcctgatacagagagaggtgggtagagtgggaactaaataccttgaccactagttcctctcatatgcaggtcctcccagagccttccattggccaaacgaggggaagccagagagcaagagagcctgggggtagggagcacaatgcctagtggtcagctcctggggcacacagcagtgtggcctgaaggtggcccttggagagggcatgccacgtggatgtcagggcggtcgtcttgttccccattactcaatcctctcctgggacgttcttttccttcttggggtgaggcagctgtaaagtcagggctatagtagggtgcagagggctcactccagtggggccatttgaggagtttaggaaaaaaactgtttaccaaagtaggggcaggatgcaatggtagcattaaggttaacagtcagcaaatgacagcccacggccagatccaactctctgcctggttttaaaaataaagtcaaattgaaacagccatgcccattcatttacgtactaagtatggctgcttgtgagccgcaagggtggagctgagtcattgtaacagagaacctacaggcctcaaagctcagaagatttcctatctggcgctttacagaaaatatttgctgccgcctcctttaagggatgctgcagcactttgaggatagcaacagtgaagctgttacttttctgggcctgaactgtcagaggagggagctgctgccgcaacaggagaggggagagagtggagagaacagcctgaaggcgcctttgggagagggaggaaggcaaccatggtcatccaggagggagagtgagtgaagacacagatgccctctgatctcctactagtggatgattcccattagcttaacccacctggaagatggaaagtgagggagtccattggaagagtccacagggtcagcagccagacatagagcaaagtagaagagatggagggggaatctgaagatggtgtcttcagttctccagcatcctttttttccctcgctgtctggcctccgatatgaccatcacagaaaccaggtgtcaggcagtcagatcattcctgctgagcatctaagctccatgctggtgttctcactggccaacccctctgcctgcctccaggaaccttgtggaacagctgaggaattacatgcttacactcaccaaccagactatgggcaagacagaattctaaatgaagatccaattaataaagaaccaaatagtgacctaagccttgtggccagtggaggggagggcaggtgacagcgggtgtttgggtggaggctgcaggaggctgtcatagaatcctgcagggtgacattggctggcaccctcaggcatggtgtcatggaggaaggtgtccccacaggcacgtgaaggatggcggagtcagagccaggaaggggaaggaaacagcttttattgagaagctgctgtgtgccaggcacacgtggcagtccatgctgggaggccagtgtgctaaagtggctgtgagctcagcctctaaagtcagaccatctggtccacgaatcagccccaccacctcctggctgggtgcaagacacatcccctccctctgcctgagtgtcctgagataagagttactcagagaatccacctcttcggatggaaagagtaaatgatgtgatctacttaagtcctcagtattgagtaatgcagaaatcctagtggtaccattatccatagccctgattttgtcgtgtcccctcctgctagggaggaaggacagaaatctcagagtggaacagaaaaaatacagggatttaggcacttaggttatctttacctcctcctgtgtgaccttgatccaatttgttaacctttctgatcccaactaccacacgccctgtgctgtgactaacaccaaacagatgctaagtaaataccagtgccccctgcacactctgccctacccctgaatgtacctacttgagccagcttcctaggcttccacagcttgccaccacgacatagggcacgtctgaggcttggcctggcacccacagattggtcctctcttatcatcactgatgtggagctttgatgggaagctgagcatgtgtgggaggagtcaggcacaccttggggtaagtctcaccttggctttcttgctgggggacctcagacaagtgtctcgacctctctgagtctgtctgttctgtgggagtgatgccaaccatgtggtcctattgtgggaatgaaatgtgatcatggattttaatataatgaaattccaggtccagtaggaatataagggtcatgggggagtttaggagtaaggatctatatcggtgcttggcacacggttggttctccctaaatgttctgtgaattgtcttgtgctgggtgctgggctggggtcttcagtccggttttaaccgtggagtaaagggaaagtgaaaatctgattgagagaggttaccagggatccagcacatgcttgttatgtgggtgtcctctcactgcacggctaggaaaactgaggctcagagagctccctggggtgtcaaaggatgtgaactcaggccatgataaacatgctttcccattatgtgtggatgcagacagcacagggggacatcagaaatctctgcccacagacttgctgctctgtcccttctcaggctcatttctaactgttcattcattcacctacttattcatttgacaaatatttaacttttattttaattaatttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcacaaagtgctgggattacaggcgtgagccaccgcgcccggcctttaattaattttttaagagacagagtctattactgccacttggactggagagcagtggcgtgatcacagctcactgtagccttgaactcctgggctcaagtgatccttctgcctcagcctcctgcatagctgcaagccacagctatgcagctgccactacacctggctaattaaaaaaaaatttttttagacatggggttgagaggtgacaacatgctagcagcccttgctcgctctcggtgcctcctccgcctcggcgtccactctggccatgcttgaggagcccctctctaggctggccgaggccggagccggctccctctgcttgccgggaggtgtggagggagggacgcaggcgggaaccggggccagtgcgagttccgggtggtcggaggctccgtactcggagcggccggctcgcgccgctagccccggacagtgaggcgcttagcacccaggccagcagctgcggagggtgcgctgggtcccccagcactgctggcccgcccgcgctgcgctcgaattctcaccgtgcctcagccgcctccccgcggggcagggctcaggacctgcagcctgccatacccgagccccccaccactggttaggatcgcgcgcggccagagcctccacggcaccgcgtcccatggactgcccaagcgctgatcagtgcgggaagctcagcccgtggccccagcgcaagatccacaaggcgaccccagctggcctcccggtcggcaggggcgggtgtggggggggcgggggttgctggattggagaactttcatgtctagctaaaggactgtaaacgcaccaatcagcagtctggcactctgtgtctagctaaggatttgtaaacgcaccaatcagcaccctgtcaaaacagaccagtcagctctctgtaaaacggaccagtcagctctttgtaaaacggaccaatcagctctctgtaaaatggtccaatcggcaggatgtgggtggggtcagataagggaatgaaagcaggctgccagcaccagcactggtaacccgcccgggtctccttccgcgttgtggggtggttgtgttttcgctctttgcaataattcttgctgctggtcgattgttgggtctacgctgcgtgtgtgagctgtaacactcaccgcaaaagtctgtagcttcactcctgcagcaggcgagaccacgaacccatcaggaggaacgaccaactccagacgcggtgcctttaagagctgtaacattcaccgcgaaggcctgcagctttactcctgaagtcagtgagaccgcgaacccatgagaaggaagaaactccagacccgtccgaaagtcagaaggaacaaactctggatataccgtctttaagaactgttaacactcactgcgagggtccacggctttattcttgaagttagcgagaccaagaacccgccaattccagacacagggtctttatgttgcccaggctcttttggaactattggcttttaagtgatgctcctgtcttggcttctggaagtgctggtgtttcaggtgtgatctgctgtgcctgaactaacaaatgttgattgaaagctaagtatgtgctaggcactaaggactacagtaagtgaagagaacgcgttgagaattctggccttcataggggctgctctggaggaggagtagggtgggattgggagttaagctgcaatttaaatagggagtgagcacaggcacattgagaagactttaggtgacgatgtgagccatgcagcaggaaaagcatttgaggcagagagaacagcatgtgcaaagttcttgaggtgagaatgtgcttggaagggcgtatcctggaggtcagtgtaattgacagggaggatagaaagggagggtcgctaggacaggtggttatggcgggggcgctacaaagacttgggaatgtattctatgagacaggtgctatgttacaactggacattgtggggtagtgggggaaagccttgagggtcccatggaaccactactcagatccagtatgtgtacgcggaaaacagtttcaagtcatctcctggctttggggttgcgttttctctccccagcctctctcccctttaaggggagactcgcgattttataccgtgaattccaaatgtctatggccacctcatgggcttaaaacagcagctgacgaggcaggtgtatgttttgggcccggaccggagtatggcgataagaacacttgcttaaattaagtcttgacaaaacctccccggcgggattggctcctggccctgggtcagtggagctggcgcaggacctctgagggggcaggacatgaggggtgaggccccacatggggttccctcgcattgtccctttctgctaaggccctctgggaaggctggcagcctcagggctaaggacagcccctacgacagccaggattccccctggagcccgaagctgagggtgattcttgggaagcggctgctgacgtggccaggcctgggctggagaggaaggcgggtagtggcggccaaggcagccacctgacgtcaggcctatttataattcgggctttgctccttaggcatggagtctgtgagtcactcgggggcctcgccagtgtctcccaaggggacgacgggaggggagggtgtctttccttctcttctttcccccatcccctctccccttttgtccaccctcccagcttcttgtgtctttttaaattaaattttattttattttttttttgagacagagtttcactcttgttacccaggctggagtgcaatggctcgatctcggctcaccgcaacctccgcctcccaggttcaagcgattctcctgcctcagcctctccagtagctgagattacaggcatgcgctggcacgcccatctaattttgtatttttagtagagacgagctttctccatgttggtcagtctggtcttgaactcctgacctcaggtgatccgcctgcctcggcctcccaaagtgttggagttacaggcgtgagccaccgcgcccagccactttcctgtgcctttgtaagctggagatctgatacaatttgaatgtctgttccctccaaatctcatgttgacgtgtcatccgcagtgttggaggtgggacctagtgggaggtgtttgggtcatgggggcagatgcctcctgaatgtcttggtgcccaccctgggttaatcagcgagttcttgctctatttgttcacgggacagctgcttgttcaaaaccagtctggtacttccctcctccctctctctgtctctcgctccctctctcatcacgtgatgccagctccccttctcctgcggttattggaagctccctgaggcctcagcagatgcaggtgcaggtgcagtgcttcttgtacagcctgcagagctgtgagccagttgaacttttttctttctttcttttttttttctttccccccacccccgttgcccaggctggagtgcagtggcacgatgtcagctcactgcaagctctgcctcctgggttcacgccatacttttgcctcagcctccccagtagctgggactacaggggcctgccaccacgcctagctaattttttgtatttttagtagagatggggtttcaccgtgttagccaggatggtcttgatctgacctcgtgatccgcctgcctcagcctcccaaagtgctgggattacaggcatgaggcactgtgcctggccaaacttttttctttataacttactcagccctagatattcctttatagcaacacaaagcagactaatgcaaaagcccacactgtgggaaactttttcttaaggtaaagacttcgctgttggcacttggacgtgtatttgtggcctcccattgggcatgtgacctcattagagccgaaatgctccttggatttttggatcctgggatttcactcctgcagggctgcgtaggcatgctgaggtctcagctagtgacatgctgataggcgtggaatggccagctcccagaataaaagacctgatttgtagcatttgccaatttccgtggtgtaaacactcccatggctgccgttaagttatgaattaggctttgctgaatgcagacttggaaagagatgttcacaatggactctcagaagatgaatagtgggggcttcagcacagcagcagggaccagccaactcttgggctcaccagcttccaggatgtgaaactgcctaagcagccttcatcttttcatctcaaaaatgtaccatttctctgttttgggaacattccatgtccttctatttgaaactatatattgttggctggatgcagtggctcacgcctgtaatcccagcactttgggaggccgaggcaggtggatcactttaggccaggagtttgagaccagcctggtcaatatggcaaaaccccgtctctactgaaaatacaaaaattagccaggcatggtggcatgtgcctgtaatcccagctactcaggaggctgagacaggagaatcacttgaacccaggagatggaggttgcagtgagccgagatcgtgccactgctctccgacttgggcaacagagcaggactgtctcaaaagaaaagaaaatatataatattattgttaactatagtcatatagtgctatagaacactagtacttacaaaagctttacatacgcctcttatatggcatactattctactctaggtatcaggcagggaatgaaaatgcatgtccattcaatacttttgcataaaaattcatagcagttttatttataatagccaccttctagttaagtcactgaagggcagctacttccaggcttacaaggccttgaagtcctggtcaggccaggtgcagtggctcacgcctgttatcccagcactttgggagccgagggtcggatcacaaggtcaggagttcgagactagcctggccaacatgacgaaaccccatctctacaaaaaattagcgggcgtggtggcacgtgcctgtagtcccagctactcaggaggctgaggcaggagaattgcttgaactcaggaggtggaggttgcagtgagccgagaccgtgccattatactccagcctgggcaacagagcaagactgcatatcaaaaaaaaaaaagccaacaaaaaaataaaactgctggtcagtggttactctggcagctgggatggagggtgggtgtctctcaggaggggtcagtgaagcacattgctcagagggcccggccaaccagagctagaagtgagaaaagccaaaggcagaagagacaccttcctccactcaagaccgcttctactaagaccttggtatatttcctcccacttgattttctacaggaagtgttttgttcattttggacagctctggtgtgtgcaacattgtactcaatcttactttacaagctgagacaagcacctttcaatgattctgcaaatgtttcccaaacaactctcacacactgcaggggtggggatgtggaaaaagatatagtcactttggaaaacagttggaaagtttctttgttgttttgtttgttcgtttgtttgtttttgagaccaagtctcactccattgcctaggctggagtgcagtggcaccatcttggcttactgcaacctccgcctcccggattcaagcaattctcccacatcagcatcccgaatagctgggattacaggtgcctgccaccacaccaggctaatatttgtatttttagtagagacagggtttccccatgttggccagcctggtctcgaactcctgacctcgggatccacgcacctcggcctcccaaaaggttgggattacagatgtgagccaccacaactggcaggaaagttttttttttttttttgaattaaacataaaattattatactacccagcagtttcactcagaagaacctatgtgactttgtagcgacattattcgtagtgcccctaaagtggaaacagtctagctgctcatcacctgttgcatggattaagaagaaaaaaaaaaagcaaaaacatgtctatccatgcaacaggaatgcaattgagcaacaaagtaatgaggggccgacgcacacaggagcgtggatgaatgtcaaaaacatgcaaagtgaaagcggccaggggtaaatgaccaaatactttatgattccgttatagcgaatgtccaaaaagggcaaatttatagggatagagagtagatttgtggttgcctggggctgagagagggaacaactagtgacagtaaatgggcatgaaaagaagagtttttttgggggtgatgagaattttttttttttttggagacagagtctcactctgttgcccagactggagtgcagtggcatgatttctgctcactgcaaactcctcctcccaggttcacaccattctgcctcagcctcctgagtagctgggactataggcacccgccaccatgcccggctaattttttgtatttttagtagagacggagtttcaccttgttagccaggatggtctcgatatcctgactttgtgatctgcctgccttggcctcccaaagtactgggattacaggcgtgagccaccgcgcctggctggggtgatgagaatttctaaagttagattgtggtgacaattgcacagctctgtaaatttattaaaaatcaagttgaaacttagctgaatgttatgacatacaaataataccccaatataactttaaaaacaaatacccaaaggattataaatcatactactataaagacatatacacatgtatgtttattgtggcactattcacaatagcaaagacttggaacgaaccccaatgtccatcagtgatagactagataaagaaaatgtggcacatgtaatactatgcagccgtaagagagaatgagttcatgtcctttgcagggacatggatgaagctggaaaccatcattctcagtaaactaacacagaaacaaaaccaaacactgcacgttctcactcaaataggagttgaacaatgagaacacatggacacagggaggggaacatcacacactggggcctgtcgaggggtgggggactaggggagggagagcattaggagaaatacctaatgtagatgatgggttgatgggtgcagcaaaccaccatggcacgtgtatacctatgtaacaaacctgcatgttctacacatatatcccagaacttaaagtataataaaaataaagttacaactttggctgggaagtaacaggtgtaaataaacaaggaaatatagtaattgtatggagatatggcaagtaaaaacaatgcttgctaaacactctttttttgatggtttcatactgttactgcgaattggaggtactctaatttatttgacattctctagttatcggacttcatgtctgctctttcaatgctacagtcaacatggtgatgaaattttctggtttaggattacttcctcaaacttgtttcccagaaaagggctttctgggtcaaaagttatcaaaattttctaaggctctcaatatgatgacaaatgatttctccaagcgtgggacagattgagagctacagtttcctgcccttacctcatcttccaactatggaaccaagtattcccttcacaaagaaaacccatgattcatggtgttagaagtcagaatagtggtttcctggctgggcgtggtggctcatgcctgtaattccagcactttgggaggctgaagcaggcggatcatgaggtcaggagttcgagtccagcctggccaatatgatgaaaacccttctctacccaaaatataaaaaattagccgggtgtggtggcatacacctgtaatcccagctactcgggtggctgaggcagaattgctggaactggggaggtggaggttgcagtgagctgagattacactactgcattccagcctgggcatcagagcaagactccatctcaaaaaaaaaaaaaaaaaaaaaaacacaaaaacaaataatagtggtttcccttcaggaaatattgaccagaagggagcatgagggaagttctaggtctctgtttactttttgatcaagctacaaggcttttcctaagcaccagaaggttccctcatgcttcttcccaaccaaaagcgaatggctcctctgacttcctttaccatagattagatttgcctgttcttgaacttcttataaataaaattataacttttaaatcttgatcagggtgctagttatattggtgtgttctttctgtaagagccactgagctgtaccttatgatatatttttctggttgtataaacgtgtggggccaagaggaagaatatttcagggcactgttcactccgcggcctgcagggtcctgcctgaccatcctccttgcagaggtagctgacagtgtctgtacctgactgtgcccattcccccatgtggtcttggtttatggcgttggtgggggtgggagtagggctgtgcccatgagctaacctgtctctctcttctctccccactgtgtccctgtgtgtcagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaaggaaagtgacactcatggctggggctgcagccatctgcagggactgactcgaccctcgggagacaagtccgacctttcccaccttgagtggggagtctgacatccagccctcctagtagcatgtgcaatcccaccttcaaccttctcccagccagctcggttagccttggcctttccaacccagctggacactgatggccatacccttgacgcccccccgagggctgcctggttgtttcctgttccacaggtggtggtggtggtggtggggggtggtagaccagctgtcccagctggatcctcatggcagctctgatgagcactggagtttgggtgggaggaggggcacatgggggacagaggcagggctgtcagctgccaggtttatgccacaggggtgggtttctgtggtccctgccttcgggcaccatagagaaccggaaacgggctctcctccccagatattcctttctcccctttagtatttttcatgatacgctacgaagggctgcctctttctaagatgcctgttacttcctgcaccctcactccaccttgtgcatgtgatttgatgagttggaggtgggagggtgagaaacttctttctggctgcctcctgcctgcccctgcccctgcccctcccagcctgatctgggggtagcagctaaaatggcattggaagctgcagagggtgccttaagactgtctcttggccaggcgtggtggctcacgcctgtaatcccagtactttgggaggccgaagcaggtgaatcatgaggtcaggagttcgagaccagtctggccaacatagtgaaaccacgtctctactaaaaatacaaaaaattaactgggtgtggtggtgtgtgcctgtcatcccagctactcaggaggctgaggcaggagacagaggttgcagtgagccaagatcgcgccattgcactccagcccgagcgacagtgcgagactccgtctcaaaaaagaaaaaaaaaaaaaagactgtctctcacttatgaagtgtctttcagtcccacatcaggaaggaaagaagggaaatgatgttgatgtgggccctgcagtgctgcccctgcttctctgtccctgggcagaggtctgcattcaccagctttatcccatggccttgtctcctggcctttgctatctcctttgaattcctcccttatcagttgggctacacacagcaagtctttaccatacatgcacagaggttcttgataaggaggctattttagaccagtatggagctcttccgtataaagcactggtgacttttttttcttctcatgggctgtcactgatgcaggctaaagacacacttcagtcggccacagccggtctcatgcctcagcctccaagtcgctgtagccaacagcggggtctcagctgcaccacaagtccagccagtgctggcctaggccgtatttctggggggtaaaatatcagggtccaacctgcctgttctaggacccagtgttagagagctcctggctgaccaagtcctggtttaaggactgtcaggaagccacagcactgtgtcagttgaatgggttggagccacaaggtcaggtccttatataagtcatggctgtaagcccttccctatcttaccatgttcctggtgcatagtaagtgattaattggttcatctattatattaactataagctgagggggaccaggagagcgtggatgattccctgtgatccatccccttctggaaactgggaaacctcctttcagagcaggtccttctagaaatgggcatgtcccatggcaaggaagggaaccagcagccttgaccatacaagtgactgttcatatcacaaggagagtggatccaggcagaaatcacattgacccgcataattcctggctgcccctgtgttccattttcatgcgctgtctcagggacccccctgagtcgtgctgggcctcacctgcttggctgtggcttctcatacatgggcttggtcatgtatgtctcctccgccccctcccaggctccatcacaaactttgaagggcagcttgctcctgctggttgactcactgagctctctctttccttgcttctgcaaaacagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagaggtaagtggttcctaagaaggaggaccgtatgcgtttccatacccatcattctgtcttgtgagcttcctctgagtcatttgtcatcctgcctttgctcctgctgtcctggttttgaggaatgtcctttattcaacttgatctattgagctcttatgtacccttcaaaacccagctcaaacagcacatctctggaaagttcttccattgcctgccttcctctgaatcctgctgcaccttctatgcctgtcttaactgtggttggttggcatagtacttatttgattatatgacttatttgactagaaattccttaagagcaacaatgatttctctcattcaattctgtatcttaagcagccctcatagtacttggtcagtagtgagtgcttaacagtttgtttagtgaatgaataaatgatattcattgatgcatggttggtggggattacttgaacactatttttatagaaaaggaaacctagatactggctaagatgtatagttggttcactttaagcagaaagctattgagttggtactaactggtgtagttgcattgattgttaaaatattgaatccttcataccaggtggtaaatggttgtaacccttggccccccaagtgccctcagctgccatgtttacccaggtccctctcctgagtcccttggaatggctacaatccaataattacagggttaatgcttggcacaggtaggaacctcagtaccttcctccagctggtgtccgtcctgattggttgatgtccactaaaaatccttagctattctgaatagcgctgctgcattgaagcaatagttgaatgcaatgtggcccttacactttaaggatttgtaaacttgtcgctggtggtggccagtgctatttctctcttgtcctctttagccatggaacctgggcaggatgacaaggtggaccatgagggaggcaggcttggaatgcaatgcatcttgggagtatccctgtgttaggtagaaagggcatctctttgtgtctccagcgcccccttcagacaaggtgaatgctgcaatgcttgggctgagaggtctggtggcctcagggcctggtgctggcttgagcccagtgacccatcctgactcttccttcccctccccttcagctttggtttgcccggctagtcccacatgtgcctgcacctgtctgatgaacgactttgatgcattagagaggtcttccagcaactgaacagtagcagctgctgaaatacctcggccaagtctttgttggggaggttgacagggaggacaggctctgttcccactcttgcctgacctaaggcataagtgggggccaaagttgaccccggcaggctgttgttaggttatgatgaaatgttactgtgtgctgtttatctccagacaatgctgctttgctgctcatgggctcatttaataccccgtgcagcaatgcaggtggatgggattctacccatttatcacaggtggagactgaggccaaaagaggtcaagtgattttcccaaggtcatcagaccagatagaggcagagcgagggggagagcctgtgtgttctctgctctcacaagatgcctggaaaaggaccagtctggtgagtgaggtggccggggtggtgccacagagacctgggggaaagggttccatgagattgacaccagcagcgctggtgtcactgtgagcaagtaaagaggcagagttaagccatggatggggacaaactgtcactgctgtgcctggatggagactcagagccaagatgcaggatggctctgagcctcagcccacagcaggtggctggaccatgggccaagatattcctggggctggagcaagggagcctcaggacatgtttccacaaggcagcaagctctggctggttcctgccaatttaattttcttgtcccaatcaataaataactccgtactctcttgccttgtcccagcacaactgtttcatttgatcctcatctaatccttgcaagaagccattagaatccatcccattttgcaggaatggaaaacaaggcttggggaagtgacctggttctcctagggctacccagtcagtgaggaacagggagaggctggaataacactggagtggaaagtaacccgtattgaatgtcaaggagacctagattctagctctggccctgccgctttttgtggtcctggctaaaccccttcccctttcttggcctcagtttactcatctgtaaaaatgtgctattagtttctattggccccagttattctagaggtgctgtttccctctatatgctaaaaagggtggcagggtggggggaccaaaggctttgatgactttgaaggtccaaaggaagagaatccatgggcatatgagggtggggtgggaggaggctggcactggttatcttgtttggcccaccccatgttactgtctcctctgtggtggttggttaaaaataaggcactgacttacttttcaatatggtgtagacagtggtgagatttgccaagtgcagtcaatcccccttccaaggctatgtcctgccttcccccagaaggtcaggagaagctactcggccttgggccccagagccatgatgctgagcaccagctgaacctcgtaatcacccgggcagtcacaacccaggcagactcaatcagagtctctgggaataaggccaaggagttaaggtttttaaaagtgccccaggagattccagagagccctagagagaaaaggaagggcatctaatatgccgcagttcaaggcactggctttggagtcagagagaactggctttacatttcacctttgtagctgggtcaccttacatctttacatctagttctttgcttgtagaatggggagaagttcagaatctactccagttgttccttcggaggattaaataggagattgcatgatggtgatatagggctcattgcaaggaagatataaatgatagatactattattattgtgattattacaaagatgaaaacagagactttgctgtggcattggtcacctaaaacaggagagagacacaaaagccagaatggaacgcagaaggtggccacgctgtgactggtgtactagcatagtgctctggaactttgtgcaagcttggaacaatttctgattgaggtcttcaggcaaagatttgtagagaggagatagaagagatatttgagctgggtatagaagatgagtagaccatggacaagtgaagaggggaaagggcacgccaggcagcaagctcagcatgggcaacagcctggaagcagggactggtcaggtaggagaaggtgaccagtacagttcatgcatgggaacaagtagggacaatatggtcagattggaggctggggttccttgttgaggaatttgaaagaccaatggtggtgccaaatgattttcctttaggctgtgggcagctacccaaatcttttgatctggtataaaatggctggcagcaaattgaagggacagcagttcacgggctgtggcaatggcccaagtgagggatagcggacatgagtttggaaaaagagacatagatgtgaagcttggcagggtggaatcaacatgcccctgggactggtttgaatgcaagaggagggggagaatcccagattcccaggcatgggtgtctgtgaggctgtgctggcattgtccaagatggaagaacccaggctagggctggtggtgaagcgagacattagggtagaacttgcttatgaggttgaggtctttttctgcagagatggaggcacagctggacctgtgagctcttcaggccatagccaggctggtttgaggatgaagctctgcacaaggctaaaatcacaaggcagtaacaaggcctgggaagggagcaggcagtggaaaccccttgggtgttatgcagtcacaaatgtctgggtcaggcaagagtgggggaccccaggggcagaaaccagggccctcagctggtatgggaagtgtgatatggggatcagggcagtggaagtagcagcagctcggtttattcttctctctctgatctccaaagtgcatttctacatctcatcctataaaagatctggatggtcaggtggtatctgcctgtactggggaaacccgaagcccagagagaagagatggtagcccagatagacatagaaggaagcctagctggagagtgttagagccaaggtgagaacaggtcctctagtgacaggccctgagtcctttcctggatcccctactcgcctaggaaaaatccaggcagaaataacaacagtagtagcagcagctactgttgttgaggacacactatgcgctgggctcagtttctacatattgtcacacattctcacacctaccctgcaaggtaggcttttatcattctcattttattgattaaaaaacagactcagagaggagaagtcatttagctaaggtcacacagctatagagtgtcagagtcaggagttgaacttggttctgttgggctccaaagtccactccttccactccatcactcaactttgaggggctaggccaaggtcaagggtgctaggcttggccatgcctgttggatttggaggtgctcgagcatctgtggaaggatgaatggagaagtgaacaatgaaatgaatgaacgaacacgagtgaatgacaaagctgtcaggtcagcaagcagctatgtaggcatggttgtgttctttctcccagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggtgagggggctgcggccctgggagcgggaagcggcagacaggcctctccagagatgcagggatgggaaagatctgccccagggatggacaaggggtggacggggggtgggcagggaattggagaggggtggctggaactgcaaggcacccagaggaggggacgagcacttcctccatgagcagaagtcttgaagtttccattgcacctgccctggggtgggaattccccacagagtgagggaaggtccccaaagtgtgaggtgtctcctcacggctgacatggtagagcttgcttatgatgtcacacgacagctttcaaacgggatggcataacgagtagattgttaaaaatgcagattcctggggccagccatggagtctctcatttcaaaggccaggagtggggcccaggaatctgcatttatgtagtattttttttttttttgagacggagtcttgctctgtcacccaggctagatggtgcagtggtgtgatctcggctccacctcccgggtccgcaacgggaatctgcatttaaataagcacactccctctcctgttctcccccaggagattctggtttagatggctccagagcacactgtgagaaacccccgtgtaaggtagaagatgggcagcggtgccatttgctggtttaatttacgtgatgttggttctcaggctcctgaggacagatggtatgaggcagagaaagtctggctggctcagaaggatggatttactcttggtaagtaggggtgttagcacctttggagggtctgagtcttctcctgtgccccctactgctgccagccatatgttccaggtcctgattatactttggtggtcaggagggaagaggagcagtggagactgtctttcaaaggcatttgtgtcttgataatgagttatttacctactgtaactcactaatgcaacaagcatgctttcttcctacggcgttcttcgaggaagccagagtctggtacaagtgggccaatagatttgatctcatgagcctacttttgtcgattggttgtggctgatcactgcactctactgagaagtgatgctgagtctcagtctgaacatggctgggaagagtggttgattagtgatgtctgccatgggcactggagggggaaatggcagtctgtgtgtgagataggccagtgtacccaactgtctgggtgcctgctctgtgcctggcactgtgacagctggtaaaagcctaaggtgagtcagacttagcctgaccttaaaggatttggggtcacaactcagctccaagtgaatagaccccaaatggagacctgtcccaagccttctcccaagcttgctggcccggcttagagcctctcttatctcctgccctcgcctctttcccctcttcccctcccatctcctccccgttccccttctctctctgggatgtccaaccagctacggtgctaaagccagatgagggaacagcagacctgccagcaggaagggtgagactttggattgatgctgacaaaaccatcactgaggtggatgaggagcatgtccatcgggtgagtcccctgtcccgccgtcccccagcatgagtcccctgtcccacttcaccccagctccataccctccttccccagtcctgcaagagatttccttgttcctgactaccaataccattttggcttgatgccctggagggagttatagtgaagaaccccactgaactcattgctctactggaggggtactattagggggtcattcaccctttcctgtggtttcccttaatgaggacacatcaaagaacatgtttgtcaggtcttggccctgggagttcttctgatggacccaagaaaatgactgcttttaatttatagatattggatattgcaaatcatactacacagcatgtttctgttttcactctggccgccagggaactcagagccaaatttgctgcttgccattaaccatagcataggttctaatggcctatattttggcatcaaactttctttcagctttgctctttaaattgctttgaatacatttttgttgtgcaccataaatccttttgaggacaagtcccagtgtagtgatagaaaagaaaggttctgtcatgccctttccccccgcccctcacagcctgctatcttaggagttttcctccttgctcatctgcattcctttctgctcctcctctgcccacctcaggctttctctcccgcgttgggcatttacagaggctcagtggccttgcaagaaaggctgatccatgagagggctcaagcttggcccaaacctgagactaccaggttcagaaaactcactgaagctggagagaataataggacgcctcttagaacagatgttttaagaagcagcttcacataacccttgcttctaagggtttgggtggtttcctaggaatcaatgcatgatgggctatgagaccagtgaggtggtttggccattggcctccactcctgggtatcatggagcatattgagagcttcctcgtaagacccagaagaggaggaaatggcagcggatgctcgcacacactggagcatcacctgtctttttgtggtgtttgagatccagaaagtgttttgaattttgtcaagtctgccttgggagcgtctcccctcatggtgcatggagtgcaggaccacagcgaagagggggtgcctcataggttgcacagagggcaaggagaagggatggccctattttatttgtagggcttcattgctttccatccagagtccctgtgctctgttctggtctttggcacatagctctcaagaggagggcttagtgtgtgtttggttgcgggggggtggggtgggggcagggggccagaaggccagaaggccagaggagactctgtgtgatggtttcacaggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgaggtgggaccattgtgggcagggctgaggggctgagggcaggggggcctggggggatccctctgcatctgaggtgacagtagaaccatcagagcccccagtcgacctgtctgcaagcagcatccttctcgcggcattgtggcatcctgtggcatggaccatgagattcccccattccctggagggaaagatcagtcaccattaggacagaaacagcagcattaaatatcacaagagtaacgaaagaaaatactgaatgagtgtgaactctaccagacactgctgtatgcaccttcttgtattaactcagttgagtctcacatatccacctgaaaacacaggtactgtgattagcccattttacagatgagaagagccggctgggccaggcgcaggctaaactctcaggtctagcgagcagagttgctgggagaaaacccaggatacagggctcctgtgtgctcttcatcccatgctgaactctcaggagtcctgagcacccacatcaacggggaaacagaagcttcagttgtactttagtttttttcctcggaagtgtagaaacggccaatttttgttgagatgggcaagagcaaaggaaatctctaagcgccaccttgtggacgcacgaggcacctcagccgagtcattgaagcgtgggccccttcattccttcaacccatagtgattgagctattgattgagggtctcctaccgggccacgcacaaagaacatcagggaaggtgccaggcgagcaaccctccccttgtggagttgctgttctaggaagaaaagacagtccatcaacaataaagataagagtggcccgagcagatgagtggaggaagaggtgggagaggttgggaaaaaccaggacagagccgtgtcagttctcagggtgatgattctggctttcactctgagtgggatggcagctactatgggtatttatttatttatttacttttgagacggagtctctctgtgtcgcccaggctggagtgcagtggcacgatctcggctcactgcaagcgccgcctcccgggttcacgccattctcctgcctcagccccccgagtagctgggactacaggcacccgccaccacgcccagctaattttttgtatttttagtagagatggggtttcaccgtgttagccaggatgggctcgatctcctgagctcgtgatccgcccgcctcggcctcccaaagtgctgggattacaggcatgagccactgcgcctggccgatttgtatctattttttatgaactgggcagcctcctgagccagagtaggcttagagagagtccctactggggtttttagcagagcaatgacatgctgtgacttaggttgtaaaaggatgcctttggctgctgggtggaggacagatgggaagaggctcagtggaggcagggaggcctgtcggaggtgagacatcttacctgtgtgctcttctggagactcactgggaagtcagaagcccctaggacacctggtgtctaggaaagatcatgatacctcttctggtttccatgttctcctctgccaactgggggtgaaaacacatcttgccctttggggccctgtgggacaaatccatccctagtccctgaggcaatgctaaatccattaaaggggatatagtgggcctgtacccctctctccaagatttttctcctccagagtgacccacaccacaccttcagtcactcccaggggctctcccaccaccgctgtccatggtcaagggcctgggaggacctcagaagctctgggtgggccagagcttggcacgtgccctctcccgtccttgtggtgagtgcttaggcttctgttgctgcagcccaaggcctctgagctgtccacattgccgagggactcctccggctccctggaaatccctggaagggacatttttatagacccagatagcaatcaggtcctcattggccatcctggattgaggcatcagaacttaggcaaaagcgccaaaagatgcaggcattggtacgcactctgaaggtagatccccctacttcccttcctaaccctggggtggggtgcggcactggtccgcacccttccctcaagtcttccagcctcccacactcaaacccacagccacctcctgtccttaggccggatcaacctctgattccccaaatggccaccaggtgggagcacaggcctgcggtgaggctgagaccacctcgaggatgggctgggtggggtctggacacaccgggggactctctcactatggggctagccccaccaggcagctggggtctgggtgtgtgcctggggacatggaggtctaggtgaataagagggtgagtttgagcatgggtgcgaccccgtgggtagaggtggatcccatctctgtgtgcagagcccgccgcaactgttgcgtgcatgtgcctacaagcacacttctgtgcatgcgtgcaagggcacatgtacacagatgcaaaggcatgtgtgcatgcatgcatataggagggccttcaggaacctggatgtgcagaattcttccttctccccctaggcagtgggcctgagcaggctgatggacaggactgcccgttcattgaactttagttttcccagactgggggatggctctaggactgagaccccaggaccctctgactgccttaagccctaaggctgtgtccagccagtgtgggggcatatccctcctttgcctgcattaggttcctgctgagccctacatctggcatcaggatagggactcatgactgttcctcaggggcttggagcaggaagagccaacagtggattggagacagccccagccccaagctagacatctaggctgaggggagggccatcacaccagggtttgtgcccctagttcggccaaaggactgcgctagggagggcagatggggccttgccggacccagtggacaccctcagcatcttgggcttcagacatcctcctgcagcagggcccattcctcttttccttttggtgccctcctgctgacctcacagtaacctcctgccctcttccctcgctgccaaatccaatgtcaagtctctggtctcttactgaactcagcagcatttccctccctcttcctggaaacacacccttcctcggctctaagactccgctttcctggttttcattcccgcccactggccgcccagtcagtcttccttgtggtctccctgacctgtccctgtcaggatgctctgttctcacactcttccttggtgatctcatccaggcttgtggctttcaaacgcctcccgttcactgtaattgaattaatttctttcatcgatcatctctgtcttcccaccagaaggcaagctccaccaagcagggacttaaaaaaaaaaaaaatcaggcttacattatagtccaatgcacctttttagtgtacagttctgagcatttttgacaaaggtgtatagttgtataactgctttgacaatcaattacatgacagttcccgtcacccccaaaagttctctgggccccctgtggtcaactcagccccaagttctacccctggtagccactgatctgtttttttgtccctatagttttaccttaaaaaacccatataaatggcattgtatggtatgtaaccttttgaattggcttcttccaggcagcacaatgcattggagattcacccatgtggttttatttatctacagtttgttcctttattttatttcattgatgcactactgtgcttatttgttcatagggtgacctcttgtcctggttttcctgggactaaaacgttttctgggacatgagactttcaatgccaaaaccaggatagcaatttgggaggccgaggctggcggatcacttgaggtcaggagtttgagacaagcctggctaacatggtgaaaccccatttctactaaaaatacaaaaattagccaggcatggtggtgcacgccttaatcccagctactcagaaggctgaggcgggagattcgcttgaacctgggaggtggaggttgcagtgagctgagatcgtgccattgtactccagcctgggcaacaagagcaaaactctgtctcaaaacaaaaaacaaaaacaaaaacaaaaaaacaacaggttgggtgattatcctagttcactagttgaaggacatttgtgttgtttttagtttttggtgattttgaatatatagtcaatataaccaatgacatagaggggttttttgtgaacatacattttgatttctttagggtaaacacctagagaggggttgtggggttgtggagaggggtaatgagtgtgtatctcactgtagaagaaactgccaggctgttttccatagaggctgtatcattcagcattcccattggcattgtatgagaattccagttgctcctcatcttcaccaaaacttggtagtgactgttaaatgtttttttcagccattgtaataggcatttaatggtatctctttgcgattggctggaatttcctttatccattttgtgttatgctgtgcccgagtgcctgctgcatagtagacactcaatggattattttactgaatgaagtatgaatgaatggatgaagcagatacggttttagttatcacctaaatctgttatggcaaatatatagcacacataccactaactcccccatgtgccattccctgtgtccatagcagacatcactaatcgtaatggataattatgctatcgatccagctgcctcgcttcaggcagataccattcgatgctttgagtaaccagtgagatgaatctcatggatgaatgcagctctcattcaagcctctaactaaagaggagaactaggttcagaaaacaggcatgggttgtccaaggactcacagggagccaggggcaggactagacatacaggcttggctcctcctagtcgagtaggaagggagtcagggatctggaggcagatctggaggcagggacacagatctggaccctaggcctggggcggggcgctgtcttagaatgctccctaggcagtggctggatgggatggctgatacctgtgatcttcctgcaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcaggtatggtggtctctaggtgacatggagagttggggtcagcacggggagagttggaaggggatgctgagctgctttcttatattcattcagctagcattcactgagcaccagatatgtgcagaccccatgcttgctactgggcagggctatccctaggtcattgggatgcatttgttgaaattagaataaggtactccttcctcaagacattgacggccgtttgcagaacaatcatcatacatggacattgttagaaccggatacttgactgccatctgctgggaaatcgtcctaatagacgtacacaaatctaggagagtgtgatgtgaatgatgcacccctgggatgtggtgtctttgggcagtgcacaacttgcggaactgaacagaggactcgaagagtgaagcttcaagggcagagtctacactcatgagaagctaatagccagagaggaaattgaactgtacctacgttcaaaacttgaatgttcttcaaaaagtgctggcagggcaggctagggaagaaactcagggagcgcagaggagggctgcaggagggctttttttaggatgtgatatttgatctgggccttaaaaaagagtaccaattaataataacaactacaatattaataaccatcagagtaaatgcttgctgaagcctaatgtaccaggccctattctaaggatactaactttattattattattattattgagacggggtctcactctctcacccaggctggagtgcagtggtgtgatcccagcttactgcagccttgacctccaaggcttaagtgatcctcccacctcagcctcctgagtagctgggactacaggtacacgccaccacccttggctattttatttttattttttgtatttttttgtagagatggggcttcaccatgttgtccaggctggtttagaactcctgggctcaagtgatccacccaccttggccttcaaaagtgctgggattataggtgtgagtcactgtgcccaacctgaacttttttttttttaatctaaaacagccctataaggtaggtattattattttatattttatagattgaaggcattgagattcagagacgttaactagcttgcctgatgtcacacagcaaatactcctagcgctgagattcaaacccaggcctactggctgtagaactctaaccattgtggcagtgttctcagctttttttcattattgcacactctgaaaagccttttaagacatttattccccttaatcatttcccctatgatgaaatgttaataccacagataagctatatattcctttatgtgtatttgtgctttatacataaaaagagtaaaattttttttaccaccacttctaagaatcagtttttgctcttctcaggggcaatatcctccccactgagaatatatgatgcagggaatattgtgtttctaataataataactataataacagttccacttttggaatattttctaagcatgtgacattattaaatcttttggtcctcatgacagccacatgaggactagatttaattagttaattattaatgaattaactagttaattaatttgccccaaatcaggtaaccaggaaagggcagatcctcaatctcttttaactgctgggctatactgcttctccactggggttattccagtgttttgctgaacacctactctacatctggctcatgctaaaagctagagatacagtgggaagaggcacagtctctcacaatgtagttgtgctgtgaatcgcatgtgtctgagggtggaagtcaggtcaggctgtatcgaggtgcttagcacagtgcttgttgcattgtaggtatgcaatgaatagtagtggggagattataggattttgcaagcctgcctctaagctgtgagtgcaggccctagaatgttatcctcacctcttcctaggctccattaggtctgggaagccctagggcagcctctgttacccagattgtgcctagccctggcccttctagattgagtcttgtttcccctacactagagctggtagtacaggttcagcccagcaatcggtgctcagtgaaatgtatgtggtttatagttgggttgggcagggagtgggtggcaggaagctcacaggaagcccaccgggggctgaggccaggatggggactggcccaagcaggggccgtggaaaaggtggacctgtgtgaggtggcagtggcagcacctgggccatcagtgacatgtggccccatgctgcccccaacagtggagaagatccgagccaccttcactgtcctccgggccttcggctctgtgtccatggcccacagccgcagtgccacccggttctccatggtgatgtcgctggacttcaacgctacaggccgcatcacagctgctcagctccaggtgaggcctctcgggggatgtgcaagggggcccttggggctgctgtgtctctaaccccgggactcagcagagcccacgcctccagctgggactctaggatgtgtctgaaatggtcatggcggtggctcaggcctgtaatcccagcactttgggaggctgaggtgggtggatcacctgaggtctggggtttgagaccagcctgaccaacatggtaaaaccccgtctctactaagatgcaaaaattagccaagtgtggtggcaggtgcctgtaatctcagctactcgggaggctgaggcaggagaatcccttgaacccaggaggcggaggttgtagtgagccgagattgtgccactgcactccagcctgggcagcaagagcgaaactccatctcaaaaaaaaaaaaaaaaaaaaaaaaaaaaaaaaaaaagaaagaaagaaaatagtaataataataataaaataatgaaatggtcatggatcccctagctggggccagttgctccccacctcgctaggtgccctggaacgtccccttctggagcaagccagcccgtctgtgcttcagactttcaggcggatgaaatattcatgagcaaatagagaattcaggctgtcattagccgggtcttaaaagcgcaagttgaaattaaacagacgcttgccagccttctgcagcagtccgcgtgtgacgaacacatggcctgtttgttcctatctccaaaatcacccatactcctccccgtctccctcaaacatcctgtttgaacagaaaataggattaggttattagaagggttgtttgtaacatggagctggtataatatccagactcaaggaaaaccccttcatgccaaataagtcccttttctgtcctggccctgaaatcctacccttaatcactatttgggttaaggtattaaaggcttctattaaaaagggaatatgttggaaggtggcctcatttgattgttattacctttgataccttaattgaaatgaatctattgcattagttaatttcctaggtggactctgaattagtgagacaaaggattgagaagttctgacgtggaggttgccagcaaaattaatttggacctgagatgttgtctcgaagagtggatcagaggctgggcgtggtggctcacgcctgtaatcccagcactttgggaggctgagacgggtggatcatgaggtcaggagattgacactatcctggctaatgcggtgaaaccccgtctctactaaaaaaacaaaaaaattagccgggcgtggtggtgggcgcctgtggtcccagctactcgggaggctgaggcaggagaatagcgtgaagctgggaggcggagcttgcagtgagccgagatcacgccaccgcactccagcctgggcaacagagcgagactccgtctcaaaaaaaaaaaaaaaagagtggatcagagtggggcaccccaatggggcttctgggtagctgcacttcaggcatgtgcagatgtacccaaagcactgactgggtgcccctcttctctccctgcagacaatgcttttggagaagagccgcgtggcacggcagccggaaggggaaagtaacttcctggttttctcccagatgctggctggattggacttggatctcaggtgagcacttggggcaggaagagacagctgagggcagtgcgacaaagggcacatgttctttgggggcccagccttagcttctgcccagcactgagaggccgtgggacccagggattaggaacatggcgtccgattccagctgtctgggtacacgcagctcatgggctgggtgactttggtcacatgtcatccaccctgagccgcggtttcttcctttgtaatgtggaaacaacaccttgcatagaccttataggattaagagagataatttacattcagctctttataggtcacatgtcatccaccctgagcctcggtttcttcctttgtaatgtggaaacaacaccttgcatagaccttataggattaagagagataatttacattcagctctttataaatgctgggagtcaaggctgtctgctgtgatagtggcatgtcagtactggccctggcagcggtatgggaagagggagagggacagcagacccccatgtcttccagaagtttctaaacttttgtgggagctttgggtgtatggtagggtatgcctacatgaggttcctcaggatggacctggagctgagtggagcagtgagctgggtagtcaggcaagcctcatcttggagggcctcctggaggaggtggcctaaaaagccatctctgcccttccccaaatctacagggcatccttaggcatgtggctcatgtggcttcctctcccagagccttggtttcctcctctgttggatggatgggcatggtcctagtgaagtgtcggggagaggaaaaagtgggttttcccacatgaggggtgataatttgtggttactgtgctctaacctcaccattgtttgttccccaaccttccctccccatctgaaggacagcctcaacctgtctggagtgtcctggctaaggctggagggacagctgtaacctgcagagagaaggcagagtagagagggaactcccagtttttagagtgattgtaactgagcagcagggaaacttctagaagatcttgagaatctgtagaagaacttggagtggggtggtatagcagagtgacaggtaccacagactcgaggacaaggctgtgtggatttgtatgttggcttctccacttgttggctgtgtgaccttgagctaatgacttcacctctctgagcctgactttccttatctacaaaaatagatgtgactgtatcccagtgttgtggtgaggattaaaatatgatcaggcagacaatacttcttaaaatagtgcccggacatagcaaatgctttgtgtgtgtgtgttcttgtttttggaggatttgatctgccttgatacccctgacaggccctgaccaggccctgaccaggtcatccaaagaaatgactttggattcagagagacatgggtttgatctgggctttgccccacatgggcttctctgagccttggtttctcctcctgtaaaatgggttcctactagtgccaaccccgtaggcatttaaatgagatcgcatgtcaaggcagcaggggccatgtgcggtgcatagtaatggtgtaatgtgggaaggagtaggtaggtgggccctgaacataggaatcccactttcagccccgtggcctcacctcttgggacctccattttctcacctctcagaacatctctcagacacacacatcacccttgttccagccctggagttccacactggggctctctcttctgtaccccatgggtggggcttggctctggggatagaagcattgcctcctggagagggggatttggaggcttaccctggggtgggcccaggaaggatgaggctcaactgtggctagcagaggatgccagacgttcattccaagccaggcctaggccaggggccctccatgctggtggcatccttattgagtttggcatccttaggagctgggccaaagctgcctctgagaggaagaggtggcccagatgagtttcagggaccctaagagagtgagtaaagtgcttggagcaactcagccccctcagggagtcattgtcattctgaagcctcattggtgatcccccaattacttccctttctctacctctgctgctgccaacttggtccgtcacccatatggaagcttccaaaggtcaaaaacgggttctcacttgcacaaatgtcctttctcccatgcactcatgtgggaaactcctattcatccttcaaaaccctactccagatcccttttttagaggagcactgcctgattcttgctcctcagtttctcctttatactgttttggtgcctggtatgtgcttctggttcaaaaacctgccagcgcagtctcccttcctcaccagatggactgggagatctttgaattggggccctgtcattgttctttctgctttcccagtacctagcccagggcttggcaccaggtagatgcttcttaattatttgtcagatttaatttccagtgaatggaagagagtgtgaggaaaacagagcacttactccatgccagcctggcagtgtgagtttatgtataatatctcatttaatcctgggaggcaagtagagtagggggcccattttacagataagaaaaagtgagttgcagagaagagaattaccttgtctgccacatggcagcactggggttggacttgaagcctagctggtaagactccttcaaagtcacgaggcagagaggggtgtggggtctgtagagaatccagggagaggacactgaaggcctcagaaccagacaagctggctggagactgatgagtaatccccactttccaggaaccaatttgaaccaacgtgggattggggatcctaggctgggctctacaatgcttttgtgagtagagagtgtgattcgaaggggcagggggcatagctgtgcccaccccgcctttggcttgcattcctcaagcctgcaaaagtgggtggcccatctgctggtctcactctcgaggaacctgcaggttgaacacgggaaggagccttaaacattgtgttgcttcataaagtgcagactgaggccgggagaggtgcacgtggcaggatagcgcggagtctgggctcgaggggccaacagacctcagctcagcttctggttgcatgcttgctagctgtgaagtcttggggcaggtacccactctcagtgcctctgttttgtcaactgtaaaatggaaataatatttgtacccatggagtggggctgtcatgagtcatcttaggacttagcatgcagtaagggctcgttcatgttgactgttttaatattatccttgagtgaggtcgctcagctgattagaagatctggggttagtccctgctctcctgattttcctctacaaccctttctcctgggatttcctggcctttaggaagggccaagtgagggctgtgcgtgaggaatatttgggagattgaagatatcccagggcagagttagtggggccaaggccagggacagggacagcccctggggtgtccgggcagttgtgtggagcctcacactgtgacgaccacctgccctgccagggctggtgtggacagcccccctgactcctggttccttctgtgcttccaggacggagctgaacctgcaccagatggcagatagcagctcctttggcatgggcgtgtggtccaaggtaaggaggaggtccctcacgggtgggatgtgagtctgtgtctggggctagatgggagggtgatgagtcgccgtgcaacttgtctcttttggtactggggttcatagttggcaagggttggtcatgtggaagagttggcactgcctttgtagggtctcggcttattgggtaaagaagactcagacaaataaaggaaaccagacatagtatacgtagaggtaggattagggccctggaatcagtctagttcaagccccagctctgacacttgttacgtaggtgaacctcaggcatggaccttaacctcctggtaggtctgtctcttcttcagtacagtaatgatagtagcagtatctgcctcatagggttgttgtgagggtgaaatgacatgatgtgtataacgtgcttagaacagggcttggcctaaatcaatcaatagggtgctctttgtcagtactagtggtggttaacttgggtaggggcactcagcgatggtttcctgatgaatatagtctatgagtggggctgagagttaggtatttcattgcttaaaaaagcaaatggttcactggtttgatattttattattcaattattttaaccattgttttctcccttctctcgcaaataccttcatcaccacctatgctgggcctgtgttgtgttaggtgtatgttcctgctgagtgctaggagtatgatcctcatccatggattttcactttagcaggagacacagacttggaaattaatgcaatcatgtgagataagaatatgtcagaggttgcatgaaatgctgcgggcaccacaagatagctgatagagctacttggactttgccagggaagacttcttagccaagggaacatttggcctgggttttgaaggatgaataggagttcaccagatggagggaagtagataatttccactccaaagcctcttttcaaatatacatgtctgggaaacaaatagtgctggaataattggatatcctggtgcaaaaaaaaaaaaaatccatatttcacatgatatactaaaattaacaaaaaatgagtcacagatctaattgcaaaacttcaaaccacaaaatttctagaagaaaggtgagaaaaatctctgtaaccctgagctgggcaaagatttcttaaatgagacatcaaaatcccagtccataagagaacaaattaactttatcaaaaggaacagcatctgctctcttaaagtcactattagtatgaagaagcaagccaccgactgggagaaaatatttgcaaatcacttatctgataaaggatttttatctagaatataaaagtaattctcaaaactcaacccaacaaaaaagatgggcaaaatatggaacatacaaaaaaaatgtaaatggatggcaactaagcacatgaaaatatgctcaacatcattggtcattaaagaaattcagccagtgcggtggctcacgcctgtaatcccagcactttgggaggccgaggtgggcagatcacctgaggtgaggagtttgagaccagcctggccaacatggtgaaaccccatctctactaaaaatactaaaaattagctgagcgtggtggcacatgcctgtagttccagctgcttgggaggctgagtcaggagaattgcttgaatccaggaggtggaggttgcaatgagcagagattgtgccactgcactccagcgtgggagacagagcgagactctgtctcagaaaaaaaaagaaaaaagaaaaaaaaattgctaagcctgtgtgcgtgcaggcgcgcgcacacacacacacacacacacacacacacacacacacagtctgtcttacacagtgctgagtattatctgcagagtttctaattcagtagctctgggtgaggcctgagaatgtgcctttctcacaagttcacagcaatgctgatgctgctggtccagggaccccgctttgagaaccactgttgtagagtctgtttctgcactgggtgaggtgatgtgtctgccccgtctttgaactctgggggctaatctacttgtcaccttataagtatgtcccaaatattgtatgggcaagcctggagagttgggggcatatcagagaggctgcttggaagaggtgaccaagagctggccatgagaatgagaatgaaatttctttcattctcaaaactcatgcatgaaacaagctggaatgagaatgaaatgaacagatgcaacgaggctggcattcttgctaaaccaaatactaggggggcagcttctttacttgggggactcagcagtgtgttcttttttcataccctttaccccgtgatctggggtcatgaggagcccagacctccaccttgaaggcaagagatgagaaattacctcagcactgatttttctcattcatttaatgagctttggcccaaaatatccgtatgaatcagcagaagagtagttgtttattttcctactgtttttgagaaggaaaaggacccaagctggggtcctctgagctttcccccaacctgacctgtttgttaacagtctgcataaagccattggtcacagcgtgaatttgtgtcaaagaagcatttgaagtggtttgctttttttcctctttatttctgtggggcattttttagaccaattgatttgcaggaactggtagggtgtttctttgttctctctctgctacctggcaggtatcaagagaatgttttctctgttctttcagaagaaaaataaagtctgaaaattcattggtctttgatacaagcctgggctagttactggggtcgggcaggccaggtacagcttcattaagggaatctggtgatcaggatatgtcccccaataatgggagttgctaagtccccaaggctgtcaggcttagcaaatcatacaggatgcccagttaaatgtgaatttcagataaacattgaataatgttttagtataagcatgtcccaaatattgcacagggaagcctgaagggttgggagcctatcagggcaggctgcctggaggagtggaccacaagctggtcctggagtgagagtgaaagtagtcagatgcagtgaggccagcattcttgctgtaccaaatattgtgggggacatatttatgaaaaaaattatccattgtttatctgaaattcagatttgactggatggcttgcattttctttggcaactctacaacccaacttcaacccaacttcatccctggctgagccctcctccttccttctcctcctagccagcccccgtactatgattaattctgcttctgtttcatctgtaacagctggttccatctccactgaaaactcactggcgacagtggagtctgacgtagtgatgttcgaatcccagtaccagcggttaagctgggtggccttaagcaagtgacctcatctccttgggcctcgattttttccttttcgaaaactaggagagcaagagtccaccttgacctcaaatgaaatgagataaagccaatgaagtacttcggcagtgcctgacacttccaatgtcagcccttcttcttcttctttcttccttctttctttttcttctctttctcctcctcctcctccttcttcttcctcctccttcttcttcctcctcctcctcctcctcctcctcttcctcctcctcctcctcctccatcatcaaggatggcagcattgggcaagttgggagggcttagcctgctccccaacagcaagacacgctacctagccactcagttcccaatccatgttccttggcagcacgtcttgttttccctcttactgaatttatctctattctcttctaattcatatttttaatgaagcatctgtttaaaaaaaaaacaaaaaactaaattatggctgggctcagtggctcacacctgtaatcccagcacgttgggaggctgaggcgggcggatcacctgaggtcaggagttcgagaccagcctggccaacatggtgaaaccccatctctactaaaaatacaaaaattagccaggtgtggtggcacgtgcctgtaatcccatctacttgggaggctgaggcaggagaatcactgggacctgggaggcagaggctgcagtgagctgagatcacaccactgcaccccagcctaagtgacagagcgagactgtctcaagaaaaaaaaaataacgaaattactacatacttcctatggagaaatcagaaaaaacacaagggcaaaaccaaaaaccagaatacacacacacactcgagcaaaccagaaaacaagcgccattcacctcaccaccctgagaaacccactggtcctatacctgcaggtgttcttccagtatttttcctgcaaatattttacataattcataacaaactgtatatcattaaaactttctggccgggcatggtggctcatgcctgtaatcccagcactttgggaggccaaggcaggcggatcacctgaggtcaggagtttgagaccaggcagaccattatggtgaaaccctgtctctactaaaaatacaaaaattagccggacgtggtggcgggtgcctgtaatctcagctactcaggaggctgaggcaggagaatcgcctgaatccaggaggcggaggttgcagtgagccgagattgcgccactgcactccagcctgggcgacagcgtgagactccgtctcaaaaaaaaacaacaaactttcacaaatattatttttaatgaccagacattcatggaggggacgtggttcaccgaactgctgtttccctaatgtccatttacatggttttatttatttttattttttaattatactttaagttttagggtacatgtgcacaacgcgcaggttagttacatacatttacatggttttaaacctttttgtggttcttagtgataaggtgggcgtctggcttgtattaccatctccgactcccaaacctccgtctaaggagatgtctccagttatcgtctttcctgttgtctccttgctaacagtctcccatctctgatcacactgtttgtttatgatttgtctcccctcggccctaagttccatgagggtgggagtcttacttgtcttgatcactcctgaatagacaaggcctagcactcagccaggcatacagcaagtgctcagtaaaggtatgttgagtaaataaatgaacgagcatgcccaactcaccaccacttaactaaaatcacatcttttcaattttcgaatcgtttgctactgtggtcagcagagatcggttaattaaactttattttctccccagtatcatttcactaggtctttggggatctcatgtctgcctttggacccactccttgggtcctgggagctggggcagttgctgggaatctctgaggacccagagaaggggattagaaagcctgggggtcccatccctcagtcattgtgggcagcctggggtcctcaaatctgggctgagtagtactgtggacccagctcagtgggtgaactcactcaaccccaccatcagtggctcttatttggggatggtcgctagaagctcattgtcaatggatatttattgatcttattagatgccaggtattggcacacagaaataactcaactgggtctcacccatcaagtgactcacttttgggaggtggtgatgggctgccatgtctacatcaacagatcattccaagctggagagatatgtgcctgagtggaggtgtatgtaggctgaggccaagctgggaggaggagaggcatatcagggagagctgcctggcggaggcaaccatgagctggagctggactgagaatgaattagacaggtgcagggaggccagtgttctggctacactgagcacctgatgcaaaggtaaacatgaatggccagccaaagcaaggaccccagggtaaaagtgtggagatccccagtgtggcgctggccgggtcctcagaggctgtgtgtacccggtgactgccagtttctcctcttagtcctcacactgtgcccttgctgcctgccacattgcagcttgtaaatggaacttacttgagatctgccaagcaccaggatacatctgaaatcacaaagctttcatattattttcgtcttctctataatttcttttttgcaacctagcctaattttttttttaaatgtgcccagcagcagtggtaataataataataatccttgccacccagcagtttgcttctggctgtcacattccaggccttggcccgaggcacatttattttttatgacccagttgtcaactgttagggaatggtgcccaaatggaaggatgagggatcactcactcgtgccaggggctctgccaggagcttgcttttacttaattctcccaacggttctttaaataaggaattatgatcatatctgtttttcagaagaagtagccaggctcagagaggtgaagctacttgcccaaaggcacacagcttttaagtggtggagtcgggactgggatccaggttggcctgactttaaatttggtactttcgttcttcccactgtcatctcagatcacgattcagatcgtggctgaagacaatgtgctctaaggtctggtccacgttcactcttgggtcacttctcccagcctcagtttttcacctgtgggatgggtaaagcaacacccttggatgacaccaaggattgggggctcagtgacacttactgaccgtgcccttccccaaatgggtggccttgggcaagtaacttcacctctctgagtctccattgcctcctctgttggttggagagacctatgcctgcctcgtggggaaaaagcacccagtacaacagaatacgtgctcagtgaacactttctctcctctccacttaaatggactcttgatgctgagataagaagtggattggtgagatgctgagcgacgggtagggcagctcctggctgtggactgacacctgtcctgccctccctgcagtctccatgaggttcactggcctgtgcgggcacctatgtgatgtttcttttttttttcttttcttttttttttttttttgagacagagtctggctctgtgcccaggctggagtgcaatggcgcggtctcggctcactgcaacctccacctcctgggttcaagccattcgcctgccttagcctccctaggagctgggactataggtgcgcgccaccatgcccagctaatttttttatttttagtagagacggggtttcaccatttttgccaggatggtttcaatctcgacctcgtgatctctctgcctcggcctcccaaagtgctgggattacaggcgtgagatgcattgaatcagtgtccagcattttcctccccaagttagctcccgttccgggaggcagaggggtgggaatccttgggcaggttggttgtagaaacatccttccattcagttcctttacccctgcccaatgtctcccagcccatggtgtgtgctctgtgtgtcatctctttgcacacctgtccccttcagtggactgggagccccttgagggcagggtcatacccgattaacttgttatagagtatggggcatcaacttgggcagcaatggggaacggtgtctctggaaggtggaacagcctgggtgaaggcatggaaggagagaggcagcagtaagtggaaaccaccgtttattgagtaccactgtgtgctggcctctgtgctgggtgctttacacacataaactcatttagtcctcatagcagccctgggaggatgctaagatatgatttccattttatttatgtattttgtttgagacagggtcttattctgtcatccaggatggagtgcagtagtgggatcatagctcactgcagccgtgaactccttggctcaagtaattctcctggctcagcctcccaagtagctggggctacaaggacatatcaccatgcctggataatttttatatattttttatagatacgagaggtcttgctatgttgcccaggctggtctcgaactcctagacataagcgatccttccaccctggcctctcaaagcactaggatgacaggcatgagccaccacacctggccttatttcttctttgaagaagtgcaaactgagcctccatgcacggggcaagggacttttgcaaagtcacatggttgggagtgcagagtctagagggcgtccagctctgactccaaatccaaacctggcctctctctggattgtaggaatctcctgggcgctctaagcccagcctggtttaatggagagagaatattttggattttattttcttttaccaaattacctgaagactttgattgaccttgagactttacctcagacaaaccctgggcatcttacaatttgaattttatccattgatttttaaaaattgaggtaaaacataaaagtgtataacgtatactaattttaagtgtacaactcgatgtttatattctctctcccatattctttgtctctctcttttttttttgagacggagtcttgctctgtcgcccaggctggagtgctgtggcgcgatctcggctcactgcaaactccgcctcctgggttcacgccattctcccgcctcagcctcctgagtagctgggactatgggcacccgccaccacgccaggctaattttttgtatttttggtagagacggggtttcactggttaaccaggatggtctcgatctcctgacctcgtgatccacccacctcagcctcccaaaatgctgggattacaggtgtgagccaccgcacctggcctttctctctctttcacccaggctggagtgcagtggtgtgatcgtggttcactgcaaccttgatttcgtaggctcaagcaatcgtcccgcctcagcttcctaagtagctgggactacaggctcatgccaccatgcctggcagatttttaattttattgtagagacagggtctcactcttgctcaggctagtcaactcctcccacctcagcctcccaaagtgctgggattacaggcatgagccaccacagctggccatgttattattattgtttattatttatttatttttttgagatggagtctcactctgtcacccaggctggagtgaggtggtgcaatcttgtctcactgcaagctctgcctcccaggttcacgccattctcctgcctcagcctcccgagtagctgggactacaggtgcccgccacttcgcccggctaagtttttgtatttttagtagagatggggtttcaccgtgttagccaggatggtcacgatctcctgacctcatgatccatccatctcggcctcccaaagtgctgggattacaggcgtgagccactgcacccagccaatgttaatattattaaacacacatcagcaactatctgccagatcaagatacagaacattcctccttccatgaaaggctcctttgagccccctcccaggcaatctccatcagaggtacccatctcactccagactaattgtctcaacttctcttaccatgttagtttctcccattcttgaactttgcataaacagaagcacatgggatgcaggcttttgtgcctggcttctttgactccacactgggtctgtgagatgcctatatgtggctgcgtgtctcagtggcttgttctttttcattgctgtgtagtgctccatcgctgtgctctgggtataccactctttgtggctccattctcctgctgatagacatttgggttgtcagttgacttattctgttcacttgacttctttctgttttcatgattttgatccaaagagtttcttttgtcagggcactctgcagaggtgtttgaagaacaattggctctctggaaatttaagaaactatgactgttttcatgatcctaatcattttgaatcagaaacatatatatttattgatccatgtcttctgttcagaaaaaagacattgggaggggacaaggaagagaaaggagcaaatgagctttagtggaagttttctcattcttctcttcacacaagctacctggtagatggtggaatccttctgtaatttaaagtcaaatgctcataggccacagtgggagccataataaatgtgtgggcactgtccttttggcgccctttttctgctactttgagatctcataaataacagagtatgttgctaagatgccttccgtccctctgtttgctccagctgcagttgctaggttgagctcctggttgctagggattttgtgatcctgtggcggcccagaaatatgatggatcaatggaacatgcttttgctattaactgaaatgtttcccaagcaaatctcttaatgtcactgtatgctttgacgtcgtcccaattggttgatgattcttgcaagtttcccagttagaggaagtggcttgagtggaggggacaagtatcttggactgggaatcagttcaagaatcagaaaagcctgcttctagtcttgtatctgatactaatttgctgtgtgaccttgagcaagtgttacccgctctctgggcactggttgctgcaaaattcaaagacttgctggctttaacagcttacagttcatcacccaagttctctaagcaggccaagtgcaaatcagtttctcattatcggctggtggattattgacaaaagaattcccattcccggctcacttcctttccacccagcaggcttctgggctgagtgtccttggccagatggtgtgtgcatagtagcttcagactaattttaatattcaatcaaacataattggaatcataaatcttaaaaaaaaatcctataatccataaacatctgatcatgtcattttctgtttccttctgttaaaatctttggcaggctgggtgcagtggctcacgcctgtaatcccagcactttcagaggccatggtgggaggattgcttgagtccaggagttcaagactagcctgggcaacatagcgagaccccatctgtaaaaaaaatgataataataaaataaaatcatctgggcatggcagtgtgcacctgtagtcccagccacttgggaagctgaggtggaaggatcgtttgagcccaggagtttgagactgcagtgggctataatcacaccactacactccagtctgggccgtagagtgagaccctgtctaaaaaaaaaaaaaaaaaaaaattagcagttttctattgctgcacggaagacagaaaacaagtgccatttcctttagtgggaaagctcagttggtggtggctacaagaagcagtatcctgaaaggaatctggactcactggcttgctgtaggatcttgattgattaatgatgtctgttatgagctcaggaatatcgtgggggcacgtatcagtatttaccaatcatgactggagtttaaagcccacgccctttagtatcatggttgaggccttcaagggtggcccatgctggcttctccagctttatcttctccccatctctatctgacccacctccaaaaataactgcttccagacggcgtggtggctcacgcctgtaatcccagcactttgggaggctgaggtgggcagatcacttgaggtcaggagttcaagaccagcctggccaacgtggtgaaacccttctctactaaaactatgaaaattagctgggtgtggtggcgggtgcctgtaagcccagctactcaggaggctgaggtgagagaatcgcttgagcccgggggcgcggaggttgcagtgagctgagattgtgccgttgcactccagcctgggcaacagagcgagactctgtctcaaaaataaacaaaacaaaaataactgcttccgtcgaccacctattgtctccccaaatcccctttgctcatgtggttccctttgcctgttgggacttctattatattaaattggccaactctgcctatttatctttcaaactgctatcacaatttgatctgctctatgctattccctttggctgtcttgggtgggattaattaccccttcttcctctgatgtcccatgattctctgcatagacctatagcacaacttaccctacagagcctacctctaggccctacctatagaccctatatggcctatgtatcaacctgtacccatagcctacctaccacttagcccttttcatacttagttgcttttatgtctctttccagttctaccttgagagggcctcaaagtcaaggtctgggctttgctcatctttgcatccccagaccagagccccgcatagagcagagcttccataaatctgtaatgcgtgcacacatgaaggaataaaagccacactgcatttcaaagtcagagaaaaatgatttggataactttcccagtcgcctgagtttgtctgtcagtactcctcagcttaattgtgggtaatttattgtggcaataaaatgacccccgcattccttcgagacggagctcagcttcaagttgtgagcttgtgttttctccatcgcgatggccttgttttcttcctctctccctttgcccgcagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaaggtacgtccttcctgccgggctcacctgggagggcagctgtctcctttggcaggtgcctgacaaggcccttctctcggagcggtgggaacagggtcaatctgtcaccttctatgtctctgggacttcccttggggaggctgctgaaactaggcgtcgtgaggaggacacagggctggcttttcaagcaaaccttctagaccagctctgtccacaagaactttctgcaatgatggagattactgcggttcagtgcagtaaccactagccacaggctgctactgaacacttatatatagtagtgcgactgaggaattgaatttttaattgtatttaattctacttaatttaaatttaagtagtcataggtagccagtggctactgtactggcagtacagtagggcagctctagaatatgcaagggaaggttgggtctctgcagtaaaggtgctgtgtttttttctttttctttttaaaattttcattgagatagggtcttgcattgttgttcagggcagtagtggtgcgatcatagctcactgcagcttccacctccttggctcaagcaatcctcccgcctcagcctcctgagtagctgggactacagctgtgcacccccatgcctggttaatatatatttttttatttttttgtagataggggtctcactttttgcccaggctggtctcaaactcctaggctcaagcaatcttcctgccttgacctcccaaagtggtgggattacaggcatgagccactgtgcccagccaaggtgctgtgtttctagttagacatcctggagatgttccctgccacatgccctgaaactgatcttgtatccttgtccccatccttaagtgtctgcttgcgattttccccattttgacctggtcttccaagtggttcctgccatccccctagttcttaccctctccgtatccaatcattcactatgttccagagatagtctctgtgacatcatttctgtcctagtttctctatccttactgttatcaccttatgcggtgtttacgtttgtgtgtgtgtgtgtgtgtgtgtgtgtgtgcttggataggtgcagtagcctccttgctgatacctgcattcctcctcctacccattctcatcatgaccatcaggttcctttctacaacatagacccgtaatgtcattctccgcttagaatcctctggaggctctcccttgcctccaagtcaaataaaattccttggcttggcattcaaagctcctcacctcctcacctcaaaagctgctcccttttttggcaatatagaaggttctggggagagagtggggatgaagagcaagggtttctgccttcatggggcctttggtgcattgtattatgattgtgactttgtctagctcttatcagtggctggtggcttcctttgggcccagagcatagaactggaagttgcttattgaatgaacatgtgtgtgaattgaggtctgtcctgggactgtgcatggattctggctgacattctgggctgttaccttggcgggggcagtagaatcttcgagaaggtgctggtgcatcctttccgtcatccccacattcccgggccctgtggcctattcctttgattctcatccatttgagccacatacattaacccattgttttgattttggaaatttgtagaagtcatactgagtcaggagtaagtaagatggggattcaacagttgatccaagccaaggacagacatgctgggctggggcaaatatgaaaataccaaatgccacttgtttttccaaaaatcatccatggacattcacaatggcaaagatatggaaccaatctaagtgcccatccaccaatgagtggataaagaaaatgtgagatatatatatatacacacacaccatggaatactactcagccataaagatgagatgaaataatgtcttttgcagcaacttggatggagctggaggccattattctaagtaacttgagaatggaacaccaaatatcatacattctcacttacaagtgggagctaagctatgaggatgcaaaggcataagaatgatataatagactttggggactcaggagggggaggttaagagggggtgaaggataaaacactacatatttggtacagtgtacaccgctaggggggttgggtatactaaaatctgatcaatcaccactaaagaacttgaccaaaaaccacctgtacccccaaaatgattggaaaaaaaatcagccgtgggccatgctcagcgcttggctgtttgggcatcaccactactttgttcagggaactgtaatgtctctcactcaacgtcctggtcactgaggccaacctgagtcagaaacagacccttagacagagatgtgggaacatgttgcatatttggggaaggaccccagaaggctgtggcagggaaatgggaaaatgacacaggagagggaaggcaggtagtataaggtgcatgaaggagtggcttacccctgggaaactgaggctcagtccagctggggacccctgggagactctgaggaatatgcctcctggttgtcctatccaagagacaaggaagttgagatatttatccagagactaagggggagccccctggcttattagcctgtcaccagggaagtgtaggagctcaattttattcctgagtttctcctcctggggcagagtgggggggcccccgccccctgatgtgggctcaaggacctgacccatcacatcagtgcatctgatgataagagaaagtcacttttataaatattttactaatacttgatgatggcaataatttctgccagtcctccccctatcccacgttataaattattttaagaagagctgccgtcagtctgcctgggaggcctgcccgatgatttacttacttatatattctgctttgaaagatttcataataggttgctctaaaatcagctattaagaatttcaaagtcgtacataaatgtctttgctttgtgtcataacagatcattttgaaatatattaagaatcattttcattaatcaggtttttttttcattaaaatgatactcccttctcagtgtgcctggcttcctaactaattctgagagccccaatcctgtttttaaaaatcaataatagttccctttggggagaatttgggccttataactggacacagggtttttgaactgttatagcaatgacaatcaccactaatattggcctggtgtttgacagtttcaaaagcacttatacctctattatgcccttggattggattagatgtatgtgctaacttaatgggcaagagtcaggagtcagcctgctggatatgaatcctggctcagcctctctgagcctcagtctcttcctctgtaaaatggggctaatgatggtacccactttgtaggcttctcgtgagaactgaaggagtcagtggcaaaaactgtggtacacaggacttggctcctggcggggtgtttcataagggttcattttcatccgtctcattttatagacaagcaaacagaggctcagagaaggtatgccactgatctggtatcacacagccagtaccttccagagtggggtttgggccattctcattttcctggggccattgtgctgagtgtttatagacccgatgatgtcaccacctccttagaacagcctgggaggggtgaggactgttacgatgcccattttatagggaagaaactgatgcgcagcagagagtttcacgcatattcctcaggacatagagctaaagctagagatgggatttggacttaggtctgcctgagctctgagccctgagaccagcctctgggaccacacctcctacctcccacctcccaagtaccctgtgttcctgcctatggcaggcctacaattcacctcaattctgagactatcctgagttagcagagttaacacagaccctgcaggttaaggattcaatcctacaagactgtctccacttcagatgccagctgcaagtacccgacctcccatacttctagccaagtggcttttacatagtgagttctcatgacccccttctcttgtctaataattcactagaatgactcacaggattcaagaacacactttacttacaaccactgctctattataaaggatacaactcaggaacagggcaagggatggggagagggcagagactcctgtcctctctaggcatgacagccgacagcctcccagcactttgatgtgttggaagctctctgaaccccatcctttaggggtttccatggaggtttctctatgcaggcatgattgatcaaattattggcaattaactcaatctccagctcttctgtcacatcttaaaaagaaatcctatagctgggccaggcacggtggctcacgcctgtaatcccagcgctttgggaggctgaggcgggcagatcacaaggtcaggagatcgagaccatcctggctgatacaggaaacctcatctctactaaaaaaaaatacaaaaaattagccgggcatggtggcagacacctatggtcccagctactcaggaggctgaggcaggagaatggcgtgaacccgggaggcagagcttgcggtgagctgagatcgcgctgctgcactccagcctgggcgacagagcaagactctgtctcaaaaaaaaaaaaaaaaaaaaaaaacccctatagcctttagctattgccctctaaacacccatccctaagcaatgctttcccccagccataaacaaccatgaatctactttctgtctgtagatttccttgttatggatgtttgacatgaatgcaatcatgtaatatgtgcatatctttgttgtcttttatgactggctgctttcttttttctttctttttttttttttgagacagagtcttgctctgtcgcccaggctggagtgcagtggcgcgatctctgctcactgcaagctctgtgtcccaggctcatgccattctcctgcctcagcctcccgagtagctgggactacaggcatgtgccaccacacccggctatttttttttgtatttttagtagagacggggtttcactgtattagccaggatggtcttgatctcctgacctcgtgatccgcctgcctcagcctcccaaagtgctgggattacaggcgtgagccaccacgcctggctgtgactagctgctttcatgtggtgtagtgtttgcaagagtcatctattttgtaggatggatcagtattttagtcctttttattatggctgaattatattccatcatatggatataccacattttgtttacccatggaccagttttttttttcttttattcttcctgagagctgggtcatagtaactgctcagaaaattctagtagaatgtatgccccaaactggcttgcacaacaggtaaaattaggcccattttgtaaaggagagcccagaggcagagcggttctgtgatgggtcaagtatgtatgtgtatgccaagaagactagactttgcagtcagccacctccagccaagtttcagctctgccttttaatggatgtgtaatcttgaacaggtcacttcccgtatctaagcctcagttctctcatctataaaatggggacagctatgataccttctctatagggtgaggagtgatgaaacgcaacgatgttcataggaagccattagttcagggctttgtggttctggaaatgtgtctgttttgtttgtcctgcagatcccatggtagacataaaccagtcctctgggtctgtgtccccagtcctctcttaaacttctagccaattactctgaacttgttggggtttacactattttgacctcaacttacggtaagaaacattttacctcttgacccagtgaacacacacacacacacacacacacacacacacacacacacacatattttatagagactaaaccacagagggaatcttctgtattcgtgagtttgaaaaaagaaaaacaaaaacacgccaacactggcaggtagctacaaccatgcccagaaactcaccgtggtaaatccactttctctgcagctacaaatcccattttgggttttgtttcacctttattttgatttttaaccttatacagtctctccacctggccaccagagtggcccttttcacacaaaacccagcccacaccattcctctgtccccatgcctgcccaggttgctcagaggcaagctaaggcagccacaaagatctccaagcttccacggaataggggagcaatgattcccaagcagtctctgtgctgagttacttgctagatcaccggacctgaggaaatattcaagataatgccttaaggtgagtgtggtgcagttgtggctcagagaggtggtgtgacgtgcgcaagggcacacagctgggaagtgatggagcacaaagctgcttgaacctaaggctctcaggctttacacagggaccaggacccttcttagttacattagcatagttgaggttttcttctgtgtgtgtgtgtgagagagcactcctgaagtctaagcaattctcctgtgtgtggaaggtagcttttggcacaagccaggtgggctcaggtggacaccctccatataaacttcttggttgtccagggcaactgtactttgctcagcctggatgtcagggggtggccctgctctgtctggcaaggtcccggcagcgagaaggctcctgaacttgcattagatgttgcctgacagccttggcagatggggcactgtcaggactgtgagatcggatatgatggaagaccgtgggcatcacccatagacccctaattgtctggttcacctaggatgtccatgctgcgcaaaaggtgtggtgggcttgcctgctgaggagggctcagcgaagggcccatggctgtgatgggcaaggagatgctcatctctcagctcctctggtgtctggaggtcaagtatggcctcccctttccctcactcctcatgtacaggttctgagcgtgccctccctgtgcccagctctcagtggggatggaactgggcagccccatgttaaggcacccttcccatgccagccccacgttgtgatttagcacatggcatcccattcgctcctccagataaactcatctgcattctgcagatgaggaaactgaagctcctccaggagaaaccacttgcccagggcacacaatgaggctgcacccgagcttggactgggactcaggtctgtctggctccaaggcctcttccttccactgcagcatgcaaaaaggatggtcaaaggacaaatgttccctgtttggggactctcaggttggaccagggcaagatcgctgtggatttattcttggagcctcagctgggagccctagagctctctccagggatcctcgtcttatgatcacgtcacccaattggacataatctctgtcctggaagcctggaatggcttcccagctagtctcctggcttcccttcttccccatcctttctaccccgatctgttctcatgccgcagccagcaggaactcccaagttcacacgtttggttgggttacttcagtagagctaccgatgaccctgtatgagggcaattccagctggtctggtccctgcccacctctccagcctcagtttgcacccatgatgctgtggctcagctgcagaggatgtttccagtttgactctcttgctattccctgcaagagctgtggtatggcagtcttgtcctctcccgctgtccctacttccctttgtcaacccctcagctcttgattcgaaagtcactgcccccacaagccttccctggccctgagcaaggtctggttttcctgctctgtatgctccaggcattccctggccacctttatttatttttcatgtgggacgattgattattggattaatgtctgtctcccatgctgggctgtagctctgtgagtacagaggtcttgtctgattctgctcatcgttgcatccccagggcctagcacagggcctggtacatagtatgtgctcaataggtatttactgagccatgtgacttcttggcaactctcaaaggagggagaggttgccctggaatggaggtgcgatgagggatgtgaaggggttgtgcacttaatcacattggcaggtgaaggagagggaccatgcaggaggacagacagacaagggcactgaacgacaaccactcggctactgtgggcatcccctcttgccctgactctaggacacctcccatcacaggacaggtggctcctgggcttagtcagtttattacagatttgtctcgagaggctgggcacagctggcctttggatcttagaagcctgctcttgtggtggcaatgagactgcatccctccctctgcctgcatagtatccacacttcctttctgtctctctggcttgccatcactgatgggttcctggggaaggcagcgggagggggctctgagggctggcaccacatggcaggcagaaaacaccaggtgatttgacatcgtggttgatttgctgttcgccaaggctcatggctcaagccatcactccaggtccattagacaacaattcatccaagctcatgcttctctcctttggcaaaaagtggcctgtggaaccattagctggtgcttgtgtatttcgaatggcaggcaatggatgctctctggagctaaacttggtaaagagagagtagggaggaggggagagctggcttcccagaactggacagagaagcatttgagtccaggctccctgatctcctggcagtgtgattcaccctgtgtcagtgacttttcatctcgttggacctcagttttcttgtctgataataactccacctaccttctacaatcattgtacagtcagataataaatgtttagtacttggcacatacgaggtattcagtaagcagtaactctcttttctttgcaaagcattttggttgtcatttctttctgttggcattaaagcctgcctctgagatgggcttggtgagggttgttaaacccatttggtgagtgaagaacttgcacctctcagaggtgtggctcctcacctaaagtcataaaatgaaacttctgtgctagagaacagcaagttcagaaccagaatccagttctagactctcagctcagtgctctttacacagcttagcagaaggcccgagaggccaagggtagtgtagggcagtggttagagcacagtctagagtgacacagatctggactcagattgaagtaagaattccagcactggctggctttgtggctgttctgttacagtgctgctgaaggaatcagccccaaagcccatggcttgaacaatcactttattatttcccaaggcttctgtgtatctgtactttggaagggctcaactgggaggttttggcttggggtctctcatgtggctgcagtcaactggtggctgatgaagcgtaggaaggctggaatagcccatttcccaggcttcatgtggtctcaggtctctccctgtgggctagttgggcttccttatggcatggtggcttcaggactccaagtgcaagtttccaggaagcaagatggaaggtgcatcaccttttctgagtggcaacacttctgccatgttctgttggtaagaatcgtgtcacaatttcaaggatgagcgaaaccaaattccacccctagatgaaggagcagcaagattctaggacgtataggatgggagctattggcgtggccatatcttgccatagtggccttgagcaagtaacttaagctttctgaggctcagaaaactgaggctcagttttctgagcctcacaggtctgttttgcagatgaactgagatgctgtttgccaagagctttggggtacagtgccaggcatgtaagtaagagttagattttaaaaatcataatgttgcaaagtttccatagccaatgcatcccggtccctactgtggtggggatggaatggctcctgagacttttgctctctgttttattaccagtgcccccgaccattctctgagacccccaaaagaccttcttcctacagaagagtaaatcaaggatgaactctatgtcctctttgcagcaagatacgatttctctgtcttggggcctcttttcttgtatgagattaaaatcagacacaatcctcttcccaggaatgacctctgttaaaatcctctccaagttttccctgttctccacctcagccccaggctggggatcactttgcataaattctcacttttaattctcacagcaaccctgacaggtagggaaggagtcaccatttttgtggtccaagatgctgagtctcaggatcttgcaatctttgtcaaagtcaaacagcagcatgtgatggggccaaggtcagaactcagtacctgtctgcctccaaagttcttgctcttctccactacaaggccacccagctggccaagctggtgggtacattctgggtgctaggatctccaccctctctcctgagagcgcctcctcagctccatctaatctccatccagtccccaatttggaaggttgtccctctaagcagaattgaggagagctcagactcggggctaaaggcatggggtctggaaccaggctgaccagtgttcaaccctgtttctcctgcatggtccaggtgactcctttgacctgtgagactcaatgtcctcatctgtaaagtggggataatcagagtgcctgcctcctagggttcttgtgaggctgacattattgaacttgagtatttaaagctgtgtcattgctatcattggcattattgttattaacgaaaaatcagtccagggcccaggagagttttccccagcaacttttagaagaggctgacctgggcggttttttttgagacagagtcttgctctgtcacccaggctggagtgcagtggtgcaatcttggcttacagcaacctccgcctcctgggttcaagaaattctctgccttagcctcccgagtagctgggattacaggtacctgccaccacacccagctaatttttgtatttttagtagagatggggtttcaccatctcttggccagtctggtcttgaactcctgacctcatgatccacccacctcagcctcccaaagcgctgggattacaggagtgagccaccagcctgggctggtctttaaccttctctgatccctgtggtcctgtagctgtaagagttgatgtgcatctccctggagaatcagactattggtccacctgcctcctgtccctcaccacttgacagaaatgacagtaatgttcggaactcaaaatagtgacaaggatgagcaatgcttgtcttgatgggggctttgcttggtttcctttttctctgaaggcccatgggttatttagtttatttgtctctcacgaaatttgccagtctacttgctgctgacccattacttaatatacgacgcagtcagaaccaaatatatcccagcgaggtgccccatgatggggttatgaagggaggctgctatctagctggcacctcactccccgcctgctaccatcataaagttatcagtgctggaatggatggggctgtaactcagggagccaggaggtgctcatggggaggagagacaatatcaataatgacaagggcccagtcccacacagaactgggataccccgacaccagtagcaaggacggtccatccaggggtaggaagaagtggctggatgctcttcaagctgtggtaagacctgagtgtagatggtcagtgatagtaacagagggactgttaacataacacaatgaccatatattcaagagctttgggaagtgttttaccagtcttattttaaagcaatcatatgaggaatacgtcaatgttgtatgtctataaaaaatggaaatagtccagaagaatagaaagtttaaaaaaaaaaaaaaggtctttcctcacaccccagtgccaaatcccattgctatgaaaggtgaccactgtgaacagtttggggtatacccttccttcaggctttttttttttttttttgagacagagtcttgctctgttgcccaggctggaatgcagtggcaccatctcggctcactgcaagctccgcctcccgggttcatgccattctcctgcctcagcctcccaagtagctgggactacaggcgcccaccaccatgcccagatgttttttttgtatttttagtagagatggggtttcactgtgttagccaggatggtctcgagctcctgacctcgtgatccgcctgcctcagcctcccaaagtgctgggattacaggtgtgagccactgtgcctgtcctccttcaggcttttttttttttttaataggctataattttttttttttttttttgagatggtgtctctctgtgtcacccagggtggagtgcagtgacgtgatctcggctcactgcgacctctgcctcccagtttcaagcgattctcctacctcagcctcctgagtagctgggattacaggtgtgcgccaccatcccagctaatttttatttatttatttgtagaaacagggttttactatgttgctcaggttggtctcaaattcctggcctccagtgatcatcccgcctcagtctcccaaagtgctgggattacaggtgtgacccaccgtgcttggccgactttaattctgaaagcattttagatttacagaacaattgaacagaaagtacaaaattcctacataccgcttctccctgtccccacagctctccctattactgatatcttgtgatgaaccaatactgatactctattagcagcaaaggtccatctatactctttctgttgtgttccttgatgggttttgacaattatataatgtcatatatccgttgttagtatcatacaggataatttcactaccctaaactggctagttttgtttttttcttaaacttttttttttcttttgtgagactgagtctcgctgtgttgcccaggctggagtgcagtggtgtgatctcggctcactgcaacctctgcctcccgggttcaagggattctcctgcctcagcctcccgagtggctgggattacaggtggccgccactgtgcccggctatttttttttttttttgtagttttagtagagatgtggtttcaccatgttggtcaggttggtcttgaactcctgacctcaggtaatcctcccacttcggtctcccaaaatgctgggattacaggcatgagccaccgcgccaggcttttttcttaaacttttgatttgaaataattatgcaatcccaggaaattgtaaaaatcacacataacattccatgaaacctttcccagcagcccccagtgagggcgtcatgcatagccgcagtacatattgaaaccaggacatcgacagcggtgcattactgtaatccaagcagccgtatcttcaggcctcaaaactgagcatttaactacatctatgcatttaacacatatgtggattaagtggttggttattgctttttatgccagtgggttcacaccacctttgttctatgccctttgcttttttcacatgtcatatcttgccttgggcctctttccacattgcttcatagtgatattcctgattctcttcgtcagctgcaggggactgtccagaatgaatggacctctgtgtatatgacagttctgttcatgagcattcaggttgtttcttgccattttggtattataaataacagcacactgaacatccttgtgtacagacagttgtgcgcattttggaggcatggtttcctggcaggggaactgttaggtcaagggtgtgtccagtgttcaacatttcaatgaacccacccaattcacctccctggatgttaacacggacaggttgactcatttagccctcacaaatctatggggtaaatactatgaggttatcatttccatctgtaggtggggaagctgaggctcagagaggtgcagccactaattcagggtcacacagtcccaagtggcacaaagctggactctctgtctgccatgcactgtgtcattgggggtccaaggaaggcttggcatttttaaagggacttgctctttccactttaaggatgctacctctgtcctctcctccaagacaggcctggcctgtctgcatctctgggctcacatctattttcttaggtgaagaatgcggggctcagaagagcccgaccaggtgcccatctggtggcttctgactgcagctcataactctgcttggctctcctccaattctgagaggcttctcccttccttctccacctccatcccagctgcttccaccccttaatgaggtgagcttcaccctgtaatgaggtgctccaagcccagagtacatttacttcccctacatttttcctgagggtgctgattagagttggtatctgggacccagctggctgggacagctttcttcaattcttcaagctctgaattaaagggtgtgaagagtggtggagtcaggagaagcgggagagctgcagggctgggcctgggtggcttctctgtgcagagggccttggacaagcaagttcagcctcccatggcctcaacttgccagggctctgccagttcccatagagatctctctgcatggttgaaagagccaaggagtcacttgcccacttggccctaagagcatccctgatgggtggagagtccaagggctggaaagggacttggactgcagtcagcctaagccgctctttgaacagggcagggaccaaggctcagagaagggaagagactttctcagggtcacccaatgaggctacaggggactcgaatcatggtcacctgactcctgagccagtgttctgttgatcttgtttgactctgtccctccttccctcctttctcctctttctcttccttctctcctttcctcccacctctcttcatccttctcttccctcctcctttccttctttctcatctccttctctcttttctcttcccttccttctttctctcccctcccctcttccctcttctattctcctctttcctccacttctcccttccctctccctcctcctcctccttcttccttctcctcctcttcttcctcttcttcttcctttttttttttttttttgagacggagtttcgctcttgttgcccaggctggagtgcaatggtgcagtctcagctcaccgcaacctccacctcctgggttcaagcgattctcctgcctcagcctcccaagtagctgggattacaggcatgagccaccgcaccctgtccctctcccttcttttcttctcctctgtgcctattggatgataagccctcaccttccaagatgaaatttcagtggaattaagaaagataaacccaggctatcttggatggtggatgatgctgggggcaagaattctgggcaggagacaaccaaagttgagggtggtcagctccactcaagggtttctagaggcagagacccttgaactgaatcttgaaaacagaataaattaaggagcgtgctctaggcagaggaacctgaatggcaaagacacagtggcttgattcagcatggagcaggttcagggtcctccttctcaatgcaaggcctagggcctctgtcttcctgttcataaagcatcagcctaagggcccctgcactggtgctgtgaacctaagggctctaatggagacaggattgccatgtggcctagcatcctggagatttcattgatccatccttggacccagtaccctcgaggcctgtcacctcctctgccccattctgcccaaatgccttcccacggctgcagaccctgcatcctcctccctgccccagctggtgacttggctctcaacctgacagctactgcaaccaggtctattctgggctgcaggcagggatttattctgcattttctgagcatgtagaatttattcataaagctggaatgctgcttgggatgtaaacaattaaatattttttaaaaatacatgctcagaagtggcgatgctggaagacggagctcactggtagtcccacaccttgggaaggtggagtgaggagattaggacacctgcgggaccctgatttcagactggttgagccactcacttgttgagtggctctgtgaaagttcctacccttcttttgggtctctgtctctcctaaataataacagtagctcacatttaatcagtgcttgccatgctcccaggcaccgttctttttttttttttttttttttttttttttttttttttttttttgagacagagtttcactcttgttgccaggctgaagtgcaatggcacgatctcggccctctgcaacctctgcctcccaggtacaggtgattctcctgtctcagcctcccaggtagcttggatccagacactattctaagagctttggctacttcaacaatctcatggagtagatgctattatcttattttacagatgaagaaactgaggctcagaggggagaaagaacttgccaaatggggtggactaggtgctctccagggtccctttttccttgattaccagataccctattcacccctttttggaagggagatagtgatggctcagtgagaactccaatatgtatgagttctggactcatcattcagagacaaagcataacaatactagcaataacaatgacagtggcgatgatgatggaatgaattgttaatatttactcagaattcatcttctgccagacatgatttaagtgctttgtatggattattccatttaatcctcataactctgtggtagattatacccattttatggatgagtaagtgaaggctcagagaagtaaagtaagttacctaaggtcatggacatagggaggggaagagcccaatctgggaccaagaggttctgtctttaaatcctacacccttattctttacatcactgaattgcagggttcataccaataaatggaattcataatcatgcctttttgtatggttgttgcattgatgagattatgtgcttagcacaggctcagacgcatggtgagtactcagaaaatgccagctactcttgggcttcccttggacccaggaaatagctttaaaggggacagtttgatagattgaatggcccctgctcagcctgccttggcgaggggcatgtgaatgtggaaagagcattagaggggaccatctagatctgggcttggtcctggactctaccttgctagctgagtgatctcaggcaagtcgtgcatagacttgcagctggtccattctttgagcctttgcccctgcaggtgccccatgtgacatcttccagccaaggtctccctgacaactctgctcctcaggttgggtcacctgctctgggacacactcctaggtagcttgacacattcaatgtcttatttcattcttaaaacaaccagatgggagaggagctaccccattttacagataaggcaactgaggctcagagagctgatatctcctacttgagatcttgcagccaggttgaaattatctttggacaatcagcttccagttctttccacaattcccaccacctcaaagatgcctccttatccatctttctcctccagcttcttgatcaaattagtttgagagacaccccaccccctcaacaggctcccttcctcttgtaaattccgcatacatgttggcatattcaaggttctgacaagtcctgcaagagggaaacctgttttgctgagtttagtttgatgttgctccaactgatttgtccataaagccttcttttcccccaaacacctgctcatagtccccagaacactgggaatggtttgtgtgctgtgttctcagttgttaaggttcgggcaatgattcatgttggattatgcataactcagcatcaatttatagatggcacatcggccaggcctttggacaactttctccaaacccagtcaggtggaacaatatgtccaggtttgtggggctgcatggcacctgagggcagcaggacctggaaggagccctaagaaacaggaatggatttgaagttctagcctctaagaatgagaaggttacattttccatgttctcaaaaatagaacttttctggttgtccctgggcagaaagccacagctgcctgaattggattttctcccggggtttctctttctgacccatttgtcatttttaagggaggaaatctctgagtgggatcataatagagttgacatttactgagcaggttgcctgttatgcatcctgcccgtataacctcattcattcttcttttatttattattatactttaagttctagggtacaggtgcccaatgtgcaggtttgttacataggtatacatgttccacattggtttgctgcacacatcgacttgtcatttacattaggtttctcctactgctatccctcccccagccccccacccccagacaggccccaatgtgttgtgttccccgccctgtgtcaatgtgttctcattgttcatctcccacctatgagtgagaacatgtggtgtttggttttctgtccttgcgatagtttgcttagaatgatataacctcattcgttcttcacaagcactccatggagtgaattctgttcgtcattcccattttacagaggaggagactgaggctcaaagtgttgacatgactttgccaacatcacgcggctgtaagcagtggaggtgggatttgaactgaggcagtctgtctccagaacattgccttttcctgtagcagctacagccttttagacttatctcttctctacaggcagcctccttcctcacaggcctccgaattgtaaacctctgtgtgaggaaaagtgaaccagatgcagcaagattataaagaagtcacataatgttgagtaattcagcaacagcacagctattgttggaaggagaaataacttggttattaataaatgcaggaggccacagtaattgatagcaattgaactcatagtgggtggggaaaaacagctatgttatttctctctctcgctctcattttgtatcgacataaagggaaaaacctgcctttgcaggtggatttgagcaactcagaaacggcagtttcattactttcccttgttccttttcctcccttcctccctttttctttctttctttctttctttcgttctttctctctttctctctctttctttcttctttttctttttcttctctttgtctctctttctgtctctttctctctctttctttccctccttcttttcttttctttttcttttctctctttctttctttctctctctctccttccttctccctccctccctccctcccttccttccttcctccctccctcttttctttccctttcctttccctttctctttccccttcccttccccttccctttcctctttcttctttttctctcatttctcttttgtttgttctctcaattcaaatcccagcctgcctcttaccaaaggagtgacctgacaaatggctcaggtgaggcagtttgcctggggtcacctggttaggtaactactctttcagctaaatcactctttccaaaaccactgtctcatggatcattagatccgcaagagattctgtaaatgcattctgaggccaactaagtctgaacagaatttctccttcttacagattcataagatatactttaaaggctctgagaagtcctgcagttaagaaacttatttaaccaagcaatgaccaaattgatatgatacaatattcatttatttcccagtgatactgatgaccattccatagaacaaccactacaaggtgcacctttggggaactctgatccccacctgtgtggccggccactctgccctgcttcacacccattctccaggagggcagtgaggaagggaaatggggtaggaaggcaggaactgtgggcccatctgccatggggacctgtttctccctagcaacccgaaaaatggctgacaaccaaaagcacagaccagaaatgatctctgcacttagctttgggatttccttgtctcctaatctccttgcctcctggtgggtggagagaaaagtacctggatagagtgtgtgatcccctctggagtgggctgggggcaggggaaaatccacttcccccaatggggagttccctttgaggaataatttctgtcctttctctctgtttctctctctctgcctctccctctttgtgtctctctgcctctctcactttggttttatcttgtatcccatcttcccttgctgtggctttgcaaagagctgatggtctacatggatggttccttgagcatggagcctgagatcagccacagccgggcagaaatcacatcttgtacctctttgcacaagaattttgactttactgggtctgttctgcatttgtgcactgcctcagagggttttggtgagatgaggcatggaaagcctttagctcagtgcctggcacataggctatgctcaacactcgatggcttgagaagaagtgacctcagctgactcagaagctctggggtgtgacccacatcccaagtgcaccaatccattatccattccacatggcctctttaaaaagcagtgaatagacaagaacctgcaggggaagtctctgcagccagcaggacaggataatcccttctgggctgaagggtaccctccttggttttgcaggtggagaagggaattgcaattttttgagcaccttttctgggccaggcactctgctgggtatctcacatgtaaccatctcatctccttcttgcaaccctatgaagaggtgttgggggttttaagattccgtttcacagacaaactgagtctcaaaaaggccgtgtacctggctttgtgcgacaaactgggaatagcagaaacaggaattggacccagatccagtttgggccaacacccatgttattgcccagttccttttctccctgcctcaggtgccaactcagggttcttgacctcccctgggaagagactttggtcactacccatgtccaagcaaagatagaagaatccatgggattggattttgtgcaccggccagccttcggggagctgatagtagaagatgcttttcctggcaaagctccctgtgtgcccacctggattgcaccagcagcatgcatctcagctgcacctgcaaatatcccccctaggtcaggcaggatttagagagtccagccagcatccattaaccactcttcttttcagaaatatcaattgccaatttcctttatgacttctcccagctcgttgaggccagaaacagttgcaagtgtttagagagcaggcatggagtagagcaagaggaggggacaggacctcacctacctagaaagacatctcctatttagttcactctcaatccccagcacaggaagaagaaagtctcattcagtgctaatagcctttaatgcctctctctaatatttgcttcttaacaaagagagagcagatttcaggctcacaggtaacagtatttaattagaatctaatgacattattgtgcttgtgtaatatttgtttctactttctatttgtggcaggtgataatgaattctcatttaacatagtgtgataatatttctgtttacagtgtatttaagtgaagatgaaaagtgagtccatttaaaagtagagtcacaaagatatggcaaaaaagatgatatttgaaggactgattttggtgaaaatgtagttcttccacttagtatcagcctgttttctggtgacttctctcaattagatttttaatctataaaatgggattaataatagagctttttaggactcttgtgaagatttaataataacaataataacaaataactacaactaataagtactgagctttttccatgtgtcactcctggaacaataacccaggcttttcaactgtaaaagtcatgagctgaacaaagacgcaatgttgaataaaatcaggtaagtgaattagatcacaccatcatcaccatcatcatcactatcatcatcactgtcatcaccatcatcatcaccatcatcatctccatcattttttaaagtgacaggatttttaaaaattagccatgttacctgagtctcagtttcatcatctataaaacgagcatagtctgtaaaatgaggttaatacagtgatgctcttgtgaccagtgcagagtaattggcacattaggaggatgtcagtaagcaatatctatttgtaatgcccttagtgattggggccagacctcttccttgggtagggtcaaagtcctagataaagtccttttccaaatttctagttttgccataagccagattggttcttcaagctgtctacttgaagaattgggccctcacaatctctttctgattgattgaaaaatccctgttggtggctgtgattcttatttcaaagaaggaaacacatttataggaaaataagagatgaaagagagaactttttttagttttattttttaagttgacatataataagtgtacatatttatggggtacatagtggtgtttctaaacatgtacagttatcagggtaattagtgtatccatcatcttgaacaattatcatttatttgtgttaggaacattcaatatcctccttctagctatttgaaactatataatatattacagttaactacagtcatcctacaatgctatagaacactagaacgtatttctcctatctagctgtgattttgtgtcctttaacaactctctccctatccgcccacttacctccccacaaacccttcccagcctctagtatgctctattctgctttctacttttatgaaatctttttttttagcttccacatatgaataagaacatgtgatatttgtctttctgtgcctggctatttcacttaacgtcctccagttccacccatgttgccatgaatgacaagacttcatgcttttttatgtctgaatagtattccattgtgtatatataccacattttctttacccatttgtctgttttggacacctaggttgattccctctcctggctacggtgaatcatgctacagtaaacatggggtacagatgtctctttgatgcactgatttccttgggataaatgcccagtagtgggattgctggatcatacagtagttctatctatagttttttgaggaaagttcctactgctctccatagttgctgcactagtttacattcccaccaacaatgtctaagagttcctttttttttttttgcatccttgccagcacttttgctttttgtcaccccatcctactggagtgagacgatacttcattgtggttttgatttgcatttccctgatgattagagatgttgaacattttttcatgtatttgttagtgaaaatgttttaaggacgacactattatttgttttaagaagtcatttattggccgggagtgggggctcacgcctgtaatcccagcactttgggaggctgaggtgggcagatcatgaggtcgggagatggagaccatcctggctaacacagtgagaccctgtctctactaaaaatacaaaaaattagctgggcgtggtggtgggtgcctgtagttccagctacacgggaggctgaggcaggagaatggtgtgaacccaggaggcggagcttgcagtgagctgagattgtgccactgcactccagcctgggcgagagtgagactccatctcaaaaacaaaacagaacaaaacaaaacaaacaaaaaaaagaagtcatttatttttctatggattaaaaaagtagtgctcaaccatggtagaaaatttggaaaataaaaaatccctttacctagctgtgatggttaatatttagccatatttcccttttattactttttacagcagtttagaatgatttgcacagttgatatcactatgatatcattttctaatctgcttttcacttagcattcaggtgtaagcattgtccatggtatgcacagtcttcactgctaattttaaatggctttataatggtccaaagagtggctctccattgattctttaatcccgtctggttcctctccccaccccgttacattccagccacactggtttgcttggcattcctttaacacaccatgctcatttctaccccagggcctttgcactgcctccttcaacctctgaagcacttcgctggttctttatgtagtacctccttctcacctttcatagctcagttaatacatcacgtcttcagatagaacccactttgaccaccatagacaccaaacaactcctttggtctctcttgatctcagcaccctgctttagtttctgtttggcagagggcagagggaactttataattttatggctggaaatgatcttatctatttgtttacttgtctgttgtcacactccctcaatggactataagctccatgaggacaggcaccttgtctgtcttgctcattgattttggtggcagacacagtgcctgtcacatgaggggagctcagtcaacatgtacacagtaagcagatggctagttggatggttggatgtgtgattgtgtagcaggacgagtcacagacaaaactcctcagacaccggattaaagaaggaagaggtttatttggccgggagtgccggcagacttgcgtcttaagagccgaactccctgaaaaagaaattcttggcctttttaaaggcttacaactttaaggggtccgcatgaagaggtcgtgataaatcgagcaagctgggaaacgtgactggggggactacatgcatcagctaacagaatagaaagttttgcaatgctttcccatacaatgtgtggaatttacagataacacaagtagtttaggtcaggggttgatgttattattattacttttttaactcctagggccgggtggtggtgccaaggttgtctggctatttatcttacttctgtttgtttccaactttttgctttctctttcctactgtcttgtgaactaggcaaggttgggggaggagggcagcaggagtagtagtggtctccttccttaattggatgaggagttgaaaggataggtaggtggcttgcaggggatagtgcatgcctggatgggtaggtaaatggatatgtgggtgggtgaatcaatcataattttaccaaccatcccccaatttcacagttagagtgcttccccatgatatttttaatcgctttgaaaaagtaagcaatgcaaatggcgaggaagtcggataagcaagtctcttgggaaatccgactcctccagggccattgcctaggggcccaggcctgggcagttgtccaagctcccggctgaggaggctggcctggagattgggagggtgctgagattctccgaggtcctctcgggtgttcattcaccccatgcccaaggcctcactgccacgcctctgttttgtcccctttgcagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcaggtacatggctgctgcctctttgggtgagctgggcccccctctgggccagctcctggggatacaccagcattctttaacttttttatcaaagatttgttaagggcctatgctatgaaggcgtgtgttagatgcaggggaagccatcgtgggtggaaagggaccggtcaatgctaatgctcaaataactatctccattcagtggccatgaaggctgctgaaacctggcagggagccccgcgctgtggggaggggatgccgtgggcagggccgatggaccaatgcatttccatcggatttcgtgtttgttgagcacctactaagtaggggaaagactagtctttctgtttgagggatggaaatcccgagtggctgctgcgaggtggagggatgggagaagatgagggtggagagcaaggtgtggtccgctcactaagggtttataaacgagggttttcattctcaggcccttgggaagccgtggagtggcttaggcagggggatggcatgatttggctttaagaagctcagcctggatgaaggttggggagtgagtgggagacaggagacccactgggaacctataaaaatcaccaggtgataggtggtggtcggaagtgctagtggagacggggcgaggtggacagattcaggggctagtttacaagctgaggtgatagcatgggccctaagagaaagacagagaccagcagtggctgctaggattttggccccagcagctggaagaatgaggatgctttgaactgccgtgggggaaaaacaggaggactttgtactgtacttgcaaggatgtgatctgctgggtcccaagtctgcagcctctgtgcatctttgggagctctctaagagcagctgtccttgagacagcagagtttggggttaatgagtaggagtgttgtgagctgtgattttggggcccatctcttggagctcctttgcacctttggagctgcttccaccttccagggacttcggcgtgaggactgatgtcacttggaccccattggccctctatgtctcctttcaggtctgtgctctggtgtgaactgtggttttcttgaagattacctctcctcttcgacatgcacacacattcccagaagcatacacacacatgcttatgcacacatggtgtgcacaccatgtgtgcatcacacatgaacacaccacacatatgcacagcacaacttgtgtatgcacacatgtgcacagataccacggaatcacacacatgcacagacactggcacacatatactgcaagcatacacagcacacacacagatatgcgtggcacatgtatgtgtaaacatgtgcacagatatatatataacacatgcacataccatacaactacacacacacgcatagacacaagcacacacgtgcacacatatgcacaggcacaaacaccacacacatacttaaggatgggtgcatcacacacaggcacagacagatgcagtcaccactttgtgagtctgagttaacctctcaggctgaggtctcaagagtagacattaagcaggcaggggaccttcgggcttaggagagatgctgggaggctgtgggttgcctagcaacagcccaggttgggggtggattcagaggaggggtgggaaatgctttcggggctgcagtgggctgcctggaatgtacaagcagaattactcctccaggcactagtgcgcactgatttggaaactgtgttttcaattttttagatagaactgaaacttaagggacggaatttgtgatctgatcccctacactcctcactctgctttgttcaatgcaccctaatcaaggctggtgattttaatgggatgcatatacatgcgtgtgtgtgtgtattcgagcaaaatcaagtccacaactgtaattatagtttttgagcctttatattcctcctaacgttctaggtaggcacttttccaatctcattcagtattcttcatacctgactttaagcattcctttgtatgggtagactacaaattacctaacccattttctattgttggtcactcaagtcatttcaaaaagtgatttttgccaatttaatcaacaattggaagaacctgtgtccccagaaagctttatttctctcaatatttcattagaataaaagcctaggagtgaaattattaggtcccagtatacgaacattttatggcttctaatacaaaattgtcaaatttctctccagaaaaagggaatcataaacatttactgagtgtctgctatgtgccagacactggcaatttaaaggtcagcaaacccagggacagcgcctatcttcagggcacgcccagcctcatgaaggagacacaggttaataaaataactatactagaaagatgatgctatgggaagtgctattagaagcaacacagagctgggaattggcctagtggtggtgatggtggtagtcaaggaaggctttcctgaggaggtgtcatttgggctgaaccctgagtgatgagcagatcactctggggtgaaggtagggcaggttacataggacgctgtaggccctgaaaggacacttagactttgtcctaagaacctggggaaataattttagcagtggagggatgtggcaagaaaagaaggattttctaaattgagtggtccctactgctctgcagtgatgtccttggccccaggcaagatccctaaccaagaatgctgattctgtcctctttcccagggctcaagatgacaggagtggactgtgtggaggggatggcctcgggcctgtaccaggaactctttgcggctgtggtctcactcatcaacaggtaacggggccttttcctaggcacacagttggcctcttgcaggtgcacagatgaattcacataccgggcagttgaacaaagtggcagtttttgagctggcgagagggtttctaaggtggacagtgctgggtttaacttctaccttggccacccactggctgtgaggtcggcaaatcagttcacttctctgatctccctttcctcgtctgtacaatagctctcttcccaaggactgttgtgaggattaaaagaaataatgaatttaaataactcttcctggccaagcgtggtggctcatgcctgtaatcccagtactttgggaggctgaagtaggaggatcacctgagatcaggaattcaagaccagcctggccaacatgacgaaaacctgtctctactaaaaattacaaaaattagctgggcgtggtggtgggcgcctgtaatcccagctactcgggaggctgaggcagggagaattgcttgaacctgggaagcagaggtttcagtgagccgagatcgcgccaccacactctagcctgggtgacagagcgagactctctcaaaacaaaacaaaatgaaacaaattcttcctaacagtgattgtaaaaatgccaataataaaatctaagtacttttgagtggctactgagggccagggattgcactaattgtgtaacctgctttgcatcattgaatactcacatgggcccattgtacagaggaggagactaaagcttgaaggggtagaaccgagatgcaaacacaatgccaccttctcatgtcataccttcagttcccctgaatagcccaatacattgctctcatccatttatttttcaaaattgtcttgctggggatgggagcaacatggtagaaatttggagtgggctggggtgtgcctctgatgtgtgtctgcggggctgcaggcaccaggagcctctgttttccatcgttacgcacaatgcactgagcccatgcttggaaacccttttagcagttttttcagcagagctaattcagagcctaggcaaaggcttgccttcctcctctgtgaaagcagaaagcataattaggcttctgaaatcctgttaaagggatgaggctggcgcgtagcaacagagcagccgggtttctccaagttgtcgtggacacagaatcaactccctctgacgctgctgaagtaattaccatctgagcccacagacatattatctagaaaccaaggggatcatgcgtgcttagagagggagtactgggaatgggaaatgaactgctggcggaggaaactgccttcaccagtgaagggcagctgcttcaaggtttgggttctcagaggccacatctgtgaaatgccgcatggatgatcaaagtacctactacagcatttataagcacctagtaggtgtctgtcttgccaagaataaaccgacttcatcttcatgcatgtctgtgtggtggctgctcttattatccccattttatagttggaaaaccttggcaaacaacagaagaaccaaggttcaactaagggcctccaaagctcctagctgatcatactcgtggtgatgagagcaggtggcatttactgagcactaaccacatggcaaactttgctttcacagccatggaagcttatcacacccaaccctcacaacagccctctgagctagtcaccatcattaactgagacggtggctaagacggtggaggctcagagaggttgggcaactctcccaagacacacatcccctctgtcacagagcaaggattgaagcccacatgtgactggctccaaaatctcttaagtcctaaattttgatgtgaataatccctgttgtgtccacccctacagattcatcaggagaatacaaggaggtgatagcttgaaagaattttgtaaactgatgtattaaataaaatagttttttgattttaataggcctctgaagaaagaaaaggagggcctaggcttcatatggtagccaacttctgggtgaccttaagctagtcatttttttttttttttactttgggccagtgggaggcagtttaattcctttagtccttatagctatccctgggataagcctactcacccccatcctcatttaacagttggggaaacccctgctcagagaggttaagtagcttgcctgaggtcacacagcctgtaagaggtgagcttggttttgaaaccagttctgctggaggcttggatcagtgtgctcctagattccatgccatctcagacattccacctctctcttctctccctagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggtatgcctgggctggagcagggctttcaccagagctccgtggatggtgtaaggtcagatgggaaggggtgggattcccattccccaggagcctgcagcttcaccctgtttggttcaccagagaacaaagccctttccccaggcctggctccccagacctctgttgctccctccacagcccagcctccccctgccaccttctgaaccccgcagcccagaagcaccaaggaactcgggcttccccagtccttgcttccacggctgtcctttctttgggatgactgcttcattctctcccacttcacttaagcagaaggctcctccaagagtcagtctgcatctgcccagggggggaatgccctttgagtcctgtgggtgggtggcagcagtgggctccacacccctctgcagcacagcacggtgagtctcacaaagttgaaggtacatgcatcacaaaacccagcaattcctcttctaggaggcacctgagagaaactctgtgtgtgaaccaggaagcatgtacaggcatgatcctgccagcccttcttttttcataaaaaaaaaaaaaaagaggttaagttgaaatataaggccaggcacggtggctcatgccttaatcccagcactttgggagcccgaggcgggcggatcacctgaggtcaggagttcaagaccagcctgaccaacgtggcaaaccccatctctactaaaaatacaaaaattagccagactcagtggcgcacgcccataatcccagctactcgagaggctgaggcaggagaatcgcttgaacccgggaggtggaggtcgtggtgagctgagattgcgccactgcactccagcctgggtgacaaagagagactccatctcaaaaaataataataataatataaaataaaataaaataaataaaatttacaaagaaaagtgcataaaccagaagcatatagctcagtgaatttacccaaatgaacatacgtgtgtctctatcacccacgtgaaaatgagagtattttcagttccccatatgactcccaccttcttccctgaaggtgtgaccacttttattccaataagtaccactggcagaatattagaaatggccatattgttcaccagttgaataatatagaataataggtattgaagttccagtcatttttttggttggtaataaaaataaagcaccaacataaatgaatctcaaacagatgatgctgatgaaacctgaggtctgatcctaactctgtcgcttattggctgtgtggccttaggaaaggcactcaccctctctgaccctcaatttttttttttacgtggaaaacagagataataatacttttgtatcagttatgatttgccataataatgctgcgtaataaactacccccaagtgtagtggcttagaaaaaaatcttcggttgttgctcacaagtgtctggatggcctgggcagctctcttggtccaggatggttcttgagcttgtgttcagattcaggtgtaggttggggtagatggctctgatgatcttggcagggctcgctcatgcgtgggatcagctggccatgaacggatctaggcaggccttgtctggggtaaccttgtccctgttccacaaatgtcccatcctccagcaggctagcttgggctgtccttgtagtgctgggcagggttccaagagagcaaacagaagcgtgcaggggaccttgaggcctggacttgaggcctgcacagaatcacttccactgtgttcggtgagtcacaacaggtctaaggctgagcatggattcaaggggtaggaaaacaggctccacttcttgatggaggcactgcagtgtcactctgcagagagtatagatacagggaagtgcagagaaccagggttgttttagatcattgttaccagactccccaaaggggccgttttgaacatttaatgaacaagaataaagagtgtaacagctattttatttttcccataatatttcacttatttctgattatcaatgtaatacatttttaattaaaacgctggaaagttcatatgagtataaagaaactaaagatacaatctcctttggcgcttctatccagaggcaaccattgttactattctgtttcttttttgtttgttgtttgttgttgttaccattttccctttattatgttgtccgtggattttggatcttcctgtatatatgagtttgttgtctgtcattttcctcacagtattacattattcacataacctccctccacttacaaatcttagtaaacctgcttgcagtggttagatctgattgtattccctctcctatagacatcagggtagtttctaagttcaaggctttataaacaatactgcagtgaacatccttgtccacagcatttcctggacatttctagtgattttttaaaattttttgttttttagatggaggttcgctcttgtcgcccaggctggagtgcaatggagtgatctcagctcactgcaacctctgcctcccgggttcaagcgattctcttgcctcagcctcccaagtagctgggattacaggcacctgccaccacgcctggctaatttttgtatttttagtagcgatggggtttcaccatgttagccagcctagtctctaattcctgacctcaggtgatccgcctgcctcggcctcccaaagtgcttggattacaggcatgagccacagcatccggcttctggtgacatgattgtggcaactattattccccatagtttacatttgttacttccagcaccgaacactcagcctagcactcattaggttctcagtaaatattttaaaagtttggaccgagttatcagtttctgataaagctctcagcatgacggctgacacgctgcatgatgagcagaatgtcattggagtgtggatttacaatctttcttcctacacaaaggctaaaaggtgatgaataaacaaacaaccccattagcaactggaaaaattaattaaacagacatttctccagagatttacaaaagcacacaaaaagaagctcaccatcacaaatcgtaagagaaatgcaaatccaaaccacattgagacaccacctcccacacactacaatggctactattaaaaaaaatcagaaaataacaagtgttggggtgatgtggagaaacttgaacccttgtgcagtattggtgggaatgtaaaatagtgcagccgctgtggaaaacagaatggtggacctcaaaacctaaaaaaatagaattcccatgtgattcagcaattccatgtctgggtatgtactgaaaagaattgaaattagggactcaaacgggtatttgtgcaccagattgcaacattattcacaatagctgaaaggcagaagcaactcatatatagattgcaattgacaggcgatggacaagcaaaatgagatacgcatattacgagatacgcacttactaggaagtattattcagccttcaaaaggaaggacattctgataaaatggtacatgctggatgaaccctgaggacattatgctaagttacataagtcagacacaaaaggacaaatactgtatggtttcacttacataagctacttagaaaagttgagatcagaggcacagaaagtaggatgctgggggagaaggaaatagggagttaagtctcatgggtacagagattccgttttgaaagatgaagaaagttctggagatggttggtggtgatgggtgcacaacaacatgaatgtaccttataccactgaaatgtatacttaaaatgactaaaatggtaaattttctgctatgtatcttttgccaaaatttaaaaaaacgatttttttaaagggccaagaggtgatggaaatcctctccgctttttccttcttcagaagttttcttcccccttcagctcgctaaaagtgctaacttttaaatcctgttattttccaggaaggtgttcctgtgcagtttgacctcccggacccctccccagggaccaccgtggctgttgtggatcaaaatccctctcaggtaacacagggcccagccaatccaggctctcagatgccagttggccatattgaaatgctggtggatttgagtcttcagtctactagttgtcaatgccgtgtgcacctagagtcaccccgggatcattggcaacgtggatgcctgggacccaaccccagattctgtgtaaattgttctgagggtatggcctgaacagtggaaatttaagcatcatcaggttgagaactgctgctgtcctttatgtctgagtctatgtcttagaatagactcgtgcctgggagcctgaggcctgagccaaagtgagttcagggctcatggccagaggccaccagccactctggcctggaaaggtcagatgtttgaatgaaggtgctgtgcccagcagagactggggaccttgggcactggagaacaggggaccatgttgggttcagggccctgaactcatctgggggcagacaggcgttagtttgagggaaactgagtctttacctcactctctccacccctagaactcactttgctaccccagatctgcacctctgctcgactcagaactgcccttgacaatttcacttgatttttttgtcttcctcttcacattttattacaaaagtgcttgggccatgaaacctgccatgcttgggtccagtcttggtgaccttgggcatgttacttcacctctctgagcctcagtttcctcatttccagaatggggatgctactttttctgggttgctgtgaatatcaatgagatattgcacataaggcacctggcgtgatgcttggcacacaggaggtgccctgccggtggcatctctcctgccatctgacactgcaggctgcccctccccttttcttccttccttgtctcctgctgaccagagatggcttgcaggctttctcttggcacacagtgggctgtacccatcattgcaaagccctctcctgtgtaagcccagctgactgttgtcagtgtgttcttctggttggcatctgtctagttcatttccttccacactgtgcttcctcacctgtgcctctcctaggaaagggtgggcctgaagggctgatttagcagtgttggctgggaagggcggggtagtctccagggcctgtggctgcaaatagctaccttcttcttctttttttttttcttttttttttgagacagagtctcactctgtcacccaggctggagtgcagtggcacgatcttggctcattgcaacttctgcctcccggattcaagcgattctcgtgcctcagcctcctgagtagctgggattacaggcatgcaccaccacacccacccttaacaactattttctgaggaccttctgagcgtgggctggctatcagtttcagccccaataaagaaggccaaggtgaaggatgcctgggatccagttccagctctgcatctttgactgtccatccgggagaccctggatgtgccccttcccctctccaggcctctgaggggtgtggattcctcagggtgaccaactgtcctggtttgcataggactttcccagctttagcactgaaagtttcatgtcccgggcaaagtaggacagttggttactgtgcatgttgcatttcctctataacaagttggtggcctttttttggttgtgccaactccttatgggccctcagagaggccctttaaactccccaggcctctctcagtttcccatatgcaaaattacagggttgagtagatggtctctgaagcttgtggctagatttcaaattctacgtcagtgctattgactcgtgttcaccttcttctctgaaatgttctttgagtgctttttttctcctccccaagattttagtttaaaaaatacaaggacttcttagaggaaacgatacagacagaattaatcctttctcgtttgtgcacaaatagaccagctgcctgtatgtatctagaaatgtgtaatttccagagggttccccttgttaaatccccaccatggccctccaaggaaggtattttcagtctccattacacaggaggaaacaaggctcagagaagtgtagtaagttgcccaaggccacacaggaggtgagcacagaggcaggattcagacagtttgcaaatgagaggttgctatagcttcaacactgagagtctggggtgattgggagcatggttttgggtaggcacgttctgagtcctgacacttgggacttggatgctctcattccctatcggtgggaagagaagcccaagacaggcttctgatgggtatcagggcccttcagtgaatcctggttctcccagcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaaggtaaggaagcagggggctggggatggggcctgagtccagcctgggtattagaatctgttcttctctgctgcagggaaagccctgacaaggcctgcacagaggctccaacgtgcagaggtgaatgtgcatgagcctgtgtatgctttcattcattcaagtattcagtgaacgcattgagcagccactatgtgctgggtactgttccatgtgttagttaaccagcctggcgtgggccagtcctcatggggaaggcacaagctcacagccaagcacatgcgtgcacagtgagcctgcaactgcactctaatggggcgcatcagggcgtttctcatttttctggtagccagtgggagatgcgtgcagatgcatctaacagagagccaggaacacgatgcaggacaagtttggagatggcttctgggctcagactgcagaggctgttgctggtcatgcaaaggtcttaaccctagagcaacgagaagccatgaaggattccaggcagtgggaggcatgatgagcttcatgttctggaaagttccctgaggttgtagtgtgaagatatggtaggaaggcaggtggtcagggtgagagaggagctggcctgccccaggaggtagaaacctctggaagtgtttagcaggtaaagtccatagcacttggtgggagttggattggtggaagggggagcaagaggggagatgaaggcgtgaaaccagaacaaagtgatcatgagatttggtatccatgggctccaagttgaagtccagttatttctgctttcccctgcatgatgtggggcaaacctctcgtagtcttagttgatgtgcttttaaaattgggaaagaagtcacccctggcccttttttctctagaatttctgctacgatgattgggtaatattatgtgcatgcagagctttgtcaccggggtcaaggtgttgcaggtttattgatgaggatgaggatgctgatggtgatggagaacatgattctggggttggggagtgttgcatgtactgcactcagagcagcatacgcagctttatggatagctcctggtaggattctgtcccacacttggagatacatattcttattcaaaaactgagttccagaagtccttgtgcaaggtcacccagaggagagaagggtcaaaagacagattcaaaacatggtttgtctggatctgagactcagatccctacaacactaggcacttaagaaggcaaatgtagtggccgggcgcagtggctcacgcctgtaatcacagcactttgggaggccgaggtgggtggatcacttgaggtcaggagtttgagaccagcatggccaacgtggtgaaaccccatctctactaaaaatacaaaaaattagctgggtgtgatggcgcatgcctgtagtcccagctactcgggaggctgaggcaggagaattgcttgaacccaggaggtagagtttgcaatgagccaagatcgcaccagggcactccagcctggacaacaagagtgaaattccatctcaaaataataataataataataataataataataataataataataataaggcaaatgcacttagtgatcttatcagtcccaaccctctttgaggccaggatatgtgctcgcattcattcattccttggtcccttcagaaaatatggatggagcacctaatatgtggcagccactgtcctagcccaggagatgcatcttccagcagagaagagacagtaaggcaggtgcatccgaaaggagaagactgaggactgtgactctggttgaggtcactgagagaatgaggcttggtagagaagatgtccaaggactaggttctgggacattcctatgtcaaggtgtcagggacaaggcaaaaaaccagcacaggagactgaggtgtggccagggaggcaggagggaaagccaggagaatatgactccctggaagccacaggagggattgaccttatcaaatgcggctgaaaggtcaagtgaggtgtgtgctggggaatgaccattggatttggcctcgttgaagtcattggagacatagacagatgcatcttgatggaatgtttcgggtgattgtccaactggaacagtttataagaaattgggagaagagccaaccatccagtgagtgagcgccggcagaagcttccagcttatggtgaccagcagagacctctgtccgagacattcatggtagattcctgtgcccatatcaggacaggattgtctaaccagtgaagcagcaacagcatctgatgcctcctgcagctctctctggagcaagctcacagtgcaaattcctaaattattcccagagagctcggctctgccagtgactggcgcagagctgacttctctgcccatcatggaggcacagtgcccggtgttctgggggcccatgaaaatgttgtttttcatttttttaaattttaaggtcaggggtacatgtgcaggatgtggaggtttgttatataggtaaatgtgtgccatggtgatttactgcacagattgtcccatcactcaggtattaagcccagcatccagtagctcttcttcaagatgctctccctcctcaccctacgatgtgcccagtgtgtgttgttctctcccagaaaatgttttaatttctggaaagaaaaagaacttttaggccaagggcaattctttaatatatgcctatatattaaattatacacacacacaaatatatatataaatatatgtaaatataaatatatatatacatacatacagagagagagatggagtttcactcttgtggcccaggctagagtgcagtggcgcgatctcagctcactgcaacctccgcctcccgggttcaagcaattctcctgcctcagcttcccaagtagctgggattacaggcacctgccaccatgcctggctaattttttgtatttttaatagagatggggtgtcaccttgttggccaggctggtctggaactactgacctcaagtgatccacccgcctcggcctcccaaagtgctaggattacacacacacagtcatgcaccacatagcagtgtttcaggcaacggactgtgtatacaaatggtgattccataagatgataataccgtatttttactgcaccttttctatgtttagatacacgagtacttaccattgtgttatggtggcttacagtattcagtgtggtcacatgctgtacaggtttgtagtttggagccatgggctgtaccatacagcctatgtgtgtggtaggctctaccatctaggttggggttagcatgccctatggtattcccacaaggaccgaatcacctaacgatgcagttcttagaacatatctccattgtataactgtatgtgtgtgtgtatgtgtgtatgtctgtgtgtaaatatatgtgtatgtgtgtgaacatgtttgtgtatatatatatatatatctgtgtctatatgtgtatgtgtatatctgtgtgtgcctgtgtgtgtgcatgtgtgtgtatgtctagttgtttgtatatgtgagggtatgtatgtagtgcatgtgcctgtgtgtatatgtgtgtgtgcacctgtgtgtgtatgtatgagtgtatacatgtgtgtgcatgtgtgtatatgtatgtatatatgtattagtgtgtatacgtgtgtgcgtgtgtgtatatatgtatgagtgtttgtgtatatgtgtatgagtgtgtatatatgtgtgtgcatgtgtgtatatatgtatgagtgtgtttgtatatgtgtgcacgtgtgtatatgtgtgtgtatatatgtatgagtgtgtttgtatatatgtgtgtgcatgtgtgtatatgtgtgtgtgtatatatattttcatggaggaaggtgcccatgaaagcaaacgtgcctagggcccaggaagttgtgctgcggccctggccgtgctcaccctgcaggagtcctggcatttacttaatcctggcaatgatggaatcccctccacacaggctggggtgtgagatgtgtctgcccctttgctagctggggaaggagaatgaatgagtggcagaaactgctagttgtggagcccttggttggagccaggcctgtgggctttactgcaccccagctacagggaggtgactgagtccttgctgaggtccagtggcttcccagggccctataggcgccgagcacagggctagcgctgaacctgggttgccttactgcaaaggccagtcggacttgtgactttccgggctgtcaaagggacccctgtctctatgtatgatacgggctcaagagtggagattttggggagcaggggaggcatctcactcagatccaaaagaagccaagagaaagagctggggaagcccaggctttgggccccagagccctgagctggcttctgctcaccgctcaactgcactgttggcgactcctggaaagtcccctcctggttctgtaggatggcagtcctggtgaaacccgtgggctgtggcgaggatggaggtgctgtttgcacggagcatttccacctccccctccttcagctctctgctcagaggtcaccctttagataccttccctgccctgtctgaagctgtccccctggcagcctcgctaccccatcacaactccctgtttcttccttcagggcccttgccagctctgtgaagttgtggttgtttctctgcttgcttgcctgcttgttgccattctccccacaaccctgggcgctccccgaggacagttgctcctgttcactgtctccccagggccctgatcataacaaggccatatgtgcatgttcctctcctctctcctgtcaccatcacacagctctctttgctgctcttcaaacatagcatgcacattcccacctctgggccctggcttcagcagctccttctgcctggagggcccttccgccacattccagcccagtgctgctcatggactttccctgacctctttgtaaaaagcggtgacccctccctgcctgcgatcctggctccctccctggtttttctcttccccactgcattggtcaccagggcatgtcccacacttgctcatcagtcatttccccttggggaaggccagctgcatggtgacaggggcgaggctggtcacctctgtggggatgacgcctggcacagctggcgggatgaggtgcacagtgaatactttttacaaaactgatgaatatgtgaaaactcagtgatctagaatcaaggaaatgtattatcaaagggaatgttttctggatcctgccttgtaggtaaaagagacggaaagtagggttggaagcagaaggcatatggtagggtgaggctggagtgggcagaaggggatttggctagatttgtggcccctccccttttatccatgaggtctatggtgtcagtcccagatatccctagcagtgtgctataaagccctcagtacccaagggagagactctgtccatatcctttgccttaaaccccctgagaagacacattaattatgacattttggttaaaaagaaaaaatagttctcttcctctattgctttctggttggctctgagttaatgagaacattcaatcatccagaacacttggggcattccggctaacccagggctcgctgttcatgacctcatttccttacctcaggtacatttgctgagtgttcccacaagggccagcagggactgggatcaactctcatggagcccaggcacagtggacagtcaggtgacaggccctcatcaacctccgagtgtgacctgcagaggctgagggggccctctctggggggttcaggctgctgggggaggtgacagagtctgaagctgtgagagagatatgctggataaggctccatcttccagaagtatccatggggctcctgaaagccaaagacttcatgggaaatgctttcatggacaaaattgtggaataaaagtcaacttcaggataaaggagtgaatgaggggaacaagcaggcctggaagctgggtactgttttccaggacattgcctgagaaatgtggcatttccgtgtgctggacaccatcctggacagaggcaggcttttggaccagcagacctgtggcctcatcctgctgtgccccattagccaaattgcctcatgtctctgaacttcagtgtcatcttctagaaactagcccagagatgctaacattaccagccagagtgaaatcactcatgctagcatgtccagcagagagtgctaggagccggggcttagcaaacatcaacatcctttcttctttcttccctgtcccctactcggtcacgatcctcattcagagctcagccctgtactggctgctgagcctaacaatgagtcaaccagtccctgctctccagttgcttctaggacagtggaaggaggcagccaggtaaacagatacctgtagcattgtaaatgcagcacggacatttgcgccaaagcctggtgtgtgctttgtcaccttactccctgtgggtgctttactctcccattggaaggggactttcttgagggcagggactgcacagctctgaaagcgtcacaggacactcttgaaacagggaaacttcactttgctagaagggttctgtgctggtaacttccgttatcctggacaggggcaatctgggaagtgagcacacagtacctctaagcagccacacaggtggcagatgccacgccctttactcctacaaaggctcacgaaagccgcagactctcacactgctgtattttgcagagagttccaagaaatgcaggtcctttgtttcctagcttactggagtttagaggcagcaaattaggatttgaggggaagactcaggaccctagtgcatgcaagtacgttggcaatagcaggatgggaaagcaaagtaagatcgttccgaatagatccaagagtcatgataatctgaccactcttaataggaatccatctgggggccaggtgcggtggctcacgcctgtaatcccagcactttgagaggccaaggcaggcagatcacttgaggtcaggagttcgagaccagcctggccaacatggtgaaaccccatccctactaaaaatacaaaattagccaggcatgttggctcatgcctgtaatcccagctactgaggaggctgaggcaggagaatcacttgaacctgggaggtggaggttgcagtgtgccgagatcgctccattgcactccagcctgggtgacaagagtgaaactccgtctcaaaaaaaaaaaaaaaaaaaaaattcatctggggccattcagtatggagacagctatcccaaacctgtgactgcaacctgtgagcatcacaatagttagagtaatattataaatgaacagcaatccattaattaattaatccatgcattcattttgcaagcacttctggactctgcatgtgccaagcatgatgctgggcactggggatgtgaacataaacaacactttgtgattcgggaacatcagcaaaggtttaagtgcagtcaagggcagtgacaaccattactgctgactgagtgaccattatgtgcccggacactatactaaaatattttacatacattatctcctttaagccataagccactctgggaggtatgctttatttaatccacattttacagacgaggaaactgatgctcagagacttacggggcttggcacctttcacacagtaataaatggtaaagaacctaggatttctctagcccccaagatcaggcccatttttttctcccaccctgtctcttggaaccgatgtgcctgtatctcccaaaagtattccctgtatttatttggttgatggtattcaaaatgattttacgcggcataaaactaaatattttaaaaatatttcatcataatttccatgcatatcagaaaataaacatatcttgcacatcaaatcggcaatatgatgcttcttttaaaatgaatgtactgtacttgtgaaaatgtaagtcgatttaaagaaaacatcaagtaaatcacagtccaggtgatacgtggttatatatatagaaaaactcgaggagatcgagtgtacggatgatgtttgggaaaaacaggtgtcctagatttaagaaagcaagaaagaataaaatccactttggaaataatgtacacaaattcactacagcaggagaaatgtgggtgccttcgaccatgagcgttagctatctggaaacacgttaagatggatactgtgcgtttaagggatgccagctgattgcagagtgtcctcaacaggctccagcactcatgccaccatgtctgtttccagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaaggtgagttgggtcagggttggggacggggatggagcattggaggcactgtgttttccttcccacctaaactaggcagtcactacaacacagtgtgggagggccagcccaggaatcccatccctccataatggagcaaagaaccataacttgaattggagcagtgcagtgtctccctggggccagagtgaatccagctgaggagaaaagctggcctcctggggaggtggaacaaaagctaaaaagctgtgacttcttattttggcactttgcctttcattaagtatctgagagatgatgtgactggaacaacttttatggacattcaagaactaggggttcataaaactgaaatgatacgttttgtagcgttaaaaaaaagctcaccatgttccctggctgctcagcccagagtgctggcgtgaggccggcagcattctctgcttttagttcagaggcttattggaaaatgctgtgtgtgtgtgtgtgcatgcacactcccaagttcaatgctggaattcctcaggggtagagcttagagacaagaagagaaactgagacgaccagggaggtgctggtgtctcagatgggcaccaggatgagaaagaaccacttactcactactccctatgtgccttggatcagcataaacgctttatgagtatcttctgaatccttatcacaacacaagatccttagtcccattttacacatgagaaaaattgaggccccgagcagtgaagtggcttgcctttgctcacacagcagaacagtggcacagccaggacccaacttgagtctaagagatgcttggagaattcccagaacattatgtcagagctgattggaaacccacatccaggagtggggctcgtgaacatccagctcctggagagagattcaggccagggctggggcaacaggagttgcgagcacacagaggactgaatgatgacccaggtggcacaggttgagtctcagccctgccctttgtcacctgagtgaccgtgggcagtcgctctccctcatctcggttgtttctgcttcctgtaccataaataagagcaggacgatgctacaagactcagcggctgtagcccagctttggggacaggaagatgttcagattccgtttttccctcttttaagctacatgacctggacctcagtttcataatctgagaaatgggaatgaggttccaaagctcccatgtctgatctaagaaggctttggtgacgtaaagtagcagatgacctattagagagcccggttcgtagttggctcatggaagagggtaggccactctgctttactggaacagacacttgaaaagctggcacccttggccgggcgcggtggctcacgcctgtaatcctggcactttgggaggccaaggtgggcagatcacgaggtcaagagatcgagaccatcctggccaacatggtgaaaccctgtctctactaaaaacacaaaaattagctgggcctggtggcgtgtgcctatagtcccagctactcgggaggctgaagcaggagaatcgcttgaacccgggaggcggaggttgcagtaagccgagattgcaccgctgcactccagcctggcgacagagcaagactccatctcaaaaaaaccaacaacaacaacaacaaaaacgaaaagctagcatcctggccactaacctcagaatctgtccatgacagggatgctgagagaaggcactgtctgctcaggtatcaggctgggtatttatttgacattatcttgcagctccagaaactgtgtgcccagcctgagtcattccttcttgcatgaaacacatggcacgtgcctactgtgtgctaggcctggtctaggaatagcagagaggactttgacctctaagagagtacaggtgtcgtagcattgctgtaggtatgtaagtgacaagaatatccataggacagatgctctaagcctaggcagggagggagcatttgaaggtagaagacgggcatcaggaaggagctggcatttgccatgaagcaaagcctcacctggcaggaggggctgtgaatgaaggggagcagctgggacacatgactgtagaggaggctttaggaagccgaggagcaggaagcaagaaggcttgttccctttgccaccacccaggccaaggctttcccaagaacctcctaaagctcctctctcttttccctcctccccaccagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggtgagtgggcaccctgtctcatggtgtcctggccttcactgcctccatcctcatctcctctgggctgagtcatgtgcctacatcatctctaacctccccagcaaggccagaggggcgagtgtcaccccacgctccacagaggaggaaatgggggctcccagcagcaatgaaacttggccctggtcacacccccaggaagtgactgatccaaatctgaggcctaagcctgtgctgcttggtgttgagttgagaggcctgggggagttcccagaagctatgaatgccctcttgactccagtgacacatatgagagccagactagccctgtctgccttgctcaccactaggttcccctggggcaaggcggcaggacccagctggatgtaaatgtggtacctagacctggaatgtgaatccgtgaataaatgagaacatgagattggtcaatggccaggctgagcagaaatgagaatgggctgagacaagggaaggacacctttaaataaaccttatagtggccgggcgcagaggctcacgcctgtaattccagcactttgggaggccaaggcgggcagatcacgaggtcacgagttcgagaccagcctggccaacatggtgaaaccctgtctttactaaaaatacaaaaaattggctgggcgtggtgatgcatgtctgtagtcccgctacttgggaggctgaggcaggagaattgcttgaacctgggaggaggaggttgcagcgagctgagatcgtgccactgcactccagcctggcaacggagtgagactctgtctcaaaaaaaaaaaaataaagaaagaaagaaaaataaaatggacctcctagtgcgttatagtggaaatgcccttagtccgagtcctgagttctagtcccagctgttctgccactggtctgtatgacctggggccactcacttgctctctccatgcctcagtttctccatctgtttcaacaagaaccattatttctcatgagcacaaatcaggctgtaggtgggagctccttggtgtgggacataggggccccaaagatgctcaggttgggcttaatgaatatttggagagggtccagtcccctttctgtgtctctgtgagacaactggccctgacctccctctatttggtctaggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggtaagagacagctaggacacagcaccttgtctctgactcctgggacatgtccacccaccagtggcagccaagggatgggagcccctgccatgtgctaggagcttcacacccagcatcctggttactcttcccagcagtcttctgagatgaggccactgatgctcagagaggtggaagtacttgctcatggtcacattgcctggacgtggcagagcctggatcaggacccagctctctttgagtctgaagcccactgtttttttttttctttatttcttctgaaaacacacacacatacacacacacacacacacacacacacaaaatgggatacatgtacagcacgtgcaggtttgttacataggtatacatgtgctatgttggttggctgcacctgttgaaaaagcccatattatttctagaattgcctgtacactcctagaaaactagggctgtgtcttccttttagccatgaatttctaaggagcattgtcttgcaacagagggtggaattcctgtgatgagtgatattttgatgttcacgatgctcagtttggtttgggaggttgctgtgatcccaggagatgatgatatgacttgatgagggctcatagcacccagggatacgggaggccctgaggcctaaaggagggagcttcctactctcactgggagtttggggaaagctcacagtgatgtaataccatagtcaggccttgaagcataagaaactgtcacctctggcaaagggagggaacattaggcagagggatcagcaagtatgaaggatggaggcataaaacgggcaggttttcagggaagtggattcagaatgagtgaggagttgtgggagaagaggctgaggcatccaccagcgcaggctgggaatgcctctgttgggttatcaccaggtccacctggggagatgatgggctggcagggggatggggggattctaatcaagggattgaagtttttgggtctgtattttagtaagaaaatgtgcacctgatgtccccacattagctaatcttaggagttgagtttgatctcagtccttgctattcttttctgcctctcagtctccaaaggccaccacactgactcccctctctgacagttagaaatggctcagacaaggccatgctctctgcagaggacagggtggctgggacaggcagaagtctcaggtgagcacctcatttggttaaagtctccgtggtcactagtgccctagtgtatggtcgcttctcccatctccccctgctgggttaataagggacccctgggcacagagtatttgactgggagcagctagaagcaaagatgagaccctcactccgctgagcatatcaatgattttccctcccacccgcacagccgcagaggagggagacagataatgtcacaagagaagagggggatggtcacagccagtggctggtcccccacacttaatcgattctatttggctgcttggcaggaagtgctgggcctttgcaggcaccatgggcctgggtcagactgttagaatgcctgtgcgcacgcagggtcagggtgtcccgttcctgtgttcacgtgacctcacgacaccatctctgttctcagcacagcctagctcagccatgatgagctttccaactaagcgaagggttgatatctcatggtagaaatgtccaatttctgtctcctagacctggttcatttcctctttttatttctattgtaagtcatgtttgtctctttcacactcacatgagatagatttgtatgcatacacagatacgtcaaatatttattatttggaatctgtgcatatataatatatatatgcatatatacacatgcatgtgtgatgcatactcatgcatgctattgagtacctactacgtactagacactgtgttgtcacctatactaaatgagatcatttttgctgtgctaaaggtatgtagtaaacattcattcaacattacctatcgtgcagcctggtaggcacagctccaactctggagggaaatggtttggccttgattctggccaccacctctcaccagccgtgtgaccccaggaaattccctagagcttatctccctgtcctctcctataatagctcatatcgctgaaggctgctatggggctgggtgcgtcaataagacaataaagcttagaaaagtggcaggttgtggaagaacacataatacccattagccacttttactataattgtcatcgcatttaatcctcatagtgaccatgtgaagatagatcttgttatctcatctgacaagtgaagaaattgaatctcagaaaggtgaatcagttgtcccagtcatggggctcataagcacagagacgggacatgaatgcagataggtgtgccctaaaggaggctggtaacctcccaggtcccccatctctgtgctgtctgcatccttcaaagctggtctgagaccctcctcttccccaggaagtcttccaggattagccacacaaacaattgctgttcttcctagttgatgcatctggcttattgtgaagtctcaaaagtggagtgagattttaccataccttttctgatccagtcacttggggggtcttttttaagcagttgaggctcttcttgtacccagggaagagtctaaacctcgagacctggaatttgcgctcaatttcctttgggacctggtctctgctcgtctttggctactctccgctgcctgggtttgagtcccagctgagacagttactattttgtgttgtgtaactaggtgaattcatctctctggggctcaatttccccttttgtaaaatgaggatgataacataggcccatgagtgtctataacacgaggaagttgttaccctagtgatttgcacacataagctctcagtaaatgctggctgttactgtggactataaaataattttttttcttttttgggacagtgtctcgctctgtcacccaggctggagtgcagtggcacgatcgtggcttgctgcaacctctgcctcctgggctcaagtaattctcccacctccagagtagctgcgactacaggaacgcaccaccacgactggcaaatttttgtattttttgtagacaccgtgcccagccttggaatgtatcttatacttccctgttctaggtcttgtctgtacagccccctctgcctagacttctcttccataccaagttattttggaaaaccctatggcttcttcaaaaactgaatctaatgtcattttctcccaacagcttttcaggtgccccttctcttcccagttccccacatagaaggatgcagttgcgtccaccctgcatggtagacttacaaatgcccttagatactgcccaatgcagcatgcttcacatacagtgtatggggtggtaatatgtgttagacaaaacactttcctttgtcaaacgggtttgggaacctctgggctaacgttgggaaactcaaggcttatcaggcatctcccctgcatgagttctcagagcctttgacttggatgctgacatggctcatggaccttccaagaggcggatgagtgtgcagctttttcaaactttcagtggagcattttatagggttcgtgttctcaggaacacctctgggaagtgccaatcaaatatagtctcttaaattaacaaatggagaaactaaggtcccaagagatgagtccatgcagcaagttagtagccaggctaggaagcaggaccctgcactcctgtctaggggtttagggaactgggctgggtcttctcatctggactctgtgctcttctcctgcctgctcctacctccctaggctatgctgaccacatggggctcactcgcttccgccggcaattccaggtgctggacgctccactcctgaagaagctcatgtcgacctccgagggaatagatgaaaggaaggtaggtggagcacatgcgagaggggtgaaggccctagatatggatatgttggttattggacatgttccaaggctgggcacggtgagtggctcatgcctgtaatctcagtgctttgggatacccaggtgggtggatcacttgagtccaggagtacaagaccagcctgggcaatatgactttgactaaggtccagtgggctcatgttccataagggattgccccagggggcatctggaccagctggaatctgaaagcaggaccatgggggcagtgctgagggcagcatgaggtttcactcaaattcttgctctagaccaaacccccacaacaatgtcacttgggacccgactcagcccagaatgacccttctgacccctagataaggaactttaggaaaagaataagaatagagtcatgagaagagagcatcccagctaaaagggaccctagcaaggtgaaaggtcatcatttgcaaagtgtgttccattcagcaccagcaccctggggtggtctatgaaaagagggcttcagggtccaaaatgtttaggaaatatttacatcagggccccatgtttgagaattctgatgaacatcactccttagggcctttgcacgagctgttttctctgcctggagcactcgttccccgaatctttgcgtggctggtgtcatcttgctattcagatcccagctcagataccattcttcatcacatcctcttgttttgatgtttatgtagcacttatctgaaataatgtgaatctcctctgtgttttctggcttacagcaagagctcaataatgtttttgttgagttaatgaatgaatgaatgaatgaatgaatacccagacctaactttgtattgttgtccctgtgtgtcttctttctccaactacaccgtaaactcatggaatctcatctctacttccagtgccaaactttcaataaatgtttctcttgagaatggccacaggcttatcgatgattagagagcttgttagaatttgcaaagccctatttcatcttcataacagccctgcaaaagaagagctattacactccatttacaaaagagaacaccacgtttcttaagatgaagtggcactcctgaggccacacagccaggcatttgtgggtttgctccttggactcaagtttctcaattccaggggaggatagtttaaagagcatagttcataaagggaggtacttcaaactgacttgaatttgattcccagctggggctgtgtgaatgtaaactggttatgtcatctttctgcctcagtttcctcatgtgtaaagtgggaaggaccacaatgcagaaaatacataggggatccacataatttcaggataagtgctacaaaaactaattaaacaagaggatgtgatggaggatgatagctgagctgggatctgaatagcaagatgaaagagtactccatgaaactcgatggagtgttctgaggatgacatgtaatagtatagttcatgtaccttacacaggtcctgggacatagtaagggctcaatatacattaaccaccatcatcaacatcagcagcagcaccatcaatatcatcatcctctttcaaatccagggcgatgacacacaagcctcacagaccatgtgttcacaatcctgttgcaactgcatgtgcctgcgtgtgcctgagatcatcagcactgcagtcctcaatgaatgagtcagaagactagatgtaaagtcacaattcttaggtgtcttcttagttcttctttgcagtgggtaccagggcacaggccactttcagtagacaaggcaatgccttctgcagggccctcctaactcactatggaggggacatcacccccagatgtctgtggcacagggctgtcccttctctgggtagtggcccattttggaagccatgaaattctgcctgacttggtgccatcaaccactctgtagcagtcttcgttcatggggttccttattcttggtctctgaaaatttgacttcattcagaggggctgaatggagccactgagagggtcttgggctcctctgtggttgaaaatggtgcaggagtcaggtgtgggggagtttttttgtggaggcaaagggtgtagcatatggaagtgtttctactctgaatgagtcagcagttctctgttgtagccaaaccaaaaccacctccatacacgctagaggcctcagaaaatggaaaattacaaggagaatggacttggttgggaatttttgcttcttcttattctttttttatttgctcacaaattttatttgctgcagcatagaattttggtagcaacgaaaagaaacatcatcctgcctcttatgaaaaaactgataaatattcatttgccaggccacatgatatgccatgaattatacatgaacacgtgcttgggtgggcaaactatcagtttctgtgtgcaaagcagttaagacctcaggatttaataagacaaggttgacagctagaaaaggtcaatattgtcattagacactagacggcagcagaggggattcattgtcagggtgtaaaatgggtcttggtgaagtcccctgtgggtctaacatgtggggtctgaatgttggtgtttcatgccaagactgtttcccaatgaagtactctcatttggtgggtacctgatggatatattgtgttcctgaaacaaaaatagcatatgtcttttatcacagatgcataaactctcattataaaatatcagacatactatgaaaaggttacagaaccatgagctaagacagtattcaaaatataattcccactctgggaatcatcctcatttcacagcgtaggcagctgaggccatgaccacccagccaggtagtagtagagctgggatttgaactcaggctctcagattcctgacatagggcttaaaaaaaaattatggtaaaatacacatagcataaactttactgccataaccatttttaagtgtgttgatcagtggtattaagtacattcatatttttgagcaacaataagcaccattcatctccataactttttcgtcttgcaaaattgaaagttggtacccattaaacaataattcccgattcctcctcccctcaggctctggccatcatcattccactttctgtctctataaatctgactattctaagtccatcatagaagtagaatcatgccacatatgtcctttcatgactggttaatttcactttgcataatgtcctcaaggttcattcatgttgtggcaggtgtcagaatttccttcctgaggctgaaaaatattccattgtggatgtataccttattttacctgtccattcgactgtcagtggatgtttgggttgattccatgtttccttttcaacttttattttaagttcgggggtacacatgcaggtttgttgtaacaaacttgtgtcatgggggtttgttgtacagatcatttcatcacccaggtattaagcctagtacccattagcccattagttatttttcctgattctctccctcctcccatccttcccctccaacaggctccagtgtgtgttgttcccctctatgtgtccatttgctttcatcatttagctcccacttataagtgagaacatgtggtatttggttttctgttcctgcattagtttgctaaggataatggcctccagctccattcatgtttctgcaaaggacgttatctcattcttttttttttttttttgagatggagtcttgctttgttgcccaggctagaatgcggtggcacgatcttggctcaccgcaagctctgcctcccgggttcacaccattcttctgccacagcctcctgagtagctggaacttcaggcgcccgccaccacgcctggctaattttttgtatttttagtagagacggggtttcaccatgttagccaggatgatctcgatctgacctcgtgatccgcccacctcggcctcccaaagtgctggcattacaggtgtgagccactgcgcccggccctcattctttttttgtgactgcatagtattccatagtgtctatgtaccacattttctttatccagtctatcactgatgggcatttagggtgattctatgtctttactattgcaaatggtgctgcagtgagcatacatgtgcatgtgtctttataatagaaggatttctattccttcagctatatgcccagtaatggggttgctgggttgaatgtacaaatatctcttgaagaccctactttctttcttttttttttttttgaactcttgttttaggttcaggggaggtacacatgcatgtttattatctaggtaaatttcatgttacaagggtttggtgtacagataagttcatcacccaggtaataagcatggtacgcaataggtagtttttcagtcctcaccctcctcccactctttaccctccagtaggccctggtgagaccctgctttcagttttttggggtatatacccagaagtggaatagctggatcatatggtaattctattttaaattttttgatgagctgccatacagttttttatagcagctgtaccattttgcatttccaccaatactgcacatggatggcaagttctccacattcctgccaatgtgttatttcttgttttgtttttttgatagttgccatgctaatgggtgtgagatagtgtctcaatgtggttttgatttgcattttcctcatgattaggggtgttgagcatcttttcatgttcacacaggagttgaatagaagccctctgagggcaggcaaagtatttagtgcagttcgttacaggacatgccattcatggatattaactttaaataattatcattaatttcatccaactttaaccaagtgcctgcttttcaccagatcctgtgctaggcaccagcaacttccatacagagctggctttgggacaccccaggagatgccactaaaacatttgatgtttccaagggaggtgagagtggggcactcagggaagacatttcagaagtaggtgatgcttgagatgaggtttgtgaaacactctggaggaactgagtaggagaaaggttacaggacattctcatgttgggtacaggattgcaaagatctggagtcatggaggtgcatagatagtttcgtggtgctggagcataaaagatgccaagtgccaagtaaaggggctgaggagtttgacagaagcaaattctgggttcttgttagccaagttagagagtctgggctttatcaggtgttcagtgatgctcctctgaagggtttcagcaggggcgtggcatagcagacctgatctttgtgacttgaactggcttcagcaaaattatgaaggaagcgaagtccatgctgcccattccatggtcctctctaggaagcagtgtcctcttgctgacctctggctattccagaggcccctgtctcctctagacacccaggcacatactgaagcctcccaaatgaccctgtcttctccctgtaatcatcttcagttccattcctgtctcccaggctacctcctctggttagatgatgctttaacctacaccaaagcctacatagagtgaatacaagggtggaatctcaggcaggtcagtgaaggcactctttcagctcaccttggctacgtcccagattctggtcccttccatttttctgctgctgaagcaggagttgccaagtctatctgatcgatgtgaggaaacccttgggcctgccctcctccccgcaaagtgtctacagtgttgattgattttagccggcaaaatctctgtccctgaggacttgatctgaagaacataattaagggctgtcaatccgtcttctcaaaggcagccactgttattctgtctcccaccctggcagacactcccagtttcctgtgaattcatctcaagagtctttatctgctgggaagaaacccttatgagcccatggccagggagggagctgtctgctctctaggtgctgaataattattcatgggctcccaccaccttcgctcctgaaatttattcatcatccctttcttgttcaccttgctgtctccctccagtttgggtctattgttttgtttgttttttgagacagagtctcgctctgttgcccaggctggagtgcagtggtgctatctcggctcactgcaacctctgcctcctgggttcaagtgattctcctgcctcagcctcctgagtagctgggactacaggcatgcgccaccacgccaggctaattttagtacttttgtagagacctggtttcgccatgttggccaggctggtcttgaactcctgacctcagatgatccaaccaccttggtctaccaaagtgatgggattacaagtgtgaaccactgtgcactgtgagctgggtctattgttttaattattttacatgttttccactcaattttaatcaacccaatgtaattggtgtgtgcatgtgcatttggtttttggatagtttctgcctttttccaggcatttcgtttataggcttgagcataaatagttaaaaaacagacacagttagcacccttatggaatgatttggccacttgtgtgagaggctcagtggttaaagtatgtgatttagagtcagatagacttgagttcaaattgtgtcttcttccatatctctctctatgaatccacgcccttgatacttgatagctgtatgaccataggcaacatatagtatggcatagcaaagtgtctggtacattataggaactcaacatatggaagccattggaccatggtgtgggcttcatgggggcaggtgctatatggacggcagccaaatggttcacaggatgagtatcctattccatagacacagattcttcatatcaaactgttcattgaggagtgagttggggaagcactttgcagctatggctcttcattatttctggagtctctctgcctgtctggcatatacagccaaatgtgagatgtcagcccatatgcttttcgggtacactcttcttgaacattggagagaaagctctttgcaaaattctaggaaacaatggaactctgtaagtgggggctgtgggttggatgtgactgaaatcagttagaccccaaaatctgggctcaatttgacacaggctatcggaattttcctacttaaggtggagagatctcaggtttgccaagagccatgtttgctgaggtgtaatgttgacttacagtgaagacgatgacccatctatgctcaatgcctgggatgcttcactgaatgaatcttactagttgtgaattcgaagtgggatagcttaacaggttaaggatacagattctggagtcaggctttctgagcacatactgtgtctaatctgctcactggctgtgtgacatttgacaagtcactcagcctttctttgacttagttttattatcttaaaatggcatactaatagtttctaatactgttgataggaggattgagcaatttaacgtattgacatggtgactttcatatacacagagtaaataataaatgtaatcaattatgattttgttgtaaaaatagtaattttactatttctatggattttaatgccccttctatacaatgaaggctttaatatttgccttaaaaacctcaaataattgttaagataaaatattttttgattaatagtagtagatatttaatcaactgatcatctctaaactacatttggatagtttttgattttctgactattatgaaaaaggatgttgtgaacatttgcatatcagtctttgcacagaaacatgtttctactttttttgggtgcattcttggaggagaattgctagtttatatggtaaatttatgtgtaacttttaaatataacttttaaagaaactgtcaagttatttttcaaagtggctctaccattgttcatcctcactggcaatgtgtgagggtttcattttctatccttatcaatacttggaattgtttgcctttttgattcaagccattctgttgtgtgcaaagcggcatctcattgtggttttaatttgcattttccctaatgatgttgacttttttttttgcatgtgcctagtagccattttatctctttttttgtgaaactctattttttttgcccattttaattaggctgtttatcttatagagttgtactagttctttatttgttctagacataattatttatcagatgtatctttgaaaatattttcttccagcctgtggcttgtcttttcattttcataatgatgcacagagatttttatgaagttcagtttactaattttttaagtgactggtgcttttttcatatctaagaacgctttacctacccctcggttacagagatattctcccattttccgctacaagatttgtagttttagctcctccgtgtagacatttgatctattgtgtgttaattttgtgtatggtgtaacatacatgcctatattcatctttctgcatatggatattcaattgtcccagtaccatttgttggaaagactattatcatttctcccagcgaattgtgttggaacctttgtcaaacatttattggccataaataaagagtttattttcgtaatctaaattcattctattggtctgactgtactaattagtagcatctctttctttctgcctctttattccttggtcagtgtaaataaacttcatcagttttgtcttttcaaaggacaaacttttgatttcactgattttttttctctgttgtttttctgttttctttggttctattgtcttctattgatttccactctatgttacttccttcctttcacttgatttgagttttctctacttttcctggtttcttaaaaaggaatcttgctcaaattattggttcaaaatccttctcctcttccaatatacatggttaaagcatacattttcctcaaagtactactttggctgcatcacacaaaaattttcatttagttcaagatattttctaattcctagtgtgatttcttctttggcccgttgtttattaagaagtgtattaatttctacatatttggaactttctcaccttttttcttgttggtttctaatttaattccattttagtttgagaacatatgttatatgatttcagtacttttaaatttatttttgtttgttttattgagacttattttgtggcctaatattatatatctaggagagtgttcaaagtgtgcttataaaaaacatgtattctgtggttgttgagtagtctatagatgttagttggggcaatttggttgatagtattgttcaagtcttatatatcattgctattttttttttttttgagacagggcaggctcttgctctgttgccctggctggagtgcagtggcacgattatggctcactgcagccttgacttcctgggctcaagcgatcctcctatttcagccccctgcgttgctcagactacaggcatatgccaccacacctggctgattttgttttttagagatagggtcttactgtgttgcctagtctggtctcgacctcctgggctccagcaatcctctggcctcagtgtcccaaagtcctgggataacaggcgtgagccactgtgcctggcatgttgctatcgtttatgtttaattgttctgtaaattattgagagtcaggtattacgctctccaactattaatgttaaattttctatttatcctgtcattctatgcatttttgcttcacatgttttggggctctgtggttaggtacagacatatttataatgccgtatcttctggatggattaaccctttgttgctataaaatgtctccctttgtttctagtaatgatttttgttttcaattttaaacaaaatttaaaacaaaatttgtctgatattagtatagccactccagctatcttatgtttagtgtttacatgatagatcttatttcattttcccccttccaacctatctttgtatctaactgcatctcttacagatggtatatagttgaatctttttacaaaatccagattgacaatctctgcctttttattaaggtgttcaatatattgatctgtaatgtgatttacattatagccattttgctattttctgtatgggcttcacgccttcttttagtcctatcctccttcacttccttcttttgtgtaaactaggtattttccaaggggccatttgaacaccccttctagtgattgttctacggtttacaatatgtattgtaattcaagatgctccacttcagattaatactaacttaattctgggaaaatatagaacctttgctccaatatagctcacgtcttcctcctaccttagtgatactactgtaatacacagtccaccctccatatgtatctgtgggttctatatccatgaactgaaccaacaactgactgaaaatatttggaaaaaaaaggatggttgtgtctgaactgaacatatacagacttattttcttgtcacggttccctaaacaacacaatataataactatctgtatggcattttacattctattaggtattataagtaatctagagataaagtatacagaaggatatgagtaggttatttgtaaatactgtgccattttatataaaggactcatgcatctgcagatttttgtatcctttggcggtcctggaaccaattctccatggatactgagggataactgcagatcacatctatatatgttaaaaaatcaacaataaagctttatgattttcttttatttaatcttatgtcttttaggtaagttaagggaagcaaaggaaaaaaatgaagatttttacattttcctatgtgtttttgttttcccatgctctttagtccttaagtatttgaattacgtgtgatatgataccttgcatcctgaaggacttcctttaatgtaagtgaaacagtaaggcaggtctcatagcaataagttttctcagcctttgtttacctgagaaggtccttacttcaccttcatttttgaagaataattttgccagatacggaattcctgattgacatgtttgttttttcctttcagcacttctaacatgtaatctcactgcattctggacttcattgtctctgaagataagtcagccactaattgttttgatgcttccctttacacaataagttattcctctctttctgctttcaagattttcaatagtttataataaatcttggggtggcttctttgtgtttattctatttggaattcaatgacccgctaggatgcatagactttttttttgggggggggtgtcaaatttgggaagtttctagccatcatttttcatactttttaaaatctttgtctttctcctcttcttctgagactcctgttgtgcatatattggcacgcttgatttgccatacatatctctgaggctctatttatttttcctccttcctatttctctccgttcttcaaattggatagtttctattgatctattttcaagtttgctgactctttcatttgacatctcagatctgttgttgagtccctttggtgaatttatcatttcagttaatttacttttcaaatgaagaagttccatttggatcttttaaaaataatttctatcttgttattgacattttttatttaaggagtcattattattacactgtcctttaattcattaagcattgtttcttttagttctttgaacatacttataatagctgttttgaagtgtttggctgttaagtccaaattctgaacccacaaagatactttctactgtttcccctcacccttagtttggatcataattttacgtttattgcacatcctgtcatttttgctgaagactggacatcttagatgatacattatagcaagtcttcattctgatcttttcttaatcatttagtattataacttgttttgactaaaattacaggatctgtctcctcatggtgtgggaccactgatatctctgcccaatttttaaaaatttgtgtttttattttaaatctgacttcccaggagttgcgcctatgtctgcatagcttagagtcagcagaggttgttatcaaacatcttgaatatttgaggcttttccattttcctgttggatctgtgtgggggttgggaaatgtactcagcattcaggcagttcccagttatgcttcaacctctacgttctgtttggccctttcacatagtttctgcctgtacacatggcttcatgttcaaataaatagggatatgtagatagtgagggccttttccagtctctcttattcttgtgtttagcctggagccaggaatatgtgggaacttatcaagcccactgtggctgtcctatttcctgtgtctcctgttaaatttctggcatgtttaaggtccagtgcttgcctcaatcaggacaacaaccttaggcttagctgtgccattggccttcctcatttgtttcctgccaaaattgctactgtttctgacaatgctcccaggtgtgggttttttccatgctttgctccatataggtgagccccttctggaagcaaagctgttgtttttcacagctgcctcaccctggaagaactactgcagagagagagagacagagctggggtgggtggtgagtgggagaacctgtaatcaatattgccacaaactctcactgtttctacctgagatccaataggttttcttgaataaatgcttctcattttgttgtatcccattgtccaatttccagagtattgaacctgtggttgttggaaattttatccatatttatcttgttttggggggaggggagaggatttattaagctccttcctccaccattctggaaatatctcccttatatgctacttatatgaccttattaaatctccactacatccttgtgggacaggcgtgattacaccatgttgtagaaagcaaactgaagaccagagaggaggagaggcttgctcagggtcacacagctagtgagtggtggaactgatcccagcgttggagggtggagaaaagatcaggagctgattccttgggttcaaaccccctaccatcacttcctaaacacgtgagctttgccaagtcatttaattgcactgggcctcactttcttcctctgtaaaatgggcatgaattagtacctgctgcagaaagttggaaacaaaacaagttatgtgtaaagcagttggagcagggctcagactcaaaaacagactgaaaactgtgttttcttggagaaaaatggccacatttgactcacgaaaaagcagcattttatgctgcaaaggataagtttcaattacctgggcaattccagtacatggaagaggtgattccataaagacacaggacaaggaggaatttcttaacagtcacttggatccttgctgtgtctttttccaccaactggttgttggacaatgattatgttatgttgaactaaatgaagtgattgatatttgacctaaaccaatgacagtttcgtatggttcaatctaattgtaacgttaaatggggataaaaataacagcatttaagtgcaaagtaatttataaagtccttttcatatagtttcaattaattctctgaattgctgtatggtccaggcagggaatattctcaccactttgcaggtggggaagagggtcagttgtataatttaatacctgcacttacccactcatgccactgtttgaatccaagctttgttgtatgtaaaatgagatcaacagaacagaatatctgtgttagggctaatgttctcagctacatagacatctaaagagttctcagaaagcaaagagctggaaaaggagtctcagttatggtgggttgagcatgtgctttggcagggtttgaagtgtatctgagaaatgggggccttcattcatgttttgcagcactgttccaaggttttgaccaaaacagaggtgactataaggatgaaataactcctaacatttattgagtgcttactatatgccaggtgctatgtagccctgcacaagcacagcctcagaattttctgaaacaggtgccgttattgtccccatctttctgaatggagtctgaggctcggagtaaagcacttccccaaggccacacagtttatggagtgataaaaccaagatctgaacccagatggatctaactctggatcatgattttttttcccccaaaacatctgccatagactttacctccaaggtacacttagaaaaatttcattggtcatatatttccttttaaaaattcatccatcttatcttcagtcaattttttattgtttttttttcttcttatgtagagaaaaaaggcattatattttggatatattggttttattcatttctaccacctacagctcccttggaacatgtttggctaaaatgtgataagtgaaaccaccgacattttggaagagtgtcatggaatgttcttccaggaggttggaagatggagcttccttcctgattgcagtctgggactagactattaataaggattttttttttgatatcttaggaagttttctgtgatgtctttgacccatggaattgaaactcatttactaaattactccagcctcataataccttttgcttcctgagcattgcaattacttttctgacagtttattcttaaaatagactttctgattttcagtgagtgaaagaccaatgagggggtagtatgagggtgggtgggaggggaattggcagtcactaagcaaccaggcacaacctgggtttatctgagagtccaaatctctggctgattgtttcaaagcctgcaccactatttgacaaggggaagattccattaaatggcgattagtccatgctgtatccagaaatctctttgagtaaaattgtttctcctgcatggggctgcttttcctccctatggaatctctctggtttgggtgtttattcattcagtcatcatatctattgggctcctactgtgtgtatagaacagtactataggctgggcacagtggctcacacctgtaatcccagcactatgggaggctgaagcaggtggatcatgaggtcaagagatggagaccatcctggctaacatggtgaaacctcgtctctgtgaaaaatacaaaaattagccgggcgtggtggcacatgcctgtagtcccagctacttgggaggctggggcaggagaatcccagcctggtgacagagcgagactccgtctcaaaaaaaaaaaaaaaaaaaaaaaaaaagaatagtactatagtgcgtacagaaaacacaggctcctctgccataatgtagatcaggcaggtgaggttattgaccatgtcatttatttagcaaatatttgtgggagtgaggcagtcaccagcaagagcaatgagagaagcatagagcggggaggctatcacaggaggacttagtgaattactaggcacgcagtactgttcaagacatagctgtggccagaaagaacttaatgggaatctgtctctgccctgtgtgcaaacttgtaatcttgaaaaaaagccccttcatttagtttttgttgtgtgtgtgtattaaaatatatataacataaaagttaatcttaaccattttaagcatacagttcagtgacagtatattctcagtgtggtgcaactatcacaacatccatctgcacaacgctcttcctcttgcaaaactgaaacgttatacccgttaaacaataagccttcatttccccctgtctccaacccctagccaccataattctttattctccatgaatttggttactctaagtacctcctttataagtgaaatcatgcagtacttgtccttttgtgactgacttatttggcttggaataatgtccttgaggttcatccatgttgtagcatgtgtcagaatttccttcctttttaaggctgaataatattccattgtatggatagaccacatagtgtttatccattcatccatcaatggacatttgggttgcttccacattttgggtattgagtataatgctgctatgaacacaaatatataaatatctcttcaagaccctgatttctttctttctttctttcttttttttgagacggagtctcgctctgttgcccaggctggagtgcagtggtgcagtctcggctcactgcaagctccgcctcccaggttcatgccattctcctgcctcagcctcccgagtagctgggactacaggcgcccgccaccatgcccgactataattttttgtattttcagtagagacggggcttcaccatgttagccaggatggtctcgatctcctgacctcgtgatccgcccacctcagcctcccaaagtgctgagataacagccgtgagccaccgcgcccggccaagactctgatttcagttcatttatgtatatacacacaagtgggatggccagatcatctggtaattctatgtttaattattcgaggaacctctgtactgatttccctaacagctgcatcctttatttcatttcgtatctttggttttctgctctgtaaaataggaggatgaaacaaattggtgtgtgtatgaaggcagagtggatggcacacagtaggtgctcagcacctgcaccttcctgtgtgaggtggggctctgttagccaaagctcacagacatgtggggtcatcctccgtcctggcgcatcagccatcgagccagcttgactttcccctttaggatcctcctaccttctatgctgtctaacttctctctaattttttccccaggccgtggaggagctcctggagaccctggatctggaaaagaaggcggtggctgtggggcacagccaagtgagtagagctgctttcttacaacattcgcccatcacatcagggacccagagatgacctgattcttgtcctacctcaattgtctattatctctgtacgtctcctttttcccaaactgaaggtagagctaatgattttctgccctgcctatcttacaaggtcctggagagacaatgtcataatatgagttgaaatcacactgggaaatatcatttcttggaggcttcactcctggggaccccaagtggtttggaggaattagcattctggtcctcaagatgaccttctgagtctcagaaagagctgccataaaacctgagaagaactgctcatcttcactcacagccttttaacttctgctttgcaaccagctctaacacagctatagtcatagctgatgagcagcagtaagggaaaagaaagaaggggcttgagaggaaagcccgtgattattcaggttgacagaaatagcttttcccaaactggtgttgagcccaaagctcttccaaatatgctcagatgtttagaacagaatttcacacttccccgatatgcttatatatgctgaagttttcaaggtgggatacatggtatttagggtttctcaaactatttgactgtggaacccccagccttttgtttgtgtggaatacctagtaccatcttctggagctagtgttccatggattatagtttgggaagtggggcacggagattgtaaactcaaggaccaaggagtgggggcaggggaaagggacacagtttagaaatacaaactagaggccgggcgtgttggctcatgcctgtaattccagcactttgggaggccaaggcgggcagatcacctgaggtcaggagttcgagaccagcctggccaacatggtgaaacccccatctctacaaaaaatttaaaaattatctgggcgtggtggtgtgcgcctgtaatcccagctacttgggaggccgaggcaggagaatcgcttgaacccgggaggcgaaggttgcggtgagctgagatcgtgccactgtactccagcctgggcaatagaacaatactgtgtctcaaaaaaaaaaaaaaaaaaaaaaaagaaggaaggaaggaaggaaggagggagggagggaaggaaaactggagaggaacagaccaaaagaaagactactccacacatttccccacctagttacttactggttgatgaatgccatctaagaaaactttgtcaatggccttccacctccaggagctatgtgaggtggtgggagggttctgctctccaggagcccaccagggtggcattattggctatttgtacttcatggagccctccctatcatatgcatccgtgagagtggtcctttactcagggagctcacagtcatctacactggctaccacccctcagcccaccctaaacacactagtgtctccccactggcctcttggtcctgctaaggtatatggcggaacctgttattccgctgtgatctcaagatactttatcctgataggagttgcagcatcccaagtctttgaagcctttttcaatagagagagtaaacctgtcagttactggactcccacgcactatgtgaggcaacttcacgttttgttcttctttgttcctcactcacagtcttctgtgagatatcaagtgtgttcctgctttacagatgaggaagctgtgcccctgggaaataagcctcttttcaagatcctatctgtagccaagggttcagactccacgcaaacctgcattggtccaaatgccagggtcttttccgtacactctgggtcctattgtttatgaatggaaatgcagtcacgtgtggcttaacaatggggatacattctgagaaatgagtggttaggcaatttcttcactgtgggaacatcacagagtgtactcacacaaacacagatgggatagcctaccacgcacctgggttagatggcacagcctattgctcctaagctacaaacctgtacagcatgtgactgcactgaatactgtaggcagttgtaatacaatggtaatgacctgagtatttaaacatagaaaaagtagagtaaggatctgagtatttaaacacagaaaaagtagagtaaaaatatggtattataatgttatgggctcgctgttgtgtatgcgtctattgttgacggaaatgtcattaggcggtgcatgactgtacatgacatattctttacagatggatctttacggtcctgaatctgtggaattgttcttcagctccaggaacttcatccttctagaccagcagttctcaaagtatgggccctgaaccagcagcatcagcatcgcccaacagcttgctagaaacaccccagacctagtaaatcagaaactctggaggggggcagggctggcaatctgtataacaagccctctaggtgattccaatgcactctcaagtctgagaaccactggtctagataatgactcagttatgtcataaatatgaaaatcagtgcctatgatcctggcagctcttgcagaagaagaaagaaaacagtcattacatgcagtttacagtggcaggagtaagaagtctgtacacctaaacattcagataataaaatatgactattattgaataatacttggtattgactgagaaactgtcaaaagcaaatcaaggtcaatgtgtccttttggaggccaggctgggggatactgagacctttaagggcagatgcagcatcttacgcattgcaggattggcatgtaataatggagaaggctatgaagctcaggggacaagagaatcggctgacccagtccacacccaggctccaccacttcctaactgtgtgaatcttcagtgactggtttaacttccctgagcctcagttatctgtaaaatggggccattactttctacctcccaagatggctgtggggatccataaagtgtcatttaacagggggtggctgtcactacttgctgaatacatttgtcagtgaggcaagaggcttatcaagcaggataacattttaatgtttaaagaattaaactcctctaatctgtaaagtgactaagaggagaggagctaattccttggcggtaccagatatggaagctgtttccatatcagatttttttaaaacctgggccttcagcattgttagaggaaaaacagtttgcgtggttttgtcccccgtggattccttaaaagtggggctttggggatgttacactctgtttgcatccgataagctgctggacccatgaaaagcaaataatttagatttttcttcgtgatttttcagcctctggcgccttatcaaggcttgtgctgagggccatggcatttgtgggaaaggtgtgattccacgtgcagtcggccttctggtcggcaatatgctcttaaaaggcaaaaaaaacaaaaaacaaaaaacaaaaaaccagagagaaattgagataagattctgcaaaggcttattcccattctgtgtatggttgtttccaattatctttttaatgaaagcttcataatcaatagtggttttggcagcacccgccatctattgtaatatacgatctggtgctgtcataactttgatcattgattttttttttatagcagcttttgggactcactagcttgtgaaattaatacagtcattattgaagcaatctgataggtaatgagccaattgtgtctttatttcaatgagactaatggtcttggtggccctgtctgataggaagtgttctgcaaagccatggagggttaggaaacagagttagtaccaactgggcatgctaatttttattttcccattgagaaaaggcatagtgcaggatggtcggagatgagtggtctccattacgaaaaatagggtttagggtaatggagaatcgatcgagaccctttgttccacctggaatcaaattgcagttgaacctcgcacttcaagtgcttgtatcataatggataagaaaaggcagcttcatgttgacggacattgagaatgggtgcaggaaataaacctgaagttctgggctcaggtctcagctttgttggcaactgattctgcaaacttgagtcaatttcataacctgcctgagccagtacattcctcatagagctgtttgagtattaaaaagagacctaggagaaagcactttggaaaatgtagatgcatgtaatgttcatgctattcagtgataattgtacccttgtctgaagtcagatagaggaaaataaatcctggtgttgccacttgcttgtaaaggatcgtgggccaatgccttttttttttaagccttagttttttcctccataaaatgtgagaatcatcgtaactaccatataggattagacatgtaaagtgttttccctgcatgtcgagtggttgtttagtccagttccaaaacacagtaagtgccccctaaatgttatccattaattgataatgtcatcaatgaatacagagttatccagtgtctccagataaccgcctctgggattataaaccacatgtgacaaagaaacacatgggactctttttagaaataagcagcataagggcatcagaaaaatgacttcttcccctgtcactgactgaaatcccaccataagagcatttttcctctgcctctgggaagttgagaaaatgaccaaagcaaaccagagctacccttgcgcattggcaggagcaggcctggcccagaagcttcaggttctcgcagaaaagcatttaactcaaacctccaggactctctgccttaatcttttgctgacagtcagtcctggggtcctagcttccctcattcctgttccctgcagtctactagaaggtggctttgtggggtgccgaggaggcattgatcagagtgctgcagaggccatcatccattattgatgagttacggtctggaaatcgtgtaccgagagctgttttctgctagatccctcagcacctctgtgggtggcaccagcccagccccatcctctccagaccaagaggactgccatcccttcccccactgtctctgcccctccttacaaggctggactgaggtgtttcttttttctttcctttcttttttttgagatggagttttgtctgggctggagtgcaatggcactatcttggctcaccacaacttctgcctcccgggttcaagcgattctcctgcctcagcctcccgagtagctgggattacaggcattcgccaccacgcttggctaattttgtatttttagtagagacggagtttctccgtgttggtcaggctggtctcgaactcctgacctcaggtgatccgcccacctcagcctcccaaagtgctgggattacaggcatgagccaccacgcccggctggagtgagttgtttctaagccactgcttcactcagattgctgtgggtgcttacccaaaatattcacattcccaggcctggccctaaacccacaacccagcctttcctggggcctgggaatctgcatgtactgcactttccaggtggtgaccgtgcacagaacagtttaggcaagtccatgctagctgtgcttctcaaaggaacgtgcacaggaatccccgggggattgtgttaaagtgcaggttctgatttagcaggtctggaatggagtgcgagattttgcatttccaacaagcacccaggtggtgccaatgccactggtgcgtgggccacactgagtatccagggcctaggggaagggagagaggagccatcagcagacaaaatgctttgataatttagactcccccacctcccacttaaagggcaactgccaacaaatattgcaggtgggtgcaagagaagtggggtctgatttgcaagcacccccccattgtagacagccttcttcagcagaggactcacctgaaaccttccctctccccaggtttttctcaaggcaggtgtgatctccaggcttgagaagcagcgagagaagctggtatctcagagcatcgttctcttccaggcggcttgcaagggctttctgtctcgccaggaattcaagaagctgaaggtactgcatgccgttcccatgaggagtctgatccaacgggtctggagcgggcatagggtctgcctgtctttcaggatgataccggtgcaccgggtccaaggatccaacctgagcagtgagactttaagtgaggctttgcaagatgttatgactgtttctgggacattgacatcaaattatccatgaggtcggccttgcgctaggtagccatgaggttgtccaagccctcctgggctgattcatgacttcaacctgtcttgtttctggagaaattcactttcacaggtcagcagacagggcatgaccagggcccagccactgaggttttggggaccaaaggccaagtcaagcttgaagcactgacccatttagggtcaccatcttcagagatctctggagactgaatttcctctctgtagctgcacaatagagagaaaaccacgtggctctgggaacaagtattatatatgttcgaattccacctctacctcttagtagctgggtgaaggtgagatgaaatgatgtgcacttaatacagtacatggcacatagtaattgctcaataaactctagctgctattaccttagaattgttattcttaattactgctactactagaatggagtcttgttgtatgtgcctccagtttatgtgaacttgtaaactcaagtatatgtacttggcagaaagagaaaaatgatgagaccgtgaataatgaacatattgtgggcaaccccactggccttctgtgctcatgtagctcataccttggaatgatgtggaatagagtttcagaccctgggctctgcagccagactgcaagggttcaagcctgctctggcactgagaagctgggtgacactgggcatgtgactttacctctctgaacctcactttccccatccgtaaatacataaaataacatgatcttcctaggactatactgaagaccaagttgaggtgtgtgagatgctcagggcagtgcctagcacttacgagcctcaatgtctgctgcacaagaatcagctgctgtgatggtgatgagggaaaagcatctcttggcctgtctgccagtcagtgctgttctggtcccccccccagtgataagaatgaagcgggtcaatgcttctcaaactgtggtcccagaccagcagcatcagcatcacctggggatttgttagaaatgcacatttgcaggctccatcccagagtggctgaatcagcacctttgggggtggtgtctagccatctggggtttaacaagccctccaggggattctgatgcacattcaagtttgagaagcatgaaattactgtttaaatacactgtgaaaatgatctcccttcaatataagctaataacataatcgtggacattgttatttgtgggcagttttagagatttttcagtggcagtttttgccttgcatgatgacctttaaacctaatcctcatgtaagatgtaacctattgtatagtttcttttactctttctcctattattatttggccatgcaagactaaattatggcataatgtttgatgcagagagcctgacatatcaaaaagactacaagaaaggaagcccgtgtgtgtgtgtgtgtgtgtgtgtgtgtgtgtgtgtgtgtgtatgtgttttaaggtatccagtcccttccaccgggaaataaccccacttcctccagcccctttgctaccctctgcctcctctccttcctttatcctcacctgggttggaaaggaccctccagtctgtgttctccttccctgcagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggtcagtctatgtggcaggcagggtgctgggtggctactccccacaccctgctcctcctgtttgcatctagcaccctgtgcccctattcctgaatgttcttgatctaggaatgctcagcccaacagccttgatgccccttccagatgttcctctgcctccaacaacacagacaatcctccatcccatgcccagctcctctctaggctgtgggtgtttagagatgctattaccaccctgggggttcatgaacactcactacttaacccagagaagctcaatgggcagagtctttgagtcctttatttatttatttatttatttatttattttacctctcagacaacactctttttctttcattcttccctgtcaccacctatcttttataactgtttcaattggtttctggttcatgctttttgttgttattattttgcaaaaattagtaactatacacacatatttagttcttatatttcttacataaaaagtagaatactacatatactcttcttcgacttgtattttctacttaaaatgtattctgaaaatcttgccgtttccattcttgtggagctcctccttgttctgtctttatggctgcatagccctcctttgtgtgtctgctccttagttcattccacccgcctgctgtgggtgggcggtgaagcagcttctgaatggtgctgtcataggcacagtgctgagccactggcagaaaggcaatccctggaggatgaagtgctgagcaccgtgtccatacttgtgtatacccagtctcaggcaaagcaagggactcattctgatgatttgtgttcagcccctagactgggcagggctggaacagacttgcatgaacagagacattgaaatttggaagtggtgaaacaaaaagtctcttgttggaacctagcacctgggtatcttcatggatgctggctgaattactcactccattccccaaccgctctttaaaaaaaaaaattcatctttaatttacaaagagtaatcgtacatatttatggggtataatgtgatgttttgatatatgtttacaatatgaaatgattaagcaaagctaattaacaaatccatcacttcatttatcattttttttgtggtgaaagcacttaaaatctactttttgtttttgagatggagtctcgctcttgttgcccaggctggagtgcagtggtgctatctcggctcactgcatcctccatctccggggttcaagtgattctcctgcctcaagcctcccaagtagctgggatctcaggcatgcaccaccaagcctagctaattttgtatttttagtagagatggggtttctccatgttggtcaggctggtctcgaactcctgacctcaggtgatccgcccgcctcagcctcccaaagtgctgggattacaggtgtgagccactgtgcccagccaaaacctactttttacaagcaattttgaaatatacagtgcaccattatttgttatagtcaccattctgtgcaatagattgctaaggtttattcctcctaacggaaactttgtgccgtttgctcactcctaacacaggtggaacttaatctctggcctggaatggtttctgttcatgtgtttgtttttgtaggaggagcttacaacgctaagacggaagctagaaaaatcagagaagttgcggaatgaactccggcagaacacagatctgctagaaagcaaggtatccccatccctcctcttgggtccttgtggggggtctttatgtatgtgagatctgtttaatggggagaacaatgatatgcctgaaagcatgctaattgctttacaagcaccccagaattacctgtgaggcacatgctgttattgaacccattttacagtggaggaaattgaggccctgggatattaagtatcttcctcgaggctgcacaaccggcaagtgtaactgagattcaaacccatgtcacctggttccaaaggggagaatttcttaaataagtcacaaaagcacaaatcatagggaaaaatgataaatttgactatattaaaataatgaacttttgtttatcagggcataaaatgaagatgtatattacttacttggaatagaaatttgcaaactggaaaagagtatccagaacatgtaaagagctttctcaaatcaaatggaagaaggcaaacactccaataagaacggaaaaacaaatatgagccaataatatgaatgggcagttcccaaggaagggacgcttgtttcaagagtttaagtgttcaaaaattcaaatggccaataaactcatgaaaagacactcaacctaattagcaattaggaagtgcaaattaacaccttaataggtactgtttcacacatcagattggaaaaattgaagagtgtgatgtagccaagtgttggcaaggttgtgtggcagtgggaattcttatttactgctgctgggatcataaattgatctcatcactcttgaacaatttggcattatctgtgaaagttgaacctgtccatgccctgtggctggccattccacctctaggtatttatgctagagaatcttatccacgaatatatgaaaatacaagaagttcatagcaacagcctttgtcctgttgaaggaatgtaaacacaggaaagtaaacattcaaatgggagcttattaacagaacagtaggtgaatatgttttgtgatattaaaaacgagctcccaagagtgaaaatgaatgaagagacagggaaaactgtggctcacaggctaaattcagtgcaccacctgctttttgtaaataaagttttattggaacacagccacgctcattcctttatgtgtagtctatgactgctttcatgttacaatggcagggctgagtagttgcaacctgaaactactcagccttgccatgtggcctgcgaaagctaaaacatttactctctggatctttacagaaatagtttcctgatccttaaactagaaaatgtgtatcaacatgcatgtattgctcttgcaaacataatgccaaaggaaaataattcagttacagaagagtacttgattaggggtatatccttgtatacttatggtgtcattatatttatgggaatcataacaccaaattcagagtaggggttacctggggtacggtcatgtgactggagaaggttatgttggttgaatgtgtgaccgtattccctatgccttctctctttgatttcatgggctggggtgacttcatgggcatgggtattgatttcatgggctgggggtgactacatgaatcagacagttcccactccaagaaggtcactgcaaattacagatagacttctagacaaagtcatatgctgtgctagtccattcttgcactgctctaaagaaatacctgaactgggtaatttataaagaaaagaggtttgattcgctcagggttccacaggctgtacaggaagcatggctggggagcccttaggaaacttacatcatggtggattgttaaggggaagcaggcacatcctacatggctggagcaggaggaagagtgagaagggggaggtgctatacacttttaaacaaccagatcttgtgggaacgcactcactatcactagaacagcaagggggaaatctgtccccatgatccagtcatctcccaccaggcccttcctccaacactagggattacaatttgatatgaggtttggtcagggacataggaccaaatcatatcatatgctattatgttgcatgtggtcagcaagccacggctagaccaaagaggagcttttcgacgaaaacctgctgttctatgtagactttcaggactggggaaagggaggcacttgactagggaataaaatgtaaggggtcaccaaaacactcagcaaagtaaataatattttaaaattgtaaagtaatgcaaaaaataatccctgatgaacaaaacatcaaaattttaagtaaatgcaaaatttgtaggccaagattagggtgaggcaagtaaacattctaaacagtgtgaaccaatctttatataaaatgttgatattttctttatcgtggattttttgactaattgagatttttaaaatattgaattaaaatcttatttatcttgatttctgagagtttttttttgacacctccttacatgttgcaccctaggtaagtgttttacatgcttcattctagtctcagctctgtttgtccatgaagctctgggtacctccaaggattctgttaaagaccaaatgaaacccattttttcacccactcaacaaatgtatatgaacatctcccatgtgttagacatttgactggacaccttgatagagctaggaaggagggaaagtccctgtccttacacaaggtctccaggccgatagagggagacagaccacaagcaagcttgtcacacatgaagtgctacggatatgaagcagaaggaggtgacagtgatggaggttaagcatgggctctatttgcctaagtggtcaaggaagaattccatggaaggggatgttggactctagatctgaatgatttgctgtaatctatatgcagatctggtggaaagagtagatatggcaggtgccgaggtcctgggacaatgtgagataatatttgtcagtccaggacaaaatttaaagatttctacacccgagagcacctggtgttattacttgcttataatgttgtttggcttggttaatggacaatggtaactgtaaatggatttatgattaagccaacagaacctactcttcttcccatgttgataacccaagttgagcctgagatggctcatgtggggatgtggaatgaagtttgagaggaggccatctcttttctgcttcttctcatcttccctgtaagattgtgtccattctccccacattaaagtgtcaaccgtggagttggccacggagaaggcagaagccttgctccttgcaggaaggaccacatccacacaagagttaagagaggctgggctgagatacaccttgagcctatgctcctcctatgcaaaagactgtaagggggagaagaaatgacacacacgtgcctgatgtctcattcatgtcttgcgagagcaagctgtctgacctctcttgctggcagcaacaatgagtagaacagcagaagtgaaaaattggagagctgtgggctggttgggaatatcagggacttccctgtagaaattccttcccaccgagctgacatttgaagcagtcattaatcacgaactgtcaggttggatttgccatgcatcggctgttgggggagatgtgcggggatgagatgaacatcttcagcatccagagctgcagtttacaggacacttggagaaggaagggtgggggctcaggcttctgcaccctgaaccaagcaaacaaatgccaacacctacagaatattctactcagcctctttaactctttgcttatatcatggttacaacaagatgtatggggccttgaaaaattaagataaaatttaaaagtgaagaaagccagagcaaagggaaataagagttgatgagtgtatggaagccaggggaagaggtagaaaatggaaatctacctttggccttggatgccctctcacttcatagccttcacatgtgctgttcactctgcctgaaacactcccttcatcctcttcacctggttaatacctcttcatcccttgtcactcattttaggtggcacttcctctaagaagccctcttcaacactctaagggtgggttagggccctactctgtgctaccactagccttgttgtttcccctcacaggattaattgactctttcctagtgacctcctttatctgtgtcccagctagactgaaatccctgttttcatccctgttcgtcaaataatcccagtccctggcacaggatagataaagaatggtcaaatagaaccattaaagttgggcagaaaaatccaacactgaacttcctagcagcgaaagctaagagggaaacaagctatttcatagacatattgcatgtagattgaaaaaaaaaaaagaaacacctgttacatgagataagagtaacttttctggctattgaggtgttagggaaatttattccatggattctcataaaaggggcactaaggcatttagcaaagtatgacttcagcaatattcacacagcaattgagaagggatgggtaggagcacttttggagcatcatcctgaactgtaagccaagagcatgatgtcatttctttcaaaaatgaatcaattgaaatcaaagcagtgctttatccaggaagcacgtttgatgactgagtattatgatgactttatcttcctcaaatctttctcttccttcccacttcatcttccccaacttccagtgctactactggtttatgtcggtcacttttacattaaaaaatttttaaatagttttagagcgtacaatggcagtttttttacatggatgtattgcatagtgatgaagtctgggcttttagtgcaactaccacccaaatagtgtgccttatattcatgaggtcattactcttttttaattagttaattaatttttatttttattttttgagacagaatctccctcttttgcccaggctggaatgcagtagagtaaacacagctcactgcagcctcaacctcctgggctaaagcgaacctcctacttcagcctcccatgtagccaggaccacaggcgtgcatcaccatgcctggctgttttttttcaattttggtagagatgggggtctcactttgttgcccaggttggtctccaattcctgggctcaagcgatcctcctgccttggcctcccagagtgctggcgtgaaccattgcaccagacctgtaattacactttaaagagcattccagtcacctggggaacagttagctctgtatcttccccagtccacctcctgagggtctgacccaagaggaggttcttggtatggggggtagggagccctccagcccctaggcaatcctgattcagagggtgaggttgctttagagcagtggttctcacacttgcaaatgtgtcagaatgccctgtaagacttctccgaatacagattgctagactccagccttagagattctgaatcagtaggcttggcgtggccttggggaggctgtatttctaacatgctagagtgctaaaggtgcctgtcctgggaccacactttgagacacattaggccagagaacagctagaagatatcttcttccatgtgcatctgcttccttggaagggaatttctgttaacagacagggatcagacacccttccaggaccatgcatcatgatgacacccctgctgcggttcgtggcctctgcatgccacccctttgtctctggagggggagaaacagtaatataaacattgctaaaacgtgtcgtgtctcgtcagtgaaaactccatttgactaggcttattaaaaagacatcactattgcaaaatgatttaagtgcttcatttgtgaaggagcagaagaggagatgaggagcctctaagaatctggctataaatactcttcaagcatgcaaaatgtgccttgatgcaaactggggtttttttattttcataagaaggcagtgctggccttcttgttggaagcacctgtaaggttttgggaccacatgggatataaaatgaggtggggtgtttttccacccctctctggaataggttctggattttccccccaagaccttatttatggcaaaagacaggcccatgcactcctcatttctggcctcattagcctgagaggtttcgcttttggtaagaaattgtggagacaatccactgacggggactgcagatgtatgtaggtcagaaagtctatttgcaaagtgctgagggagtttgatcatgggtcatgagtgtggcttccagcttgtctctagcaggaggtaggaaagtgacttgttggggtcacatggtcactggtaactgagcccagaccacatcccaggtctcctgactcctcgctccatagtcctgccacagcatcatgcttctgtgaggaactggactggtagctccctaatccccgggggaaattagacagcctggtttcttatctgtcttaggctattaggatctgttgagccttcactgttgggacatgctagggagtatctcctggtggacagtggaagagacatggtggtcatattcatagatggtcctggtggaagaaactaaggcctctcagctaaagaacagctggtgtattctttctgactgtgtgcctcagtttgcccatacaaaaccgagtccataatctcttctctacctgccttgtaacacagatgaataatctgggcactgtacaaggtaaggaatgaatgcagtgacctgaccttgtatgtccagtttggaggggcagagggtcgagccagcttgagttccagatggctgactctgtaccttcattgctacaagattgtgggcaaattcttcaagtctcttagcctttgtttcatcatcagtaaaatggcaatggtaatcattacttcatcttgataagcctgtggggagaaggtgcatgtaaaacagttataacactgcgtgctatctagcaagccacatcaccactattaccaataaatatattttttaaatgtttaccctccccccagtagagtgaattcctcaaagaaaatgacatatcgtagacagttttatacccttctgtgtctagtacaaagcattcaatgcaaattcagtgaatggagtcatactgaatttaattagaaaaattacatttaatgagtgatgttctgtgccagctgctgcgataagtcctctcagcattgtgagcatttacctgcattatctaattttacctttaactgaaactgtgaagaaggtgttagtatccccatctcacagatgaggcaagggaagcccagagagctgaagtgatttgtcctacatcactcagctggtgaatggcagaactgtgatttgaacccagggctggtcaactccaaacagactgtgattgaggagaagcatctactcaggtgggaaatggggtcagggagggcttcacgggggagaagtcatgaaggataagcaggagctggccaggtgacaaggtgaggggacattccaggtacagggcacagcaagagcagaggcggagagcagaacctggtctggcaggtgcaattctggtggttggagtgtcttgtatggggatgtgtttgtgtttggggggttgaggggttgcctatgggttagagatgaggcatgaagccggactggatcgcagggggtcaggagaatcacattcgaggtttggacttcatcctgaaggggagggcaggaccaaaggacattttcaaaaagaggtatgtgggtgtcatgatcttaggattatttcctctttgtgctgaaacacttggggggccctaatggcccttgaaacccccttataaagcccctgaaaggccataactgtcccttcattctagagggacccccaaggccagtgggtggtgtgtcaccctcctatgcccagctcagaggcataacctttctcctggcattcttacaagattgacccattcccactgacatccagagcctatagagccttcccatgtatgaattgctgtcatgcacttgttagttcagtcaacccgtattcattgagtcctcaagagtcagtttggcagagtggttaagtagccaccacctggctggtgtccttcggtgagcgtttgcaccttggtgcctcagtttccccatctgccacctcgagacaacatcagtacccacttctcagcattttgagcattctgtgggcaaacctgtgcatgtggtaagcactatctgtggtggcgatggttattattatggttattatatgttacttagtagcgagtggtgaacccagctgggatgcacagcagagggctggaactggtgtccaacaggcatctctggggaacccgggagcctgccactaagctgcagatttattttgaatttcccctgctgactgaggcagctctgggggcagtaccatgagactgaagccatggcttaatctccttgacgaacatcccacaagccagctggtactgcagttgggctggccctgtatctactgcctcattttgtcttttcttcactcaggttgaagggggtgggagtgggggcttcccttccactgggcatccacctaggctctctttggccaaagtgtccagcaagggtggttgaggtccagatcttacttggtctttgatctgtacccactggctacttaatctcagctctctgggctatggctgcctggtttgttctaggtggataattgctttactaacctccagatgccagaggggtgagggaggtcaaagaaagggtcagatggtagatgtgggacagaaaatagtggggttgttgtgagccaggtgctgggaatcaggcagcccaagctgggctacctctgctacttaccagctatgatcctaagcaaatcactccctctctcaactccccagtttcctgttctgtaaaaggggaataacaaaaatgcccttctcataaggtatttgaagggcttaaggcaaatgacatatgccaaatgcttagggcatacctatcctcagcatttcaagagtgtgagctgtttctcacccaaggggttataatgaacagatctttctgtgcaaattgcaaagtatgggaggagagcaaaaagttgctgtttcctgctgtctgcaggtcagatggtttttgggcttgacagtctatgaatataagagctgaggacaggatcaagccaagacccgtgtgtgcccctgtggtttgtttgtctctctgactggccagtggggtccttcagaacaggacctggcacacagtaagtgctcacatagtgcttgttggatccgtgaagaacaagcaacagtgacggtcccaaggaccccaggtgtgtcctccagcatttaacatccgtgaaatcccagttactcactgctcgcccaagctgcaaatgaggccagtgcacaggatatttttttttctgttccactccatacaaaatatacaacaaatttattaattcctgtccccttctctctggcaggcccttggagtaattgtccctcaatagaaagaatatttctgttggtttggccaagtggtagatccggagaggttttcaagataatttctggttaattggttcttgagtaatctgcaaggactcttctgggtttgcaaaccagactccccccttcattaaattggttttcaatttgcaatcgcctgacagctctgagcatggtgcctgctcctcacctccatccaaagcccctgtgccccatggtgtgggaagggatagggatttatggggacaggggaaggtcaggggcaccttgtctctgagaaaaacatgtgtcatttcccccaatttgaaaagactaattgtcctttgggctccagactttgggttctgtgaaactcaaaattaatgcatcaaattaattgtgtggtccccttgctcaggccggttagcataaattaaatttcacactaattggctaaggtggagagaacacagtcctggtgcttggaattaatgctaatttcaaggatggtgtttggggtgtgacctggggcattcctggcttgcacctccctgtattgtgtggccagtgcaaatcagcactcttgcagcaagaatgattttgcacagccttaagcaaatctaaccccttcaaatccaagtgtgaggccaaaattaggaggagaccctggcagtttctatggcagtaattcctaaatttttttgttcataaaaatcaccctggagcaggttgaaatgtagattcctgaattatgctttagagatcctggtttgggggtctgagagtcctataatttgcattttcttttatttttttaagagtcagggtctcactctgtcactcaggctggagtgcagtggtgtgatcatagctgctgcagcctaaacccctgggatcaagtgatcctcctgcctcagcttccagagcagctgggactataggcacacaccatctcggctggtttatttttaaaaactttttaaagccagggtcttgctatgttgcccaggctggtcttgaactcctggcctcaagtgatcctcctacctcagcctgtcaaagcactgggattacaaacatgagctatcatgctctgccctagaatttgcattttaacaaccatctgaggtcattgccacataagtacttccctggtgcacggtgtaaggaacagcaagagaaagctcccatgctggagacaaccaggaacaccctaggagagtccctcattaattaactggaggtcctgacttggacctgactggtctgagttcaaatctcagttctgccttttacatgtgatgtgactttgcagtgcttcccccaagccttctttctcctctgcgtctattgaaatgtgcattttggtctcagcagtcggtgatgcggtcaacagggtgggaggcagatgggctggagaagtgaaacagatggggagcatggaatgcacagagcagcctcagattttgttcactctttttgaaagatgttttgttttctgattacaaaatcagttaaaaaatcaacagtacagaaatgcatcacaagaaaattggagttccctgtgagcccatccttccaggaaaaaaaaaaaaatctcaattaacagtttgggagtgctttgttctgtgcaaacaaaaatgggattacaccaaacattctattctggaaatttgcctttttttcccctttggcaatatatcttggggatatattttttttatgtcagaacatagatctgcgtcttccttcttcatgggacagctgaataaattttgagcctgcctaagctgacagtaccgagagaggctagctcgggaagggcagctacgttgctcattgtaagaaccatttaccttctcagtaaagataatgcagagtcgcctctaaatatcagtcatgatgcagagggtccgatgaaagagtgaggcattctaacatcttcacatgcaaaatttacagcaggaggacatgtgaccgcacccaattcaatgcattttacagctcaggtgaccaaggctccagagcaggagggaatgtccaaggtgttagttgttgagtctggactcgaaccttgcaccctacctctttctttttttttttttacaattctgctgccttccataagaggtagcctcagttttatgagctgcccttctcctacatagggttgtttctctgcctcttagccataaacactccactaatatatttctcccgttacgtactctgccatatcctcaaaccctgaacgcttcattttggaacgataatgccacagaagccctgctcatttggcatcggtggctggtcagttaatcagaaaaaaaaaccagtgcaggtgggaattcatttaaaaattcctattttaaaattaattacatgtgtaatttaaatcactgcatttctgaggcaggacccatccatttctttctttcttaaaccacgctcctaatatacaaccgtatgatttccaattttggcttctttaaaacagagcaaatggcaaagtaatttgaatacaaaaacctaattttttacttcaagtttctttttagttgttgcaacaacacctatttggcagcattttaaaaagcagcttacctttattaattccttccaaggcattcaacctagttttcatggaaactctgtccagccatattttataagtttatgtagtagctaactgaatagatagctatggtaaaaatgcaataggcaaaaacagtttgggagcacacacatgtgatactggatgtgcatgcctgtcacctgctagaggcagataggccatggggccattgtagagaggtggtctggtggagagcattctggtgcagtgggcatccatcagtgtgtcttactgagggacagtgttggtacatccagtgagatgatttgctaaaagctggttacgaagagattccactaaaatggccatttttaaaactgagcacttactacgtgccaggcaccgtgctaagctttcaatggattatctccttgaatcctcaaaaataatgatgtatgttgttttcccccctttaaagctgagaaaactgagaaccagcaaggcatcctgcttggtgtaaaatcacacagctagtgagtgttgaaccacatcaagaccaataaaattctgaagtccatcctcttaacgagttgattatactcaagggttgctttcccatgatagtgatttgtccaaaggcgatcctgtgcatggggagagaagggttggtggctccatcgagtgaccgttccttgatcaccccattccccatctcagattgctgacttgacctctgaccttgccgatgagcgcttcaaaggtgatgtggcctgccaggtgctggagagtgagcgggcagagcggctacaggccttccgggaggtccaggagctcaaggtgagtggtcaggggtggccaggggtggctgaacacggtggctaaaaatggttgggtctgctccccgaccctctcattggagatcagtaagcttaagcaagatgcacaggttgactgactgctgggctcaaggtcctgggggacacttaggtctcctaaggcttggccttgggggtgttatgggtggatagtccctggctagagaggcgaataggagaggattgtgcagaaggtggacagtctttggccttggaggtgatttgggtgagaaatatgccgaaggtggctagcccatggtcctggattctgcatggctcagggctgtgcagagggtggccaatccgagccttggaagcacttcatgggtaagatgaccagcccatgtcttctgtccagctctagtttagaccttgagccctttcttctagagcaagcatgaacaagtccagaaaaaactgggagatgtgaataaacagttggaagaagcccagcagaaaattcagttgaatgacttggaaaggaatcccactggaggaggtgagcagcctgggacccttggggctggaaggtgatggacaaagttgtctttcccatttattcagtcactcatagagcactttttaggtgctagatattgcatgaggggctgcgactttggcagagcaaacaggcacagcgtactctcttggagcttacagtctaatggaataagcagatattaatcagataatccaacaatatcccaggtaacaaattatctgtatgatatgtgctatttagttttaatgcaaagaatgatttttaaatagtggctttatgggcaaggtacttttatgtttatgtgaatattttaaaaataaattttgagaggcctggcgtggtggctcacacctataatcctagcactttgggaagctgaagtgggaggagtgcttgagctcaggagttcaagaccagcctgggcaacatagtgagaccccatttctacaaaaaatttaaaaaattagcctggtgtggtggcatgcacctgaagtcccagctacttgggaggctgaggtaggaggatcacttaagcctgggagacctaggctgcatttcagcctgggctacagagcaagaccctgtctcaaaaaaataaaagcaaaaagaaaacgtaaattttgaggaaggctgtctagtggttaaaagttggaacctatgaagttgtatttctggatttggattttggggcaaagaaattgctgtgcctcagtttcttcctctttcaaatggagattgtcttggataattgatagaaaatgtttagccacatgtatagaatagagtgatgaatagctaatagctactttaccattattatgaggaatgatgagatcacagttcatccttatagcaacctgtggaacagaaactactgctctccccattcaaagagggtaaagctgtgtcaggcgcacaacagttaccaaatggcgagaaggcgagaggactcttggttttacccagggatattatacatttgttcagtagtgccaggagtttctggaggtgtccttcttatacagtttcctggagacctcgtgattggatggcatggtgacatctttgccaccttgtcaccgtgcctcttactctccccagcctaatggagttgggtgagaaggatatccagtgggtcagcttctataaaatgtcagcattattccctccgtgtgtccagagaatttgtgcccttgagatgtccaggggaatggagatcaggggtctgtggaaaagagacaatgagtatttattttctgtttcattcttgttcttgttatcctggctacccccgtggcaggcatttagcagggaggttaatacagatgagtttgaggctctcttataagcgagacccaacaaggtagggtacacatagagagaggggaacatgttggtataaaatcagtagtgtgggacagtctctggccttggaggtaatttctataaaatccccagaggggcgccagtgtcagttccatctgcgtgaaattcatgtctaaataatgcttcccagtttgttttcctctgttaagattggggtgttaatgagagggggacatgtgcttagctcatgggcacattagtcacaatgctatataggctctcagctctggatgctcattccaagaagccaacccacaaatattttgtttttcattatgaaagtaatacatactcattatagaaaatgtctaaaatataggaaatttgaaagaagcagtaaaacattttaatcatatcatcgcagtggtaccacaaccacctctatggttcaagatggagtatgaattatttaaaaaaatatgttttcctttatgcatggctaaatatttaaagagaaccttttgtgatatgcactcagcgtggagctggacactgtgggggttacagagggattttaattgggccctgctctcaagatattcacgatataaatggggatatcaggtaaactcaggaaaacatgttgattaagggtggcactcatgggcagggaggttgaaggtagagatgagccttgaaggagaacagtttcccctcttgttcgtgttgcccactcatgccacttgctctatagcacatcatagcacagagtacatgggaagctgcagaaatgctttctgctgctgcttcttacttttgcagtccatgctgcttgtgattgtgaggcttttcctggtggagagatagtgtgcttttcccatcatgatgtttttaccttggtggaagcttgaacaagctttaactctttattattataccatccgttatttggttaatgatgtagaaatctctattgaggtcacctctttcaagaacttaatcctaccatccatccatctatccatccatccacccatccacccatccacccatccacccatccacccatccatccatttatccatctgcccatctactcacccacctatccatataccctaccacttatttatatatcaatccatgcattcatccacccatgcacccacttctctgtctacactaacatccatccatccatccatccatccattattccacctatccaaccaactatttatccattaatcctccaccctatcatctagtcaaacgtcctatccattcaactatccacctttccagtggaagttattgagcatttactatatgctaggcattatagcatattctaggaacacaatgatgaacaaaacaagtttgttgtcttattaattttggttctcttctggatttctataagcttctttatgaaagccctgatcatactaggcttcagctgtctttttacttgtttcccttgcttgattattctggaaggtgggtggatatggcttcttattcatttcattatcttgtacaaagtagtgtgctcaatgagtgtgtgaatggatggatggaaggatggatggatggatgatagatgaataagtgggtggtctctatctttggtcatccacttgtggaatgttttccacaacttcattaacttaatgggcattattctattattcagatagtcaaaagataagacatcttagcctaaaatattccattctaatcagtcaaacagttttaatcaaaccagccaataatttttttgagatgtttaccaaatcaagggatttggtatccatcttatcttgtggagacatcttctgaacagtttagtagagtcttgaattattgctaatttactcatttgttaattgcaccaacagccaatgattatatactctgtacaacccaataaagttggccagtaggatgactctttttatctgattattgtattaggttcattaagcaatccatgagcttgtatcaacatgtaggggaatctgcttgtagggaactcttccagagggtgtgaaggactcacagatgactgaaacagctcccttgcccttaaggattatgaaatttccttggaaaagggaagatatgaatacacttatagagacaactaaacagtataaggcaaccaatcttagaagagtgagcactcaagaactttagacagttggaggtggtcaggacaggctgcctggaggaagcgttatttaaaactcagagttaaagcatagtttcttggtccaaggttgaggctcaagggctctgtgaatattgtgaaattgcatgccaagagccaagaaagtggaggagagccactcacactcttgccttacactcatttggcctcttatcctggtctccctgactccgttaaacagcagacgagtggcagatgcgcttcgactgtgctcagatggagaacgagttcctcagaaagcgtctgcagcaatgcgaggagaggctggactcggagctgacagccaggaaagagctggagcaaaaggtaagatgtggggatagtctgggccacagaagtgttagagagtgggcaggctctcacctccactgtgggtgatcgaggtattagctgagcctgaagagggaggaagaggacacaaaccccttaaggtttttccatctccactattattacaaatgctggtcactgtgagacatgaaaaatattgtctgtacatgtggatcttctatccagagactgctctgtggtgtaaagaacatggatattaactcaggatatctgagttccagttccatttctacgtgaaccttgtggaagtcactttaactcatgtttcttatctattacataattatcagcggtctcaaaaccttcacatttccctgttgcctctgttctaatctgctaccttcatctctcatccagaccaaagcaatagcctcctagctgtgctccttgcctctggcctctcctctcaaccacctgccacactgcagccaaggaatgtttcagggtctctttcagattgttctgtgatcataaagtatgctgactctcatgttggatttttttccttgtgtgttttgtaaatttcgtttttgagctcatcttcaacaggtttctgtgctcctcccccagtagtcacaggtgttctgcattgtggaatgtttttttttttttccgctcccagtgaatttttgtgtgtgtatttagctattttttattgtgagttcaccttcagcaggagatttaatttttttaacattctgttgactttgatgggagccctttgataacagggtcgtgggtgtgttctgctagaagaaaccctttttcactttctttggcagcagtccttgagataatgctaaattcttggtctcagatgttttgcggcatgtaaaaattgtcaattggatctctaaacccacatgaggcttagacctggggtttaaaattcttacgagagtacttcttgccccacctagatccagggtgaaagcaagctttcttaccaccttccaggccagcaggtggagcttttattttctcttctcactgaggtgcatgcagttctttgaggggtttgtcaatgcaacggtcttcattccaactcttcaccttccatgagcccagagccttgtctcctgtctctgtctgggcattgaaacacaaacctctatcctaaaggacacttctggatctatcaactgctcttccccctcatcctggccgccataatattagtatgtaccattactgttagggctttgtgtcctctgcatttctgatatcctgaaatttccttctttcttgaaggtaacattacaaatctaatgcaatcttatctatatataatatatttttatctagcctttctagatgaatgtacagatagtttggtctctctgcttgtcttctgtggcctccaactatccctcgtctacattctaaccagttcacactctaacaaatggtgtgctagtaaatggctccctggaaaaaaacaaaaagccctgatttgtagcacttgccaatttccctggtgtaaatactcccaccatggccaatttcaaactaccattgtgatgtcactaacatggaatttgaaagggatgcacagaattagctctgtgcatctctttcaagtcggtaccagctgactctggcacaccactgattccagccacactcagttttttttcttctccttccaaaaatgcctgattctttctcacctctgggactttgcatgtgctatttcttcttccccgagcaatctttctttttctctcctgcctagatatctccaactattcttaagatcttagcttaaatgtcactctctccagaaagtctttgctgacgcagattgggttgggagtccctgagttgtcttccaaaacataggcctcatcatgttgtattgtaattacctactcacttcatagtctctcccattcgatatcggagccatagggtggaggttatatttgtgtatctattctattctcaacgtgagcaaaaagtatcatgtgattgccttgcagaggtgggcctgggtgagatcacatgggattttataaacaatggaagtgactcttgatatcctctatgctgatggtgatgattttagtggtcgctttcaaggtgaacattgcatcgtggtcctcaagagacatcttgaaccatagataaacacagatggacaactgcaggaaagcagcccagttctttaataacaaattataaagttgagtcagtttccctgatgaagggggatatttatgctacattaaaaagtaataaaacagcaaccttttctgagcagcagaatataagagaacatcccatttgccttcaaatactgaatttagaattacaggcttcattaactcagagttttgcttatttaaagcaattttttaatgaggccatttcttcaaagccagtgtgctgagttgcgtgctctttcccagatctaaactaggacatttgggagagtgtttcctggaggaagatgcaagagtcttgacttttgtttgtttaaggccgtgtgcattctggtattaattcagtccatgcaaagtgccatttgctgctttaacctttaaggcttgtcacttgggattccgggtcagattttctaggtatgtcattttggctgctctgtggctaatcctcacatatcccttctgatcatgtcggctggtggggatatgagttatccggtggctcaggggtcatcaagttgaggcagggtaggtaaagtctgtgggtgcattggctggaggtttattgagcaaaagtaaaatcaaccttaagagattgatggaattatccccactttacctctgagcaaactgaggctcagaaaagtagcttcctggaggtgaccctggaggaaggtagtcaagacagggtctccccattccagcatctgctgttttctcattacacaccttggaaatagcaactccttgaaatacaaagtaaaaagctcgttccatgcccacagagccgggtaattcattctattactcttacagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtgagttgcatctctcaccatcacctgggctgccagggtgggctacattggagctggcgttttctggggtatccaggttctcctaactccctcacttcaactcccttgttttgctctaatcttcctccctgtcccgtcacaccttattcctgtatggttctcccaagaatccagcaagaaattattcttttctcttagccagcctcaactatgtggccaattgatcttgtgaccttggggaactttctttgcctttctgggccttaacatccccatttgtcgagtgaagggtttgttgcagacggtcaagacagcatggcgattaggagcccaggcattgatataaaagtcatctcattcaagtcctaaaggtgcctctttctagatgtgtgaccttgagcaggtcattcagtccttcccagccagattccttatccgtaggttggtgataagatcgcccccttgtgctgaggactaaatgatgcagtcagtacatctaagtggactgatcctggttcctcttcctgttggtgaaaattgggctagagaataaggaggaggccaaaatatggccttctcatttaggacttggactctcagatcacgtgagccattctggcagagactgggccttgtgcaccagcaagatgctaatcttgaatctgcacggtgtggttcccatatttgcattccctttgggttgctgttacagtgaggcgatggtggagcctggatttgtacccagattcgcacactcataggcttcttcatgcaaaacctcagaacctgtgatgcttggacgccttggctgtgtctaaagttctccagctcactcggtgaggggaaaggtatacaggggtcctgttttgagccagccaagtcctaatggagatgtcatactaggcaaataggtgggaagcagcctcttttagaaggcccatgataaaatacagaaaaatgttcctgtgtgagccaagatgtgaatttgtggaaactgcctcctttccaagaagtaggaaggagaattatatttccatggaggtggcatagattttgaacttgatctgcattaaatattatttatcttatttatcctacagctttcctgagctggcttcttcatctgacaaaggtctttgggggattgttagcgtgctctgcatccccaaaataagaaagatttattttttgtttattgatatctcactctgttcccctttccacctccctgtgggtgctctggctgaaccttacccctgcagtggggaaaatggcttggctccatcttggccacctgctgtgtgtccttggcaaataacaccacctctctgggccagagagtgactgatggttcagatggtgcagaagtctcagtttaacaggtcatctgatctggaagaatggctctgacatatacccctgtctgtgaaacaagaggttgggactccatcattccccaagtttctcccagctgtgaccctcttggcccccaactatgggttctactcctgttctgagaggcctaactgagggtttcaactctctgatgagtaaggggccagcctctggagtttgtgcagccagaaaattccatctgtctggtctttccttttccctttggacagaatccctcattccaggcacttatgaatctccccaggataccccccaagcaaagttcctatttcttcatatttgcatgccctcctctcaaaacttagctttcttgtgatgccctctgctctgttaccatctctaggcagaagctaatttatgttttgatgccaattgcagatagcaggcattacctttccaggtagattagcattttatgtctcagtctaactgtggaagttcaggcagaatgactatggtgaagggaaaatttagaagtcagtaatacttccttgcatctctcgatgcttaatcgaaatgtagatgcagctgcctcctgagtttgctgggcccaggatagagtgatgcctccacattggtagagttctctgtttcccgctttggcttctaagttcagagtggcctgggatggtttcattttggttggattgtttgtggcatgattaccctatgggtcacaaagcttggttctgagggctgatgaaattccgggtaagccctgtgctagactcactgattcccacactcaagggtggctggacccaaggccctttcttaacagattgaaggttgtgtgcaaacctatctggcctcaggcaattggctggtcagtgtgggctgtttgctaggagctggtgtttgtagtagctattctttggcatcaagtggcctgttaagtcaaggactcctctgcaccatcagttactgtctggtccctactgtcttacctcacctgtcccaggaatggacaggtagatgggggactagctaagacattagggaagcccaagtccatttctaccactttggaatttggggctgaatcactcctcctctccgagtgatttcagtttcctcctcagtgaatggatcgaataacatgtttcttgctgaactgttgtaaggacgacatggatcccagcccaggacctgacacactgggactgctggatcatcaccctcatcacaatgcttccattcagaggcagcaaatagtgccccttgaatgatgtcaccaacagccaatcagaaagctcctgagctgttccaacaggagggctccattatgattgggtctctcagaagtctgagactttgaatgatagtctagtattaaggaacactggatagtcttataataagcgagactttcttgccaccaaaggccaaaccccatgcccacttctgccatatcaagatctctggaacaatgggacttcctgtttgggccaaggggaagtgactgaaagtcacaccttactgaggcttggcaaagccttctctatcggtttcctcacctgtgatactgccaggaggctgagacaactgaacagagtgacataacatccaggaggggcttctcacccagtggtcatcacagaagggcaggagggcccctaacaaggcattaattccctggatgactttcagtaggactgactagtctttgtgttttctgcttgagaaacaaatgaggacaagaatgtataaatgtccatcattttattgataatcagcatgctttagtatggcatatgagagtataagccagacaatatgttaaaatatgaaatgtagaatatcctcattctacttacatccattcgtttgttcattggtcaggaaatattggaagtcaaatggggcctggtagatttaaggggccttgacatatgctggcagaccagatagatcaggtttttgggttggttttttttttttttttttttttttgagacaaggtcttgctctgtcacccagactggagtgcagtggcacaatcatggctcactgcagccttggcctcctgggctcaagggatcctcccacctcagcctccagagtagctgggattacaagtgcatgccacgatgcccaggtaattttaaattttaaatttttaaagtttaaaaattttaaaaatagagatggggtctcactttgttgaccaggctggtctttaactcctggccccaagtgatcctccttcctcggcctctcaaagtgttgggattacaggcgtgagccaccatgcctggccacctttaaaatatatcctttattctatatctgtatatagttttattctatttttattcctgtccatatatttttattagattttagggttagcatttagattagcattttagtagggagatgatgggggcagcagaagtctcagtctaacagtggaaattcaggcagaatgactatggtgagggagaaatctagaattataagtatatcgaatagttctgtggcaagtctacctcaaccctaaaaattgctctgtggtttttcagattcccaccctacatccacagccttacgtaaaagcattgagaaaaacttccaacttctcatactttctctatctctcttcttccttttgctctctttctaatggttcttgggaaactagcggcctctctgcagcccctccctgcccctgcctcaatcactcccctgcccacctgcctacggggccctgacacgtgctctgctttgcacaggtttgacctgcagctggcccaggccctaggtgagtcagtgtttgagaagggtctccgtgagaaagtgacccaggagaacaccagtgtccggtgggagctaggccagcttcagcagcagctgaaggtaagggatgggggacacagagctatcttggctcttggtggctaaatctcgggaaactgcatcgtgcacctgctgcaaatggtgacagagagaaaacttcacaagggtatcctggtctgtcaagcagctgaatcccagtgtgtcttaataaaatagcaaatggtggctggtaaattgataatcagactttgagcaagattgatgtcttgatcttgcttcagttacctgcacaggttccgaggtgcttacctgggaggtataacaggctcagcagagaatgagttagctataaccttgtccaggagcaatgtcctggtccaagcaggctccaatgcagagagattttactaaaatacaacacgggtgcctcactcagctgctcctcatccttttgtggttctctactactcgcaggagaacctctgagcgctttagcctggcgttcaactccttcacgatctggcccaaagttatttgatcctggagctgactttgtaacctggaagagtcatttctgagcactttgcctccctgctccaacatctcaatcccagcctcagacggcacacagggaagctttagctgtgtgcctccacttcccttacaaatggggtcaacccttcctgtaggtgctctgagatcgaactctagggacaatttattccaatcctacctcccacccccaactccatgcctgtaggagctataccaagagcagcccttgctggtgtcccacagggggcgctgtgagggacggtggggtccaggtggaaatggcaggcattggaaagtggaaaacgccactccagccccagttggttgtagaggtatccctgggggaggagggaggcatactcatgtgactccagatctctgtcctctttgtctctgtagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcaggtaggaaagccctgtctcagggcaacaccctgtcccatgtctccaatgcagagtgatgttattaaaatacaatgtgggtgcctcacttggctgctcctcatccttcaatggctccctattatcccagggaacctttaagctcctaagtctgacattcagatccttcctgatccagctctcccctgcaaggttcagtgtcacctcctcagagaagcctgccttaatcatcttgcaaatagctcccactaggttgcattcatttcccatctccttagctgggttgctttactctctggtacctgccatcgtattagatagtattttttaaaagtttgctttatgcctttctctctcattaacatataagcttcatgaagtcagattgtttttctctttctcttgcttcttagtgcaatcctagagcctagaatgaggccaggtacatagctgatgctcaataaatagctgttgaccaaatatctaacattcattgagtactgtctgtatactaacctcagccctaagctctccccacacatctcacgaatctccacatgaaccttatgtagggagatcttagtattatccccactttacggatgtagaagttgagactcagagacatggagaaagtatcagggatgggatttggaacctgtgtcatctgaccccacactgcctcgaatgtctgctatgtgctaggcattgtgcacagcttcggggcagattgaagtgctactctttggggaaaataaaataacaaagggaataagacaaaaatatcaaatactcttgtaccagtaccctctgcaaagtaccagatgaatactttatttgtctgcttgcttatttatgtacttacttatttacctcattctataaataatttgaggcagcttacaagatacatgtataatagaacacaaaaattgtaaataaaacaatccaaaccacaaaagtacaaaataaaatagacactaaggaggagggtgggggcagtgaattaataggcagataaagcataacatatggtcttacacacataataattttagctctaaaattcctggtggccagaaagaaaaaggaaatgtgagttacatgcctgagataaaaaaaaaaaaaaaatttctaggggaagtaagacttcttctgatgcttggctctaaacgaatttctcttgtgggattttgtaaaaggcaattattttaaagtgttttttttaaaaaaaatgctgaggccaccgttatgcgagaaaatgtgaccaggtgtcatgaatgtgtaaagcagatgaactctgagcagctctgttgaactgaagtggggatgggtgggacaggggatgggggaaccaggggtcagctcttgcttcttgctaaccactgctccaacaagatggagcctggtgagtatcaagacatgtgggtggtgggtgttggggaacaagatccaggaagtcttggatgctcactaaggagcgataaggaagacaagtcttttactcagtcagcctgtatttattaagtacctcctctgcatcatgcactctgtggatgctgagggtgcaattgcaaataagacagacacaatctctgccctcccaaagtttatagtcatgcttagtgttaggggaatgttgaacttgaagatctggtcgtgacagcagggttgggggagagatcggggaaaacttcctggaggaagtgatatttactgaagagggaagctggaggatgaatcagaattggctgaatgagagagttctaggcaggggaccagcctgtgcaaaagcctgaagacagacaggatagtcgtaggatattcaaggagctgtaatacggggtctttgaggcagcttgttgcctgtatgaccttaggcaagcccctgttttctccagacatcagtctccttatctgtacaatcaaatatggagccttatctctcccctagcttcctgccaaccacagctatgaatcagtgaaggtttgtgaagaaggtggaatatctgtgtaggtctttaaagggcatggatgacggtgcagtgccatgtagcaccccagtgttccttgtgttccttaaatgagcaggatcttcacagagccaagaataaaacaagccctcttgaaaactgtgttaactctttaagataccactgggggaccacttagtgctcggaagcaaaaatgtattaccatggcctcagggacccaaaacttaatgcagctgcctgaatttccatgctcagttcacccaggagatgaggctgactcaacactttcatccgtcttcagcttcacccataacctcaggctgcattgtgcccttgtagacatccagtggatatttattgattataatacaacactttttccagggaattttatgttaactcgtataagtttgacataaatggtattgcagatgtcaagaatgtccaagaggctagaaaaaatgaaaaagaaatattatagttacttgctcaggctccttggttttggattatcttcccacaacccctgtcattttaaaggaaaaaaaggcaagaagttgacatttaaagtgagcctactttatgccagaaactgtaacagggcctctgacgtacactatccttttgctcctcaccacggcatagcagggaatattatcaacattttaaaagacccagattgtttttttctgtccatgttggggacagcacttgttaagttccaaaagcttgatgagaggtgctgggacagtagagtaaatgatcagaaagttatcatttctacaatgtaacccattgtattagtctgttttcacactgctgtgaagaactgcctgagactgggtaatttatgcaaaaaagaggtttaattgactcacagttccacatggctggggaggcctcaggaaacttacagtcacggtggaaggggaagcaggcaagtcttacatggtggctggcaagagagagtgtgtgaagcaggagcagtcacgtataaaaccatcatatcttaagaaaactcattcactatcatgagaaaagcacaagggaaaccaccccctgtgatccaatcacctcccaccaggtccttcccttgacctgtgggaattatgggaattaaaattcaaaatgagatttgggtggggacacagagcctaaccatatcacccatctacgctattgagttccaaatgctttttcatgatccagtaacattaaagagtatagacagataaaggaaagcttcaaagctttcttgggccctgtaccctggggattctaatccagtaggtctagggtgaagccctgcaatttgtatgttttaaaaatgcgtttgtaattctaacgtgccacaaaatttgagaagccagggcttgggccaatctgtaaatcatgcagatcaggaaagtgaagtcttgaactagacctagaactcatgacttttttgccttccactctagaaccctttatacgacttcacacagttccaacattatgcacggctctatgcctgttgcatgtgttttggaggttcttgtttgaaagacccagctcattcatgggatcacagctcttaattatgtcaggttgccagggagggaggggatagtcttttctgttttcgaaataatggggaaagagaaagtaatatttatgtatcagatactgtgctaggtgctttatatcatcatttaattctcatagtagcattctaagacggttgttttctacagagaaaggggactgacctagaggtaaagtgaattgtctcagataacattttgggcaaatcatcttcttttccaggctttcatgtcttcatacacttttgtcctaccattcatctacctatccactcacccagaaaaccatcgctgttgcctgctccaggaatgagaaatatgtttcatcttaagagtgttgagaagggggccgggcccggtggctcacacctataatcccagcactttgggaggctgaggcgggtggatcacctgaggtcaggagtttgagatcatcttgatcaacatggagaaactccgtttctactaaaatacaaaaattagccaggtgtggtggcacatgcctgtaatcccagctacttgggaggctgagcaggagaatcgcttaaagccaggaggtggaggttgtggtgagccgagattgcgccgtggcactccagcctaggcaacaagagggaaactccatctcaaaaaaaaaaaaaaaaagagtgttgagaaggattctgaggctgcttctaaactcagtgggaaagtgtgattgatgagtgatgtctgttataagcacaagaatggatagaggcaatatttaatctatttacccaccatttgtgatcttccaggatgcctagggcaataacttgactctcatttatgtattccaaaaatgagaaatgcaattggaatgccaaggatgacatggagggcttggagagttagagtgggtcaccctcacgtgctgtccttgctgcccccgcagctccgccagcggtttgagctggagatcgagcggatgaagcagatgcaccagaaggaccgtgaggaccaggaggaggaactggaggatgtccgtcagtcctgccagaagcgggtacgtgagcagtgaacacagctgtgcccttggatcctggcaggtctggcatggattccctcttccttagagcgaggagtaggacagggtctgggatctggggacaagctctttctgcaatcatctgagaccttagcttcgaagtgacttcaaaggtgtaggagcggaaatgcccatcttaaatatgatcttggaacttccagaagcctctggaactgtccagcataatggctcagagatttctactaagtccccgtaatgccatgtgactgatgccaaggacttgtaaatttcaataatagaaccaattctttcttactattttctttacaagtcaaatcatttcttaacattttatccaaagtctttgtagccattccgaacagtgtgtaagaaagcaataaccccttgacatgttatcacctagaagccatcattattactattttaagtgttcttttatagctctctttcactctctgtacacacatgcagatttgcagagatatcattttcactaaatgaggccatgtggttctgaagcctgttgtctctgcagtttgtcatggcctcttttcatgtctgtaaatacagatctaacttatatgtttaatggcttaacagtttttcacccaaagcttatcctctaacttatacagtaaatcccctatcactggacattaggttgtttctagttttctgcccttataaccagtgccgagataaacattcttagagctgtattgatggatttgaatgtaggatcttcaaagtggaattgctggaaagcttcgggttaagcctcgtttaacaggttctcacatgtactctataagaccttccctcccttctcgtcccctgaatcatacctatgtacagaatacactcaattttgccttgcttgatatatagttttgttattttgtgtgtttttcaagatgggttttagcttttccagtctttattctaaaaacagatataaagagagcgccttgtatttctctccatcctaaacgaaatttctgaaacgaacttgctttctatagaagtgaccatcactcagtactttttccccctccatgggtcaggagatggaatctctcagtccctgcccatattccttcaggtgaagattgcacacatttctggtttattctaagaatgcctcaaagtatggtgtgtgccctgagccagggctccagtgagttggagatgtgacccagactctcctgaggcttttctctggatagatttataaaaggagagagtgaagtcagagaacggtgtttttctccttataacaaatactgatattgacttctcattctggtgactgctctgttcagtctatctctcacgttggcaggaaatcaatagttagtgacctgggtgggaatgctggggctgtctggggtggcagaaagagctggggtcaggagagaggacactaactcctctaaacagcaactaattgcagagtatgcacttcggattttccctgggtcttagtttgcccacccgtgaaataggatctctgatggcatgaggtggaaatggaggatggataatatatacaagagaggctggtgggggtggtctgcaaagcacagccacagtagggtgtttgctctagtggggaatgtctgtgtttgctgggtaattgctgagaaatcagagccagttgcaaattaaatgagtcgctcatagtcagatgtctgagttcaggctgctgtagcagaatattattgtctaggtggcttaaatgataacatttatttatcacagttctggaggctgggaaatctgagatcaaggtgctggcagattcagtgtctggcgagggctgtcttcctggcttgcagaccaccacctcctgtttgtacgctcatgtggtggagaaagagagtggaagacagctttctggtgtcttcaggcactcaccccaccatgaaagctctaccttcatggcctcatttaaacctaattacttccctaaggccccacctccagataccactgcactgagggttagggtttcaccatatgaattgtggagggacacatatagtttataacaccaaaaaatctcaaatgcaacttttttactgcatcattgtgtatttaataatggaggggatgcatttttgatatgttggttataatattgttcagagcctttaaaaatcaaagtgcaaaggtttgcaaatattcagcagtggccatggctgcaggagagaggcatctcttctactggggacctgggggagggggtttcacagtcaagggcaaggggttccccatcattgaccagccctccctactgttgtccagctcccaagcttttaggctcttaaattctcccacagagacactaccacccaatcactagggcagcctcatggaacaaagccacaagctctacattcctccgccttctgagggtccttgccttgtaggatgtgtctggatggagttcatttaccctgtgatgtttcttccctgtgtatccacagcttcatcagctggaaatgcagctggagcaagagtatgaagagaagcagatggtcctccatgagaagcaagatttggaaggcttgatcggaaccctctgtgaccaggtaagggggagacattggcagacattcagaggagtatctcagggacctatttgagagatgggctcatggagagaacagcctgagggataccctctcctccatcagctctgttcccaccatattcactggctcttcaaaggagaccttcaggtgcctgcaaacagcagggtttttgtaagaacccatggggaataaagagagtggggccagccaggagcaatggatgaggctgtctttgccttcagcagctgttgggatcagagtccaccagacagtccttcctttaaggggatgtatgtgaatggccactgcacacatgactgccctcctgagaacatgacttttgctagaagcagtcagccttggagccaggcaaatgtagctttaagctccagagggaccacttctgtctgcacggctttgagtgagctagttaacagctctgagcttctggagagtggagccttatggggttgtggctatcactgtacaccagggttctcgactgtccatcagtgtacaccagggtcctcaactgcatcactatgaacatttggagctggatcattccttgtggtagagggctgtcctgtacattgcgggatatcacgcagcatccctgacctctacccaccacattgcagtagcccacacctcagttgtgacgaccaaaaatttctacagacattgcccaatgtcctttggggaaaaaaaatcaacttccctcactactgagaactgttgctgtactaatgtagccagcagagctcagaggcagcttccgatttcagagttgcaaggaatgactcttccacctcctagatactctattcccttcctgtgctgctgctgcatgaaatcccaacacgggagagaaatgcctgtggcttctatgatttattttaaagtatcaaaggagtgtattttaatgtatttgcttaacatgggttcgatgtctattaattagtaatggtcttgttatcaatatccttccctaaattcattaactttattcacaaaacaatgtgggtgcacttcaggtgatcatcttgggcagccatgccttggacaaaataaatgcttattatgtattaaaaaacaaattgatttaatgagtgaattccacagcagggacacacgcggcaagagtaagagttggaagctgagggagtcaatataatcttccttcttctctgggttttctaattttccagccaaacaattgagaccattgaattcagagccattgaggtgactttccttcagcatcagggcaagagagcacagcccagtaccagattctagaatgatagaggggaatcactgcgagaaggttgcattctattcagcatagtctgagaaaacagaatagataatctagtaaagcaaggtttttatacaaattgcaaaaataaattttacatgtaaagagaaggtaagtttaaatgaataaaaagccatctttgtgttagtcaccaagttggatccttttaataaattagcacttttgatgattttaaatgtttttgttatgacctttgccaaacccatggaaaagcagaacaaataatgtaatcggtgtttatgaaccaagcactcagggttcacataaattaacattttgccatttcttattcagatgtttttaaggaaacaaaacgttttaagaacggttggtggcctctttatgtcgcttcctaatctcaatcctggctctgcttttctctttctttcctccctccccagatgaaaccattccccggggtttgaggtgtataattcccctgaatgtatatttcaacttcagccacatgcagcaatatgattctgcactttactttgtccccctctatgttatgtttttgagattagtctataatgatacatgcagttctaattaattcatttcatttctacacagcattcatttttttaaaatctcctacttctattggtgggtagttagttacttccaccctaaaaccccaaactgcagtgcatagtctcgtatctgcctcactgtgcacacgggcgagtgtctctccagggtatgtagctggaagaagaattgctggctcctgggaatgtacaatttgggaattattaaatatcgctcagattattccccaaagtgattgcagcagtttccatcgtcactagccgtgtctgaaattttacttcttcatgtccccaccaacatgtggcactgtcagacatttttaaacattttttccaggcatcgggtgctaaatggtattgcgtggccctccacagggatgctgtgcatttttcacatgttgattgtggctttttcttttcttttctttttttgagacggagtctcgctctgcctcccaggctggagtgcagtggtgtgatctgggctcactgcaagctccgcttcctgggttcatgccattttcctgcctcagcctcctgagtagctgggactacaggcgcccgccaccacgcctggctaatttttttgtgtgtatttttagtagagacacagtttcaccgtgttagccaggatggtttcgatctcgtgacctcgtgatccacccgccttggcctcccaaagtgctgggattacaggcgtgagccatcgtgcctggccgattgtggctttttcttatgtgaattgcctattcatagaagtttgtctcctttttctctattgatcattcatgatctttatacaagatgcgaatccatttttggttacgtattttgcaaatatctcctacactatggataattgtttcactttgtttataatgtccttagcttaataaaaaatatttttaatacagtcgtgttaatcaagcatgttttatggtttgcgcttttatatcttaagatactgttctttgagttcacaaaaatgtcatcatgtgtcttaaaagttctaaagtattgcttttgacatttttaggtctctaatccatctagattttattggggtgcatagtgtgaggtaggaatctatcttcctcaatatggataaactatgttttagttcataatttttttcctgcaattaccatgtatgcctgggtgtgtttatgaactcctcattgtggctcattgggtttttttttgtctatttctccaccatatggtcttcatggctgggttttgataactcgtaggacagcttaccttgactgtttttaaaattgcctgttttattgaccctttaatcttcttatttaggttctacaacaaaacctgatgtaatttttattggaattgcattgatttacaagttagttgggaacaattgactttttttatattgaactattatattattgcatatgccctctccatttatttgtggctttcagtaatgttttattatatttttctatacagatcttggacttttttgttagatttattttcaagaaacttgtagtttctatggctattatgaatagaatatttttctgtattctatctatatttcaactagttattgtggcatatgggaataccattgattatcatgcattaatcttgtatctagcaaacttcctgaacgtttattatctttcatacttcatctgtaggcttttttgtattttctgccttgacaatcttatcatttgaaaataagaatagttttgactcttttttttttttttttttttttttttttgagatggagtctcgctctgtcgcccaggatgaagtgcagcggcgcgatctcagctcactgcaagctccacctcctgggttcacgctattctcctgcctcagcctcccgagtaactgggactacaggcgcctgccaccatgcctggctaatttttttgtatttttcatagagatggggtttcactgtgttagccaggatggtctctgtctcctgacctcgtgatccacccacctcggcctcccaaagtgctgggattacaggcatgaaacaccgcgcccggccagttttgactcttgaccatggattggggcaacaaagatctcaacaaatttaaaaaaaaaaatgttatactttctacttcttgtttctttttcttaccttatttcatttgcctccagtataagattgaatggtagagaaagatatttgacatccttttcttgttcctgaccttaataggagtgcttgtaaagttttgtgatacacatatttgcagtgtctttgataattacagtgatggattgcttagtgacagggatactttctgagagatgcatcattagacaatttcatcattgtgggaacatcctagagtgcactcacacaaacctaaacgggatagccttctacatgcctaagctatctgatatagtctattgctcctgggctacagacctgtacagcatgttactgtactgaatttgggaggcaattgtgacacagtggtaagtatttgtgtacctaaacatatctcaacatagaaaaggtacagcaaaagtatggtattataagcttatgggaccaccgttgtatatacaatccatcattgatggaaatgtaatgtggcacgtgactgtaactttaataaggttaaatcagtcttgtatttgtaattttctaatatcttaaaaaaagatgttttattattgaatattatatgttttttctgcaattgttgataatctgatgacttgtctcaatctatcaatgtagtatattttagatacttaaggtatcctgatatatttcccagataaacctttcttagtcatatgttttcaatacacagctctttcggattgctaacagtttatttaggatttttgaaaccaggcacataagtaagattgttttataatttttttctcttagactgtctttgtcaagtgttgtactaatctcataaaatgaattcacaactatttctgagacaattttttgtaaaatttggatcatgcagttcttgcagattagatacaatttgcttgtaaccctatttgattactgtgtcaaaatgctgtaatcataattgaacacaaattcaggtattattcttttccttattgagtgaactttggtaactaatgtttctagacatttattatttcatctaatttttcaaataggttgacataaaaaatattcatggtattttctcgttatttaaaaaattctactgtatcagattattttctttttaatcataataatgtttacttttgagttattttgtggttgatgatgattagtcttgttagagttttgtctgtaatcccttcaaataacctgcttttgttttattgtttctttgttgtgtatttaatagtgtctgaccttatgtttgtttctttttccttcttttttccattggtttagatttttgttcttggtcttcagttttagtattaaaatgtttaactcaccttcaatattttttatcccacttaaactgttttctttaagataatacatttaagataatacatttacctggaattgctgttttagtgccatctactaagtgtcttgttgtatcttttgttctttttttcttttaacctgtaagttatctagaacttgagtttcaagtttattaacatttaggatgatttggagtaactttctattgttaatttttaatttaatggcatttaggacagataacatggtagaatgcataacatcttttctttgaaattgttgagatctctttgttgctctagttattggtagagtttaataaaggattgtgtgtggctgggcacagtggctcacgcctgtaatcccagcactttgggaggccaaggtgggcagatcatttgaggtcaggagttcgagaccagcctgaccaacatggtgaaaccctgtctctgctaaaaatataaaaattggccgggtgttgtggcgggcacctgtaatcccagctgctcagggggctgaggcatgagaatcactagaacccaggaggcagaggttgtagtgagccgagattgcgccactgcactccagcctgggtgacagagcgagaccttgtctcaaaaacaaaaaacaaaacaaacaaagaaacaaaaataaactactgagtagaaaataatgtaactgtttatgaggcacagggttcaatacatggcaaatgaatcaaccttgttaaatttttatttcaacattacatacgaatataaaagcataaaccataaaggaaaagttttaaaatacatgattatgtattttttaaaactacctcctgttaactttggttttgagttcttaatctgtttctaagagagtcctgttatatccttaccatgagaatggttataccaaagtttgttaacagttctgtcatagtttctctttatgtattttatggttatatatttaggtgcatctaagttttgtattgctttattttcttgaagatcattgcttcgattcttacttggtgtctttctttctccatgaataagttttgccttattttatttcgcttgatttattttagtcagtttacctgcaagactttttctatttcattttaaagctttgtaggggtgtgtgtgtgtgtgtgtgtgtgtgtgtgtgtgtgtatgcatgttcatgtgttttctttaaacagctggataattttaatgcaatattttagtctctagcttttcatataaaaatttaatttatttacatttgttataatgactgatatatttgaaactattttgtgttttgttagtttcttgtccctttacattgctctccctctattgctttcctacttttggatagattgatgttttctatgttctcttttgacctattgattcagaagctataaactctatttctgttcttttggtggttactcatacatttccagatatatgcttaatcataattttttactaacattaattttcacagtaatgctgtgggatagatattattatttccttcatataaatgaaagaagtgaggctcggaaaagtaaagtaaagcaacttgcccaggattgcatagcaagttagtaccctaggcggattctaaatgaggtctatattatttgaatatctgtcattttaaaaacctattatgattctgcttaaaagcgataaggtccacttagctagaaccatatttttgtgcaccatctttttttcatagtgttctcaggcagccagttctgccattaatttgtgaagccctcagcaacacgcattctgtctccaagcctcaatttccccatctgtaaagtggtttggttatccctaacggcacttctagaccatattttaatagtgtttggagattcctttgacaatggacatttgacaagctccccaaacaatttgcctttatgataaatggtgaaccaactaaggttggaatatagttactcacaacaacactaaacatcatgtagatttattagttaattattcaccatctttatcaaagtttgaatctttgtgctttaaaagggaaactcgcagaatgacatttatttcccattaacctaatgagtgatattttttgccctcctctctgtagcaatttgttataaatgggaggatgactggtctgagattttcttgtgaattctgtttgcagtgcttcctctggaaaggagttagtgccagcattttcagggcctttcaggcagtgaagatcgtagaatctgagccatctctactgcatggtcagtgtcaacatcagggaatgtccctgatgctaactcgccccacaggagaattaaaggcactttaggatatatgcaaaacaaaaacagacacaaatataagaaatgtgcaaagcccactgcctaagcatactcatgagtctgggttctagagtaagtaaatctgagtttatgaagcagctccactaggcactgtggtgcagtagttacagacttacatcctaatgctgagctgtctggattcagatctctgcacagccacttagtagcaatatgacattgggcagatcatttgctctttcatatcagttgttcctccatgtaagagccctggataacctctttcactttgtaacctgcccctcaactcggggttttataccctcatggcaaccaccccgaaatgcatagcccagattatttcttgcctctccgcctttgctcattaagtgctttctacctaaaatgctcttcctccacctcccctagctaggagtagctacctcctacttcccaattccatcccagcctgagctgggtaatgctcttctgtgcccccataatatatattttttcagaattaaagactaaaacacacctatctaatgttatattttactaaaattaccactttccagccagaaaagctggattcatattccaactctgccacttactagctgtgtgatctgaggcaaattacttcatctttgcatacttcagtttcattatctgtaaaatgggaatcataatactatacacctcattgattcatcatgatgactaaatgcatcaatagctataaagtgtttagaatagtatatgacacttaaaactgtctataaatgtaagctattactacatttgtaaaggcaataataataaggtctatttaaggagattgtcacaggagttaaatgcaataacgtgacaaagagcctggcacaatgcccagcccttaactcagttcagcaggtgagattgtgtgtgtgtatgtgtgtgtgtgtgtgtgtgtgtgtgtgtgtataatagaacagcattttgaacctaccaaaacaatacatttcagatataaagaccgtattctgagaaccaactcgtttttcaaagaactcaaaaccagcagtagagaaatagaaatacaaaatctagaggaacacattcgaggtcttcagacaatactcataatcctttatatttgcaaagcactcaacagcttacaaagtgctttggaatccattatcacatctgatccttgtcttatctcaacacgaaggatagggtgttttttttaacctctctttttgtggatgagaaaactcaggttcagagatgtggcgtgactcagccactgctccatcatcagcaaatggtgagccagggtttaaagcctagatctgctcattctcaaccccatgttttttctagaatattccaggacattctgagcatcccaggaaatggttagcatttcatgtggagacacagatttccaggtgtgtaaaaaccacatcccagtgttgaggcatctgcaccctgttttccttgaaactccccatctgatggacaggcccgtattgtatcgtctggtctcctgaagagtccaagaagggagttgttagtttctttcagagatgttaacacgttgtcttttaagtcagcactatttctagagaggtgaccagctgtcgaaatttcatgtagggccctggtgtaattctgcacctcttctgttttggcttaacctgtactttttggccactgaaggctgtcaaggagtctaaggtcacactcctggtgcccagtccaggatgcggcttctttgggactcccttgacagctgtccctggcaaattcaagattctgggggaaggaatgtactcacctctgggtaaggttcctctgcagaaaatgatctcatttgtttgtcctccaactggaaaagaggaccaaaggacagaaaggattgacttcaaaaggagcacatttacaatttactgaggtgtaacacaaatacagagtactccgtatcccacgtgtacagctcagtgaattttcataaactcataaaacaacacccagatcaataacattaataactctccagaagtccagaggctctgtccagtccctgcccacccaggactgtcctaactgctgtcagcagaacctggccagcagcagagggattcacctggcacatgaggctcttacaagatgaggtgaggtcacactgatgacttgcgtgcaagagatgggatgacagagtggctttggatccatacgggctatgatagcagcaatgatagtaactcatatttcttgtacatttattctgtgtcaagcattaggctaggcatgtatttaattttcacagcagcccaatgtggttggtgccaatcccatttctcagttgaggaaactgaggctcggagaggagaatggtcttgtccaaggtcacacggtgtgagtggcagaggcaggatttaaaccagggaacctgattccggaaaacttagaccctggccactgctttgccacctaagctcatgggtctccctttggctttcagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccaggtgggtgtcacgggatccccttgagaatcaggctggggaggatgctacgacctgcagagaattgctgtccctcccaggtatgagcggaaccatggtgccaacctccaactttcacagatgtgcagggagatggggggcatttcagggctgtgagggtcatgtggagtgtaggtgaggaggaggggtctaagaaggagtcctgttccctttttcagagatgaggcagaattcttctgtctggaaggcttgggcagatcagcactggccagaatggctgagtgcagtgtgcctgttgtgtgtgtgtgtgtgtgtgtgtgtgtgtgtgtgtgtgtatgtgtatgtgtgtatgcgtgtatgcgtgtgtgtgtggtgactgccaggactaggtatgagccaaatagcaatagtgtgtgtgtgtgtgtgtgtgtgtgtgtgtgtgtgtgtgtggtgactgccaggactaggtatgagccaaatagcaatagtgcaatagtgccagtcatgcaaaaccaatgcttaacaatagcaacagttatacaaacgttggcagtttgactgcctattagtatgctaatgatattgatcaaggcatgatgttgaccactggctgctaccagctggagccctcactaggtactgggtcctctgtatctctgcacatggtgctgcatggtgttctcaggattgctgagtgaggtgagatcatcaacttcatttcacaagtgcaggtgatcgggtggcagaaaggtacgatgacccacccaaagtcacacagcttgaaagcggcagagccaggatttgaacccaggtcttcaggctctaccatccttgggccgactcaaaggaggacaggaggagcggcaggtctgagggtggtagggaggtgaggccggagcagagactggggacctaaggagatgtgatgagtgtgggcggttgcggtggcagactgtggcccagggcagctagtgttgagaagtgtgaatggatcccacagggtggtgcaagccttgcggagagatgtcccaaagctgaatgatgtagcaggaactcaggatttgctaccggtccccatggggagctgaagacacctggggaggctcagagctctgttggaagtgttgtgtccatgcaattgatgttaccttccctcggataagtcattcttgctaagcccagatgccttcgccacctgccttcttggagggttactgtcccttcctccagtcagaggctgagctgggcctgggacccatgtttcctgactccaaacccagtgcccttctctcttccttctggagacacagcccatgatgaccaacaggtccccaggaagacagcaaaaggcagcagactatagcgccaagggttggaaacagcgatcccacagcttcggctgcttccagtctctggtgtcagtttctatctgtaaaacaaaacatttcagttagagcttattcgcttaactagaagacctcaaccaaaacaaaacaaaacaaaaacctaaatttagacttgatttgaatttcaccagtctctcccatttcctctcccgggatccaacccgggaccacactctgcattttgctgtcatacctgcccagtctcctctggtctgggacagtttctcaggctgaccttgctttttatgaccctgacagttttgaggagcactggacaggtatcctatggcatgtcttctaatctgggtttgatggttttctcatgaatagagcgagtttatgtgctattggaaagaatatggcagaagcaaacttgttaaaccagaagacactgggagggcccttccatcttgaaaattctgcgactcttagccatctcctttatcaaatcattctcttctagggtgacccaccatcctgacttgtctgagactttcttagttttagcactgccagtcctgggtcctgggcaagccaggatggctggtcattctatcctcttcatggccatgtcaggaagccagtatcacctgtgcttgaacgcattgccctgcttaatcctcatgatacccctaggggaggggaggtggcattgtgcccattttacagatgagaaaatgttgtccagaggtggcaagtggtgtgtccaaagtaacacagcaggtaagtggcagagtcggggatttgaataccaagtttgtgattctaagtgcagaattgagagatgcttttgactcacattgcgtcttcctgtctgcttggctgaccaggtgggtacggaaccttgaggcacctggcttgcttctaggtaggcagagttgctgtgtgattgcccagccaggggccaggcattttgagttgagcaactcccttggcagaaggccacatacctgcccattttccatcaaaatgtccccagtgccacagcacccaagcttcccttcccccaacaggtggatgtttttgaaaagaaaccacacagagattttgttactttttcttttttttttattaagtattcatgagaattctccctctgcagggttaaaatgcatgttcttgggaaaaagtggtatttaatgaaggcgctttgagctgaatcaaagagcctcattcttctgaaagtccttcttcctagtctctgcatccggctcctatcaaaggaaatccacagctttggcttttcgttgctgttgtcatggaaatcgttataaggatgggatcgcgtggaccagaggtcagggtacagttgctttggctcccagcgcacgtgtcccagatgccagagtcagagctaatcaaataaagcagtgatgacattgggcattgctgcatctcctctccaatgtacagtatttgtcctttgcctgaaggctccagggacataggtagggaaagcagacaggaggatgaaggaagagggagctaactttgctgctggctgctacttaagtgctgagcatggtgctgaacaatttcattcattcaatatttatgcagtacctactgtgtgtcaggcagtgtgctggatataagcaccatggatagtgagacagcggtggtacccaccgtcatagaatttacatctgatggaaaagaagacaaacaatgatacgaataaatagaatcatcccacaccttaatttgaatgagaaaggaaataaatagggtgctaagatagagaactgcaggggcgtcctgtttagcttgggtggtcagctaaaataccctgggagaaggagaaataggcagggaccagaacatacggggcctggaagtttggattttatcccgggggtggtgagaagccattgggaggttgtgagcgaagcgtgacagaatctgattcacgttttagaggattgtacttctgcatggagattggattgtggagggtatgagggaatatccttagaaggctaatgcacccttctaggccagaggaaatggtcacctgggttgggggagtattgatagagatggcaagaagggacaaacttggagctgatttggaattgatgggatgtgcagatgaggtttggttagcaacacttaagtgtgttatttcagaaaatccttgccataaccctaggaggtggatattcctatttttaacccattttactaatgaagaggcagtctctgagaggttgagcaatttacctaagggcacacagcaatacatgtcctatacccttacaacttggtttgaccaatacgggtcctattaacttctattgtcaggcacttactatgtaccagacttttccttagtgtcttggggtttctcaaatttggctgcacatcagagaagttaaacaccattttaaaatcacagacttctggattctgccccctcccccaccccattttaaaaaaatcaagttttggttggaattcaggatctgcatttttaaacaaccacatgaaggggttctggggggaaccataggctttatttatccctcagaacaccctttcgagttcagtggtagcatgtatattttgcagatgaggaaactgtcactgaggttatattagtgtgacagatcttatttccccctattttaaaattagttaatttttgagtagagaaaactggatccagcacttgctaattcatgacttttgacaagtgtcccgacctctctgagccctttttctaaagcgaagcatcatcatcatcatcacatgatggcccaggggctgaggagggaaaggcaatgaagccttcagaaacttgagcaggtggctgggcacagtggctcacacctgtaatcccagcactttgggaggctgaggcgggtggatcacctggggtcaggagtttgagaccagcctggttaacatggtgaaaccctgtctctactaaaaatacaaaaattagcccggtgtggtggtgcatgactgtaatcccagctactcaggaggctgaggcaggagaatcacttgaacccgggaggtagaggttgtggtgaactgagatcgcgccattgcactccagcatgggcaacagagcaagactctgtcaaaaaaaaaaaaaaaaaaaaaggccaggtgcggtgactcacacctgtaatcccagcactttgggaggccgaggagggtggatcacaaggtcaggagatcgagaccaaactggctaacatggtgaaaccctgtctctactaaaaatataaaaaattagccagatgcagtgacaggagcctgtagttccagctactaggaaggctgaggcaggagaatggcatgaacctaggaggtggagcttgcagtgagccgagattgtgccactgcactccagcctggacgatggagcaagactgcgtctcaaaaagaaaagaaaaaaaaagaaattagaacatgttctgcgaccttcacattcgctcactgtgatgacagaaaacctagagaaaggtgtttttttttttaagacagtgtcactgtgtcatccaggctggagtgtagtggccctatctctggctcactgcaaactctgcctcccaggttcaagtgattctcctgtctcagccttccgagtagctgggatcacaggcatccgccaccatgccctgctaatttttgtatttttagtagagatggggtttcaccatcttggccaggttttactgagttggtctctaactcctggcctcaagtgatccacccacctcagcctcccaaagtgctgggattacaggtgtgagtcaccacacctggccgaaagttttgttgtataaaggacatgtaggagggaatgtgttcgaatgcacatgttagaactgtgttcactctgcaaatatggatatgatctccactctgggatgaatttgaggccaagctacagggataaagaggaaatgtcaaggtctctgcccttaaggggctcctagtcctagaagcaggctataacaagcagagtgataaactcttttgttgtgggaaatcagggaccccaaatggagggaccagctgaagccatggcagaagaacgtggattgtaaagattccatggacatttattagttccccaaattaatacttttataatttcttatgcctgtctttattgcagtctctaaacataaattgtaaagatttcatggacacttaacacttccccagtcagtacccttgtgatttcctatgcctgtctttactttaatctcttaatcctgtcagctgaggaggatgtatatcgcctcaggaccctgtaataattgcattaactgcacaaattgtacagcatgtgtgcttgagcaatatgaaatgtgggcaccttgaaaaaagaacaggataacagcaattgttcagggaataagagagataaccttaaactctgactgccggtgagccgggcggaacagagccatatttctcttctttcaaaagcaaatgggagaaatatcgctgaattctttttctcagcatggaacatccctgggaaagagaatacgtgcctggaggtataggcttataaacagcccccctaggtgcgcctgtctcttatggtcgagactgcaggggtgaaagagactccagtctcccatagctctcccaggcttattaggaagaggaaattcccgcctaataaattttggtcagaccggttgatctcaaaaccctgtctcctgataagatgttatcaatgacaatggtgcctgaaacttcattagcaattttaatttcgcctcggtcctgtggtcctgtgatcttgccctgcctccacttgccttgttgtattctattaccttgtaaagtacttgacatctgtgacccacacctattcgcgtactccctccccttttgaaactccctaataaaaacttgctggtttttgtggcttgtggggcatcacggaacctaccgacgtgtgatgtctcccccggacacccagcttttaaaatttctctcttttgtactctgtccctttatttctcaagctggctgactcttaaggaaaatagaaaagaacctacgtgaatatcggggcagattccccgatactctttattggaggactatttggattagctaaagaggaggcccttaattttgctttgagagaggagctggtagctttggttatctctttaaagatggaaatgaattgctggttagataaggtacatgtatgtagacattctaggaggaaacaccagtgcgtaaaagggcagaggcacacagagacagaaagcatattcagttcggcatggtattgctggagtataaggtatccaggggttaaaagggcagagaggatagtgctggtaatggaggctggagccagttcatgaatggtttagtgagcttggctgaggagcttcagttttatcccaaagccacagggagccatagaaagctactgagcagaggaaggtgtggccagaacggcttgtaaaaattggcaggattccaggtgcaatgtctcacacctgtaatcctagcactttgggagacagagggaggtctttttctctgagcccaggagtttgagaccagcctgggcaacatagtaagacccggcctcaaaaaaaaaaaaaaaaaaaaaaggcaagtccccagctaaatcacaggagccctgatgtgcagaatatcaggctctaccagcagcaacagtttcccttagctacagcatcttctctccagatgggcaggcaccccctctgttcattgcccctgcatctagaaccctaagataatcatttggttcttttctcccagtttccctccactgggagctttggatacatctcagtgaacacctgaggcttaaaaccctcctgatacaatacagaagactcctgaaagccatatataggattcaaatcctgccaatgacacttaccttgctgcagatcttgggcaagtcagctgccttgcatagagtctttcttgcctaataagggggtacgataatctcagctgattgggctgatataaagaacactggaccatggatttgaaaggagtcattaaattgaaaaccctaagacagtgatctcctggccaggcatggtggctcatgcctgtaatcccagcactttgggaggccaaggcgggcgggtcacctgaggtcaggagttcaagaccagcctgaccaaaatggagaaaccccttctctactaaaaatacaaaaattagctgggcatgatggcgcatgcctgtaatcccagctactcaggaggctgaggcaggagaatcgcttgaacctgggaggcagaggttgtggtgagccaagatcacaccattacactccagcctgggcaacaagagcgaaactgtctcaaaaaaaaaaaaaaaaagacagtgatctcaaaatataacataacatccccaattggctctctcctttcattcaccggtgtcagctattggaagattttagtttctgagcacatgattttataagacctcttggaacaggtaggcagacaaggtgtggggttgatctaatgacacctgttttttttcagagctgatttctaattaattctcatggaatgtttccactggaaacaaactaatctggagacagaagcagttccaacaaccaagatatataattgagataatcgctgtgcacaaataacatctgtgagcagcagatgctaacacctggctccaaggagaaagtcggagatgatgtctgctccagggcagcagttgctttttctctccccctatttgattcatgcttctgacctttgtctcttccacagaggcaatatgttacttgctttctgttagatagagaaggatttgcactgaactctttagtcgtttacttaattcatgctgggggctgtattcacctcttccttctgagaacaaagctgccaccaagtcattgtaccctctaaatagctctgaaatgcatcccccgtctctctctgcttgtattacagtccacctgaatatctagtacttggatttctctcaagttggctggcctctggtcttgtctgagcaatctttgtaccgtctgatctttggagagagaattttaaaatttaaacgcaaagtcggttctttgtgtgttcaagatccattggtagtttcacattgccttcagcctaaagtccaggtttcttcccttgacctacacggatgcatattttggcacctaccctcctgtcacccctcacccgaagcttaggatggcttggtgtcctctgcacctgccctcacctcttcacctttgcccaagcaatgcccttggctgggttcttgcttctttcactgatccctctttgcctgataagcatctaagcattctgtgaaattgactttgggtgtcctctcttggagccctcttggtcctccatgggctgggtgagggtgccgcctctccttccccacaatctgttgggcctgcccctgagttagtacttgtcactccctgtaattattcctttgtttccatcgttttttttctaaacccttaaaggcagggactggggtgagtaaacatagtaaaagacttagccaaagtcacaaaggtaattaataaaaatcccagcctgggtttgaactgaaggaatccgactcaggtacctgggaatttaacctctccccgccatgccaccaatgcctcctgttggtcctctgctgtctcggggctattacatcctttttaatttttttttttattttgaggcaaggtcttgccctgtcatccaggctggagtgcagtggtgcaatcgcggtttactacagcctcaacctcaagcagaatacaggcatgcaccaccacacctggctaattgttctgtatttttgctagagacaaagtttctctgtgtcgcccaggctggtcttgaactcctgggctcaagtgatccacccgccttggcgtcccaaagtgcagggactacaggccacatcttccctggacaccctgagtgctcctgtaggtccttccacttgggaattctgggtcagctccggtgtttactcaggtggagccacaaagccttgtgcgacttatacactgtgagctcccagcagtggtttgttaatagcccgaggctctctgttagtgcttagaagactaataaccctggattcatgctcagtgcccttaattgggacatttatcaccgtgtgtcatccatgcttccatgagacattggaaatagttagtaagcactgggaagatgaccctgatgggagtcttttgtgtgtgggcacctggggaacatttttccccagccaggaactatggaacaggtggcttcctgcgatgttttatttgaagagccttttttaaaacgattatgttggagtgaatttattcaatgttaacataacctcctgtcggagaagataaagacagaattgtaattggttaaaaacatggttatcacaggcctgttcaccccacaaatgttgacacattcaatgctatgatgaatgaagtgggaagaggctggtttcattataggcaagaaggcggggacatctccccaaaaggacctgttaccatttagtcatggaggggcctgtcaaggtcgtgataactattctacagcaacgatattgacggggaacattgattctttacactgtgctagtcatggtgccaaatatatcaacgtcatgacctgattatatcccccaaacccacttgagtgcagtgaattctgcaatggcaggagccttttctgttttgaaccagtgtgtgggagtgtgactgtatacagcaagtgctcagtgaatgagtggggagagaccggacaggtggtggccagactccagaggagaggagacagctagtattatgccttttctttttttttcttttttctttttttttttttttttttgagacagggtcttgctctgtcaccaaggctagagtgcagtggctcaatcatggctcactgcagcctcaacatttcaggctcaagcaatcctcccacctcagcctcccaagtagctggcatgtgccaccatgccctgctaatttttttttttttttggtagagatgaagtttcaccatcatgtccagctaatttttgttgttgtttgtttgtttttttgtagagatgaggtttcaccatgttgcccaggctggtctgaaactcctgggctcaagcgatcctccagcctcaacctcccaaagtgctgggattacaggcttgagccaacacgcccagcctatgcccattttatacaggaggaggctctgcgtagaggcaaattgctcaaagtcacagagatggatggaactgagatttaagaaaatatattttgaaagaatttaaaacttacagagaagttgcaagaatagttcaaagggcttatttaagtttttcacccagattcatcaacttttaatatttttccacatttgcgatctggttctctctataaattttctgaattatctaaaagcaagttaaagacatggtgcccctgtatcctaatcaaaatcacaaaatttaatattgataaaaatccttccttccttctttcttccctttctttctttccttctttctcttttcttttcttttcttttttcttttctttcttttttttttctttgagacacagttttgctcttgtcgcccaggctggagtgcagtggcatgatctcagctcaccacaatctctgcctcctgggttcaagcgattccgctgtctcagcctcccaagtagctgggattataggcatgcgtcaccatgcccggctaattttttgtatttttagtagagacgggatttctccacgttggtcaggctggtctcaaactcccgacctcaggtgatctgtccacctcggcctcccaaagtgctgggattacaggtgtgagccactgcgccctgcctaaaaatattttctaatccaggagttggcaaactagggcccaaaagccaagtccagccaactgcatgtttctttgtggtttttgtttgtttattttattatagctggtgagcaaagaatttttttttttgtttttaaatggttacatttaaggtggttatgtaagtacccacatatatacttgattttgcctcttgacctgccaagcctaaaataattattatctgacccctgattttatctgctgtctttttaaattttgccaattaccccccagtgtccgttatagcaatttatctcccaatttaggatccaacttggaaagtaaaactgcttccattattttcatggtgtcatagttcctcagtctgtctttttttatgatactgacattttttggagagttcaggccagttgcattgtagaatgttcctcaattttgggtgaactggaatgtgaacccctatttctttccaatttcagagccatttttatttatgcaggtctgagattcccaggacaaaggacttttaaaaccagaaagtcccagaccaaaagggatgagcttgtcatcctagcaccagtgtctcaagcactgagtaatcctggggaagataaaatctccttaccctggccccaccctccacctggcctttgcagtaaagccagttctcaaaagccaactggtggttttagcagaaagggtgatgaaccaaatgccagtgtgagaacctgtccccttccacacaggccttttgtcttctgtcttcccatgtttctcgttagagaaattctcaccatccacatgtgctggccttgtatcttgccttttttccctctatttatgcatgtgagctatattgatattattgcgtgtgttttaggcaattaaagtaatggcaaaaagtaatggcattaaattaatggcaaaaactgcagttacttttgcaccaacctaataattggtttattgttgttgcggttgtatgtgactaccacaatttatcttatccatgttgctgtttatggatatgtgggttttgtctaggttttggttatgaatagagccagtatgaacatttttttgcacattattttatgggaggggagcaaatgtatgcatttctgtagggtgcataactagaagtgtggtatctctgggtcatagtacacatggtttttgtctttagcagatactacaaaataaatttccaaggtacctgtagacatttacattcccatcaacagaacatgaaagtcctactggcttcctgtcatggctggcagttggtattattatcagttgttggcattttagccattccgagggaaggagaatattttttattctattttgcacttctctgatgttcaccttttcaaagtatatcatccatttcgatatttatttttacctgtccaaggcatatgcttatttttctgttgggttgtttgtatttttcttagtgatttgtgggatactttgatagaagctctttgctacatatgtctattgccattattttctctcactttagggttgaccattacattttcttggtggtgtctttttatgaagagaaattcttgattttgatgtaatctaatgggtcagtgttaaacatcttagaatccaaattttaaatcagttggtcaggcagagggtgttctgtttagctggatattctggtgagttgggagtggtgcaggatgatggaaagtctacctccatggccaagactctgtgaacccccagaatttgaggcaggtctcagttaatttagaaagtttatttctccaaggttgaggacgtgcgcctgtgacagcctcaggaagtcctgacgaagtgcccaaggtggtcggggcacagcttggttttatacattttagggagacatgagacatcaatcaatatgtgtaagaagtacagtggttttgtccagaaaggcagggacggctcaaagctgggagggggcttccaggtcacaggtaggtgagagaaaaatggttgcattcttttgagtttctgataagcctttccaaaggaggcagtcagaatatgcatctatctcagtgagcagagggatgactttgaatagaatgagggcagatttgccctgagcagttcccagcttgaattttctgtctagcttagtgattcgggggctcaagatattttcctttcactactcgtggttccgtccctcagtgctcaatcagtttctgctaggatttgaattacgctggtggtttccaggctcgtgtgggtgtgtgcacacacgcggtgtgttttctttttagcaaaataatccacttattaaagagaaatctcattaaaatgccctctgccctgaccattaatagtgtaactgaaaattgggttagttgctggccaccgcatgtagagtccaattaacaagaaccaggcctggtacaggaaaagtgagttcatttctgaagctagcttgggagaagggcacaaaacatcctactttaaatgtgccgctttgcctttggagcaaaaagcagacacttccataaggtcaggaggagagtgagcaagggaggggggtctccctgctaccaggtagttacctagtgggcagttgagttggcacctttctgggcaagagtaagttgtaaaagtggccgagtggtcatgccttaggcatgccctcctgaggcaaccccctggagggggtactttcctggggacatgctttgatttccaaatcaattgtctgctctggaggagaaattcatcttggagcacatagatgaacttgctctataggaaacattgggtgagggggaggtgagaggttattttgcatttcaaaaagggctaagtaggaagtagagggaaaggggaaaggagaaaagaagagaaaaaaaaaaaccctgtgtcttagaaaaatgggggtacttggttataattgggcttcccttgtttctcccagagtaccctccttctggctctgaagaaaggtaccagctcgggtatgtggggtctggtgaataaggctgtggtcaccctccctgtccaggtcatttcctcctacagagggggatcctgcccacaggtcccaccccttgtccttcctgtggacactgtgggtatctgggttagagacctatgcatggaggatgggggagcactcctggttgcgggcttcttcccaaggatgcatgcagtgcagacaggctacagagtcaggcagtcctggctcaccctgcgggttcactgatgctgctgagctcacgtgtctgcctcagtctctcagtacacgacatgtgtcgagttcatactatgtcaggacccagagttgaacaagagccaggtgaccctccaggagcccagtgtccagtggggagacagacgtggaggcacaagacctggtgctgtttaggggagcaaaggggtgctggaatataataaaagagggatgtaaatgagacggggatcggggagggccttttttggatgttttatcctgcttttctatttttctttctctctttggagcatcagtgtgatccagattcatcatcaccagagaggaagtcaggatagaagcttttgaagtctgttcagtggtggaggattcaagcagtccttagatcctaaaatacaaaaaattaggaggactcttgaaccctcaaagaaatagacttaagacaagtgaaaggaggcctgctttactcagcaggtggtgaacatattccacaggacttacaggaaaaagctgtggacttaaaagagacctcggttcagattctgccaccttcactattagctgtgtgacattgatgagttaactaacctgtctgtgcctcagtttcctcatctgaaactgaaaacagctacttcctagaaatgttacatgttataaattaacatgtcttaatcagctcaggctgccataaaaaaataccgtaaattaaactaggtagcttcagtaacagacatttatttattatagttctggaggctggaagtctgagatcagggtaccagcatgcctgggttctgctgtgggctctcttcctggcctacagacagacaaatgccttctctctgtgtcctcacatggtagagaggaaggaactttttggtgtttcttcttctaagggcacgaatctcatcatggaggccccaccctcatgacctgatctaaaccttattacctccccaaagcctcatctcctaataccatcacattagggggtggcttcaacatacacatttctaggggacagaattctgtctctggcaatgtggtaaacacttgatactaagtagttgtgattatcctactactaataataatatttattattactttgaagaagatagaaaaataaatattcaggaagatttttttttttgagacagaatcttgctctgtcacccaggcgggagtgcagtgagtggcgtgatcttggctcactgcagcctctgcttcctgggttcaagcagttctcccatctcagcctcccgaatagctgggattaatgggtgtgcaccaccatgcccggctaacttttgtattttttgtagaggtgggtcttaccatgttgcccaggctgatctcaaactcttggcctcaaccgattcgtttgcctcggcctcccaaagatctgggattacagctgtaagccaccatgcccagcagggaagtgttttgatacattgataagtgatggtctggagcagaatgtcatgaaaattatggaatattcaatatatacccaaatagtttaagttaaaaggcaccaagagtagccaccacactgtcttaagatattctcccccatggccactgtcatcagacttctgggctgcacagaccattggtggacctggcctgacattctttttttttttttttttgagatggagtttcactcttgttgcccaggctggagtgcaatggcgccatctcagctcaccacaacctctgcctcccaggttcaagcgattctcctgcctcagcctcccgagtagctgggattacaggcatgcaccaccgcgcctggctgattttgtatttttagtagagatggggtttctccatgttggtcaggttggtcttgaactcctgacctcaggtgatctgcatgcctcggccttccaaaatgctgggattacaggtgtgagccaccgctcccggccgacattcttaatatgtttgcatttaacaattttgtttgatgttagggctgtctctagtttgatctgtgggtgattcccttcagggaaagccttaatgttgaaggttggttctttcaagtaccctgatgggatgtcaaggcctgggatgtgttgagaatagccttccaaagacaccatttcttaaccagaatgctttccctgtggtgtttgtgatgcactatttttaaatcccctcagttgttcaaccagacccagaaatccaggttctaaccattctgcccaaagactggaatttttcctctccacacctcattccatatgtctagtcaactcatctagtagcttaacaaatcctagcaaacatttcacctaggtatttaaagcaggcagatggcttcgcatagagaagtaatgctattcaacagtttgtagttgatgtatatgtgataggaatctcaattggcctcacactgaatgaaacagaggtgggtgaggggagagaatgcctagatttagctcaggaacagagactagtgtgtagaggagtctttggggtggcccaggaagggcatgggtttggagtctcaaccactagcacacaagtctgaccttgggcaaatcacttcttcctgggctgcagttttctcatttgtgaaataatgaaggctgactgcttccttgcagggctgttgtgggctatagtgataatgaattttaagtggccacgcagtgcgtaatgtagtgagtgttgaagaaatctccttccctctttccccctcgatgagtaatcgggaaagggaaatattgatcctcctatgggtaaggatccatacacagaacaggtaaacagtaaataattgttactctgtcacagggttttgggtggaaccactttgatccaacttttttggtagattagcatcaattaacactatggaagtgtttggttttgcttttttaagagatgggattgcccaagctggagtgcagtggtgtgatcatagctcacagcagcctttcattcctgggctcaaggaatcttcctgtctcaccctcctgggtagctgggactacaggcgctccaccatgcccagctaattttttgctctttatagagatgaggtctagctatggtgcctaggctggtctggaactcgtggcctcaagtgatgctcccacctcggcctcacaacatgctaggattacaggcataagccaccatgcctgacagatagcaatgtcttttgagtgtttattctgtggctaacatcatgtatgcattacctcctttaattcactcatttgtatctgggttttgggtggtaacccagttcaaattggcttgcatagaaaaagggaagttattggccaaaatatctgaaaagttctgaggctaggactgccttcaggtttggctagatctaggtaccccaatcatgtcatcaagattatgtctctgccacctcttaggtcagctttaagatacaacagcagcttatatcttaagcatgttccatcttgtattcttaggcagactcttcgatcttgcccagactttccaagcttttatcctgcttcagaaagagtgaactttattttcatagtctcagcaaaaatcttggtgtcaaccatgtcgttattacagaaccaaccactgtggccaacaggaggcgatgctctgattgggtaggctgggtcatgtgcccctctttgagcttggggagcaggatctgcaccatcaaagcacatggatgtttggagatggatatttatcacagggaagatggggtccttctctcaaaagaatgggaagtggatgctgggcatgtaccataccacattttttgtacagagcgtctgtagtgggcactattgtttccaagggagagcaaggtaatggctcagagtgggaacttcatgaccagactacctgggttcatatcccagctctgccatttagtacttgaatgaccatcagtaagtcactcaacctctctattcctcagtttcctcaactataacaacaggaatggttgttgaccctacctcggagtgctattctgaaagttagatgaattaatacatgaaaagtgttcagagcagtgtctggcacagagtaacagctcatgctcataacctttgtgcatggcatctcctaggcttgtacagtgcacaactgatacagctgtactcagcagtcctactcaatgaacgcaaatcattttgtcccccattttttggatgatgatatggtttggctatgttcccacacaaatctcatcttgaatcaaaagtagctcccataattcccacgtgtcatgagagggaactgctgggaggtgtttgaatcttggggagcaagtctttcccatgctggtcttgtgatagtgaataagtctcacgagatctggttttataaaggggagtttccctgcacatgccctcttgattgcacccatgtaagacatgcctttgcttctcctttgccttctgccgtgattttgaggcctccccagtcatgtggaactgtgagtccagtatacctctttcctttataaattatccagtctcaggtatgtctttattagtagtgtgagaacagactaatacgcatgggaaaaatcaaagttcagtaacctgcccaaggtcacaggctcatagatggaggtactgggactgaaatcccaattctgcctgacctttgggtctgctcctaaccaccacatgatactgtgtgatgttaaacatccccccggtggtagagaacatagagagaatgcaacctctccttccctcccattctttgaccctagatggagctcatctcatcttacccctgtgaactccaggcttccaggacccacaatcacagaagagtcagggccccaccaaatatccccaggccaaagcttagcagcacttaatttatgcataagatctgaagcatgtttccctctgtaactacagtatggggaggacttggaatgaacattttactatttagtagaagaagggtcctatcccaagggaatagtaggcaatgaagccctccgtagatgcctgccttgcagaattcgagcagatctggggaagccgggctgatttaattagagaacaatagaatgacttagtacgcacggaggaaggtgctttttctagctattgaaagtgttttggtgctttgtacccacatactcatgccattgttctattgattttacaaaaagtaaaaattggaagagaaacaaaaatctaatgaacttaaactaaaatcaaatcagatgtgttgttgagggtctattgggatccagcccacactaggtcgggagacagatggaaattgcaggaccttcatctcaccctaaacctctccacccctgagaggccttgtccatggggacgtgatgattactcagagtcgaaaggtgggaagtgtcagctgtcacctcaggtcctcattgtcacactggccacaagggttggagagtgaacatcaataattcttccctgtcgcctgtcaacccaaccacctttactacccactgctctctgatggctcttcctggagctcctcaggggaaggcattttcaaaggcgagtctggccagtgttgcgccactgaaggatctgatctctgtccttaacatgacttgccaccgacttcataaaaacatcagtcaaacagcctccgtatggaaataatgtgcagtgaattcttcttatgctgggtcatccataataaaaaatcagccagaggtggccccatatttctttctgctccctaaagtgcaataaattgaaacttttaaagctcagcatgaagacagcttgtcagcagcggcctggggcctgccccgtggaggtcttgggctgggaaatgcctggtctggtctatccagatcctcttaaaatctagacctgcttgacttgtgtgcctctgggacactgacctccctctacccatcccagtggaacaggaaggctaaaattcctcaagatggtcagtgctgaggccctgcttatcctgactgtgtaaacttggcccattcttttggcttccgcttcattttctttctctctaaaatggagttaaaaattcccacttcccagggatgaaaggagctcacaacgacaattgttaccattttgtaatgttttctcactgccagacactgtgtaagcactttgcatgttttcatccatgtatcctgcagacatcctgtgatggaaccatccctattttatagaggaggaaaactgaggcatagcaagacggtgctgctggcagaagcagactgcctcaggtctggctccagtgcccaagctctgaaccacacacacagtgaaatctggcacttagtgttggtaacgttggtttccttcctctgtccttcggaatgaatgtgttcatccctggcaggttccaggaatgatgcatatttccaccacatttgctcaaactccgagttctgtcattttacagactcccaacttagtccaggctctcctgatgctgcctaagaggtttccgttatagcacgaaaccactgagctgttttctctgcaacagagctctctctttattttgatccattccgtctgtgtggtcagacctcccagtgagtggctttctatgaggggcagtgaagctcagtagttaagagcttgggctctggcgttggagcaagcaggctctccacagaccagctctgtgatggtgaacaagtcacttcccctctgtgtgtctcagagtccgcctttatcaaaaggtcctaatggtggcacctttctcctagaggtgctgtggggctgtcatgaagcaaggcagagaaagcacagtgccttgaacatggtccccaagcaacagtagcaggtgggactgctaatgccaaaaccatcagggccaagataatcctatctccagcccagtatgagctaagaaggccagcagctgtctccattgactgctgtctgtgttcatctctctctggggataagtcgtccctctctctgcttgctccaaggaaagaagggaaaggaaagagcatttctggatcatgcaccattatgccatctataaaatggggataaaaatagagtctcctttctccaggggctccgaggactggcgggatcatgctgctgaaaccctctgctgaagtaggggctgggcagatgggaactgtgtcatcgtgttctgctttgccctgttgctttatttacaatgactctctcttgcctcctggctcccagcccagctccttggcctggcagaggggccctgcgtgaggcctcctcttccaccattagttatctgacatcatctcccttgatggcccatctgctcctgccgcccagaccttttgttgtttgcatgccctgctgtgccgattcttccatttctttccacttccaccccttccaccccggctggagcacctccaccgcctccttcctgcaggaccatggcgatcccctcactggctgccctatttgcaatctggtcccaccctccccacagcagccagagggagattaggccacctacctccttagaaaccatccatggcttcctggcagactgaaataaaatctaagctttgtagcccagctcacaagcctcagagatgtgacccgcgtccacatcttcagcatctcctcctcctctccttctctgtgcagctgccctgccgcactagtgaggtttctgttcctcagcaccaccgttagttcctgtctctgcctcagggcctttgcacttgctattgctgctgcccagtgcgctctgcacatggccatctactttgcatcttgtttctttctttcctttttttttttttttttttttttctgagacggagtttcggtcttgttacccaggctggagtgcaatggtgcgatctcggctcactgcaacctctgcctcccgggttcaagcaattttcctgcctcagcctcccaagtagctgggattacaggtatgtaccaccatacccggctaatttttttgtatttttaatagagatggggtttcaccatgttggtcaggctggtcttgaactcctgacctcaggtgatctgcccgtctcaacctcccacagtgctgggattacaggtgtgagccaccgcaaccagcccttcctttgcatcttttaggtcttagcttaagtgcttctccttcatgagtcctctgacttctcaaaagaggggctggttttgccctgctgccttcagggcagccctatcacccacctcctagccatggcagaggcacttgagttacctgctggaaaataagaccaggcctgacatctcacttcttctgtccattatgctctaacaaggccaattaccttcctttgctctacatcaattttctcagtgtgtctcaatccctcccatttgccgactgaaatgggcccccagccctcttttgctgggcccaactgcaggaatacatttttctcaggggctggaaaagggggttttgtgagttgtgacccatccctctctgagccccgaatgtttaccttaggtgatttctaagagtgttttctgttccgagatacagaaaagggggataagagggccaacgggacttactgtagacctgctaaatgttcagcactctgaatgtgcaggcatcctgctgtgagctgaacattataaatgagctgagttaggctgggcatggtggctcacgcctgtaatcctagcactgtgggaggccgaggcgggcagatcacaaggtcaggagttcaagaccagcctggccaatatgatgaaaccccgtctctactaaaaaacaaaaattagccgtgcatggtggcaggcgcctgtagtcccagctactccagaggctgaggcaggagaatcgctggaacccgggaggtggaggtcgcagtgagctgagatcgtggcactgcactccatcgtgggcgacagagcaagactccatctcaaaaaaaaaaaaaaaaaagctgagttagagttcagaagaggcagctgccaactgcagaatggatttagggtatgtgcatgaatatgggtttctccagtggggcgtgtctgtcacctggggccacgtacataagtaattggatgaatcttgatgactccactttgctaggataggaggcctactgtgtgcagctgggaggaaaagagagaaagaaaagtgtgagaaagagctttatttaagtcggtgtctcttagccttcgaggatctagtgaaagctatgaacccagcaaaatgctaaatgctcacatgcagaatattttgcatacccttttaaagggggtctgtggacccacttttaaccctgaaccctggttaagaaacttccacttggctggttcccatgggccgtcaaaccacctcctacaggaagcctccctcaattcccatcctgtgtttccactgtgccagtgtcaccctctttcctctactgcacaaagaggttgtcattagctgttcttgcctgtctcccactgagagggcaggggccagcttgattgttccctgcatgtccagtgcctggcactgaatgggcttcagcaaggatttgctgaatggaactgaagaataactcctggtgatgcaccaggggtgacattttgagtgggctcagaacctggcagcttcaaatgcaaatttatttgctttctcccaggtgtgagttgatgaatagttgtgaagacatgagggccgcctgtatattaatcccatgcctgggaggggctgggctgagctagaggggaaggacattgaaggaggcagcctcatgaggaggcctctcctctcccctcgcctcccctctcccctcgcctcccctcccctcccctcgcctcccctcgcctcccctcccctcccctcgcctcccctcccctcgcctcccctcccctcccctcccctcgcctcccctcccctcccctcccctcgcctcccctcccctcccctcccctcccctcgcctcccctcccctcccctcccctcgcctcccctcccctcccctcgcctcccctaccctcccctcacctccccttgccttgcctcgcctcgcctcccctcccctctcccttcccctccgctctcttcccccctcccctcccacctcccctcccctcccctcccacctcccctcccctcccacctcccctcccctcccaccttccctcccctccccacctcccttcccctcttcccttctcattttcttttcttctcttctccacctcttgcctggtccagctggagcagagtgaagccaagtgtgaggaggccttgaagacgcagaaggtgctcacagcggacctggagagcatgcacagcgagctggagaacatgacgcggaacaagagcctggtacctgtcccttcctgcagctgcagggacctgggccagcataggcctctgggagctagtgtgggcctagtgtgcgctcagcactataggaagtatgaggacatttattgtaaacctaccaggtagcaccttggaggtacagacatccattgtaggccttttatgtgctcagctctgtaagagggacaaggggacttattgtagacctactaggtgctcagcgttctgaatgtgcaggcatcctactgtcagctgagcattataaagatataagggcatcagcgaggctcaactgtgtgttcccatctgcaacgataagcaaggaagtctgttgtggacataatgggtgctcagtgctgtgaatgtgcatctgatgtgagcttgttatttgctcagtacccaatgtggaaacacaactgtatgttgtgtgcccaccctgcttgccactctaagtggttctcagacatctgctgtggtcctactgtgtgctcaccatcatgagatggaacttgttccttattgtggggctactgcatgtcccctctagtaagtggagacaagggcatctcttggcccgcttaggcttattaccaggagaagatttgagccatttattatggaactaccctgtgctcacccctgaatggggacacatggacatatattgtcgatgtattattttggtgagaattggatgtaggtttccaagtcccctatctgggtgtacagggttggcttagatttatactcaatgtataaaacactaaagtttaggtatagttcgagttttataggcaaatgcttatctcaagatctctgtgggcctttttgtcccttatgttgttggaacttgcctacaagcattcacacacacacatacacatacatgcgcacacgtgtatacacaggaatgaatgtacatattcacgtgcgatcaccaggcacacatacaaaataaatgccctccgtataggtaacctgtgcctccaagtttattcatccacccaatacatatttattgagcacctgttatagggctggcctggtgcttgctgctgaggttatgtttgtggacagaacaaagtccctgttctcagggagagcgccgggatttgcattttcatatatgtactaggcacatttaaaatgtgcacacatagattcccaagtgggattgcacagacataaattcatacacacatacaccctgaattcatagtcacatgtaatgcctaatacacacacacacacacacacacacacacacacacacacacacacacacacacacaccaagctgttatacctaccacatgcattggtaaccacagccactcttaaacattgatggtcactcacctcacacacctataggcaagcccctctttgctcttcctctggaccttgctgcccatccctcaccctctcaccttgccttgaccactgatctgcctcccccaggtggatgagcagctgtacaggctgcagtttgagaaggcggacctcctgaagcgcatcgatgaggaccaggatgacctgaatgagctgatgcagaagcacaaggacctcattgctcaggtagtgaatgagaccttggtggaagaagctcagggacttggggtggggtgaatggggaatgttgagaaggtgatgtggttggactactccctggtcttaacatcttggagggataagtgcacagagatagttaggaattgtgcatttcctgtggtcctaatggaggacaatgtcaccttcagatggtgtgtgcatctctggaggacgtgtccaccatgaaagatttggacttattcatgcatctgtctgcccatccacccacccatcgatcattcatctgctcatcaattcacccattcacttttccacccatctactcattcacccacttaactatccatctatccattgtccatccatccatccgtccatccaatcatccacccatccacccaaccacccatccatctgtctgtccaaccatttatccatctatccagtcatccatccatctttccattcatttatccatccatgcagccatccattcatttatccattcatccatcctaccaccgcttacccatttattcacctatccacctatccaaccatcattttcttttctttttcctgtctttccttccttccttccttccttccttccttccttccttccttccttccttccttctttctttctttctttctttctttctctttctttctttcctctcttttctctttccttctttctttcttccttccttccttccttcctttctctttctctttttcttctttccccctctttctttctttcttcttatctttctatctgtagctatttattcaatatttactgaatccttgccatgtgttaggcactgtgaaaaatgctaagtatattgtggtgatcagaagcacatcccattcccaccttcatgtacctcacagtttagtgggctgggaagaccttatcatatggtcacccagagcagagggcagacttgcaaactgagccaagagtccagaaaggaagtgtacacaattctgcaaatcctgacctaggttgggagtcaggaagggcttcccagagtaggtgtcatttggatggagatctgaacaaagaataggagtcacttagattggagtgggacattggggattgggggtgccttccaagcagaggaaatagcacatacaaagggcctgtgatggtgcattggagagactgaaaggagaccagtgaggacaatctggcacaagacaagctcagcaaaagaagaggatcagatcagggtcttagaggctgttatgagattgggttttattttatggttgaagggaatcaattggcaagcttttcaggggcaagagcagttggagaggagcagccagcatgccaccccagactgtcatctccataaaggcaggactctcctctgccttgtccagtgctgtattcagagccaagaagggtgtctgccctggaggtgctcagtaaatcactgttgaataaatgaaagctgactttgtccaggggaaagacaactccagcctggtagatggagtgaagatgaggaggagtggatggatgggcttgggagatgatcgggagccatgagggcagcatgggtgaaacagaagctttggggtgaagctgaggggtatgatgtggaatccccagcagatctccacataatgactgcataatggggagaacagctccctccttgcaatacaccatccagaggagagccggggtaaaatacctgccacgctctaaatgcatctgacagaggttggatctgaagggatttctgctggacaaggaataataataacaaaataattgatgatatcatccacatggtaacaaacaccacaaaaatagcctatgccaatgtctccacttgcgaatcacacttatttttgcctcaaagagaggttaatctgttcagttacaaaggcactatatgcatatgcccataataaataatttaaataataaagatacaagaaatagaaagtaaagaggtgtttctaccctctagaattcctctcttcagaggtaatgaagctcaacagttggttctattttaaaaaaaacctttactctccactgcttaatttgatctctgaacaaacccaatacggaaaggctgagctgagattgtcagtccgttttacgaatgcagagactcaggtgcagagaggctccacagcttgctaaggccagggtccaggtctagaagctcagttaaatgaccctccgagtagctctcatccctcggaatctggtcctagtgccatggccagcccacttctgtctgggttctcaagggtatataataaaatgctggacagtggaccaaatccaggggcttatataattggagtgactcagcgaacattgaaatgaaagatggtgaggaggatgtgagaggtaatttttgggaaacagctattatcatagaagctctgagagatgtagacatctgtgggtggggaaagtagggattttcaggggtggtttcccagcaaggcttgtggactcagggtgatatatatacatttttttttttgtctcaccagtctgctgctgacattgggcagatccaagaactgcagctgcagctggaggaagccaagaaggagaagcacaagctacaagaacaagtatgtgctcagagccatcctatagttgtattagtcagggttttcttagagggacagaactaataggatgtgtgtgtgtgtgtgtgtgtgtgtgtgtgtgtatgagtttattgtttgtttatttgtttatttatttttgagacaagagtctcactctgtcacccagactggagtgaagtggcgcgatcttggctcactgcaacctctgcctgccaggttcaagcgattctcccgcctcagcctcccaagtagctgggattacagacacccgccaccatgcctggctaatttttgttttttaagtagagacggggttctaccatgttggttaggctggtctctaactcctgacctcaggtgatccgcccttctcagtctcccaaagtgctgggattataggtgtgaaccaccaggcccagctgggaaatacgttaagtattaacttacatgaccacaaggtcccacaataggccttctgcaagctaaggagcaaggagagccagtccgagtcccaaaactgaagaacttggaattcaatgttcaagggcaagaagcatccagcacgggagaaagatgtaggctgggaggctaaggcccatctctctccttttcacgttttcctgcctgctttatattctctggaagctgattagatggtgcccaccagattaagggtggatctgccttccccagcccactgactcagatgttaatctcttttggcaacaacctcacagatacacccaggatcaatactttgtgtccttcaatggaatcaagttgacactcagtattaaccatcacagggaggaagagagggattctccctgggcacttacttatactttggctcctggaaactgtttccttcattcttttattcatcagttcattcaaatactcactcaattccagttgtgtgcgaggtgaattgagaccagtccttagacagacacatgcacacacactcacactcatttactcttggcctgtgcttgtgctgaatccaagcgtgccccatgcactgagattcagccattcagtgcagaattttctccgtctgagaaatggctccaagaacaagagatggtctgtgcaagacaggatcacgatcctctgcgaaatcttcctttgaagtcatggtccctccaaacatctctggctttccatcattacctagagggttgctattatccatgaaattttcaaagctcttctagaaccctggcatgcacctgcttaaagtgactgttggagtgaccaggtctcaagcaatttcctatgggtgctggataacaacacgcacaacaaatggaacagcagcagtggccatttgctggctgcttattatgtgccagtcactaatctcctctaatcctcacaagaaaaatgaagaaaccaaggctcaaggaaaggaactgactttctcagactcacacaccaggcagaaacctggctcccaaacccacacttgcttgtatcttttgatgctgtagcttgttgctcacagactagctttgctccttgatcagagcagggaaggagagaagggaagcactgattaaaagtcttgttttcaattgtgaaggcataagaagcatcacctcccagcacctgagacccaggatcagggtctggtgtgagggtccagtgaaggtcccaagattgacacctggccattcttgcttgtgcagacatttaacatgcagcacacctgagtagagaaggaggtggtgtgaatagctcctcccaccctcccaggctgggtcctgcacatgtctctgtcctggtatcagggacaacagatgtccaatagacttctctcatacttacagctgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtacgtagtgattcataaatagtgcctgggccaagagcagggagagcttttgtgtaagcttcatccatccttctactactcatctatctactcacatgccttcatctagatatacattactcatccacttctcacccaagctccctccctccttccatcatagcatcatccctcaagccacctacccatttacccatctatcctcacgtatgtctctccatctccttccaccatcatgggtccattcatccatcctcccttccatttgttcttcctttcacctttactttttcctctcttcctctattattttttctttagccctcaacccctctgtctgcccattcttctatgcattgatccagttcttcctacctccgtccacctactcaaccacttacatgcccaacactcattttgaacagaaatttattttgcacccagtgtgggctaggccctgttttaggtgcacagaagacagatgtatgacacagatctgctttcagaagcatatgtctttgtaagcaatgtgggtaagatatgtacataaatatctgtaatatggagagagggctgtgatgtttagaggatagagatcttttcaagactctggaatcaggagggcttctgggaggaggtggcattaatgctgaaccttgaaggacaggtaagacttggatgggctggggtgaggttcagtgattacattcacattgcccttgagctgggaacacaggtgttcacttcttcagctctgtaggccagtgacatgggactcttacagaagacatcaccattgtcaaaatcctttcacataagccactccacttgaggtttgatacagtcctgtgaggcaggtaggataagccttatctgatgagaagatgaccccggagaggtcaagtgacttgctgaagataaagccaggcagtgcgtgggataaggtagatggacacctgaccttcacttcctcctggttacaggttccaatttctctgcagccagctggcttcaccacagtaagacagtgcgtctagacagttgggaggctgcattcctcattctgaaacatttccccttgatctccctaggggcatctggtctccaataaggctgctatggatgaagaacagagagaaattcttctttgctttgaccctcagtggttcccagaaattgctcaagggatccctcaaggtctgactgtctctgcagatcaccatgaaactttgatctactatattttaaataattaaatatgtaaagttgggctatatcacatgccattttaaaacttgtgtctagcgtagtgaaatgacagcagaggagaaaagaaaatgaatgtgggaaaacttcaaatggaaaaattctatctccaaattcaattttgccctctgccactatgatttgaatttagtagaatcctgggtctttgaggtgtagagatggggtacctcaaagacacagtttgagaactccttccactcttcctgctgttcttggaattgtggctgaacttcatttgagaggtgaactgaataggaaagcatttcttttaggttattatttggtgtctgatctgcaggctgttatccccactgcctgtggctgcagaaaaagggctcaaagtccttagcaggggcttgaaatattcatgtgggtcccgtcttatgtcaacactagagtatttgcccatcaggatcgattggttcccggcttgttggccaactaatgaattctgcagaacagtctttgggtttgttttgtgtggcactcgtgatggccaaagcacttttctctctattgtttcattgtgtcctcaaggattccccatcccccctgccaccaggaaaggaaaaatgtcataaaatagtagggctgaggctcatgagaaattatctgaacaccctcattttataaatcaggaaacaaaaacacatgtgggggaaaggtttttgacttcagcagagttctctcttcattgcaccagcccctcgagataaataggagctgctaaaaaaaaaaaagaattaataatcccccatcccttatctggcacatcctatgtgccaggcacccaagccttctgcataccaagaaattagattctgacagcgtccctgggacacaggtactatcatcatccctgtctctcagagggcctccataacgtgcccaaggtcacatagccagggagaggtagaggtgggatttgaacccagagggtcttgggggcaagggttctcataaatacgctacactgcctctcagaatagcagttattttatttatttatttattttttcgagacagggtctctctctgtcacccaggctggagtgcagtggcgtgatcttggctcactacaacctccacctcccaggttcaggcaattctcatgcctcagcctcccaagtagcagggattacaggcatgcgccaccacgcccggctaatttttgtatttcttagagaagggatttcgccatgttggccaggctggtctctaattcctgacctcaggtaatccacatgcctcggcctcccaaagtgctgggattacaggcttgagcactgcgcccgaccatcattttttgcatgttgttaattcttcatttttgtagcagacatcagtattcttatcctgattatgaaaacacaggaaactcggcaaaggatttatcttcctgaggctcccttgtttcatacccctggcctccaactccaaggtgggcatgtgtctctgcccctcccaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggtgagtcctgtccccatcatgggctcttagcgactgagggtttgcaatgtggtagacccccctttcttaagacttctgaatgggagactcataggtttgggtcctgggcctcaggggtgtgcggaaagccaggagaaacaagaaggggagagtgggctgagacaacaccgtcattggctgcaaaccctggaggtgggcccaaagtggaccaatgacattcactgctgccggatggctgccaagttcatttacatatcagatcccagactttcttttcctgctccattcattccactccaatggcaggaaggcctcatacaaaagaggaaaaaaccggtatttattaacggcctatctttcaccaggtctcaatatccataatattctataatcctcatgtcagccctgtgaagtcagaattattgcccccatttcacagatgaggacaaaccgagccttccagaaggggagatgactagtctaaggccacatctagtaaacatagagctatttctgggctgttaatagcacaacaaaaataaaagatacaaatgatgattcaagccaccatgtgtgaagtatttgctccctaccaggttctgaaggaaacatttctcgtctaaatcctcatttcagaactgtgaggtaggtgctatcttgatgtcccttaaaaaggtggggaaactgacacgtggagatatcaacttgccaaattgaggctccgaatggtccatttgcttgcccagggtcacacaggagtaagaatttgaacccaaggctgcctgacaatgtagtctctgcttttagtcactaactcatattttgtctccaggatggaccgaggaaccttttttttttttttttccctggagacagagtcttgcactgtttgccaggctggggtgcagtggcacgatctcagctcactataatctccatctcccaggttcaagcgattctcgtggctcagcttcctgagtagctgggactacgggcatgagccaccatgtccgtctaattttttgtattttagtagagacagggtttcactttgtggcccaggctggtctcaaactcttgagctcaggcaatctgcccacttcggccacccaaagtgctaggattacaagtgtgagccactgcgcccggccccaaggaacattttaaaatttgtttcttgcctaatgggaaggtttctccatcattcagtgtgttgttctaagaagttttctgcacaggtcacagagcatctaagagtgactgttccactttttctccacggggccagatatcactaaggttccagatttctgattctgtgacctggggtgtatctggcacccctatcgcctaccatcactcagccttctagagacagcccacaatatgccaagccttggcccagaggtctctaaattacatttgttttctccttcctgcattatccgctctggtgctgtgagaggtcttaccaacttgttcttcctgcagcaaatatattaatatgtctcgggctactgtctttcacagccggtgtcatccccatcagctttgcccttgacaagctggctgtctggttcttctgtgagggggcagtaaggcaccgcacagagacagaggttcccagacaaagtccaggcctcctgactggcggttcctccacacccatggccctgggagagagaaaagctctttcctccagttgacaggataacttcctcattaaccagccccatttctcatgcagctgagcacccctcctgcaagctctggctgggaggagagaacatccccagcctttctcctctgatgtcttctttaactagccaggcactcaggcattctgtccagatcaaatagtgattttcttcctctctgtcccttgacctctttttctctgtctcttctctccttccctcttttctctctttcctctccctgtccccattcctggggccatattctgatcttgaaaggccctgaaatactgaaaagattatagcatagttcccacatatgaatcaaaatggacacaacacaaaaccttaaagagcttgcatgcatgctgaaattagacctgcatctgtctccaatttctgatggcaagattctggataagtttatcaaagctgaacttttctctttagtttggtgagtgtggttgaaaggagtgttcgtttcctaggattgccatagcaaattatcacaagctgcatagcttaaaacaacagaaattcattctctcatagttctggaggcctgaagtctgaaatcaaggtgtgaacagggctacactccctctgaaggctctggaagagcatccttccttgcctcttccagcttctgatggctccaggtgctccttggtttgcggctgcctcagtgatggctttcttcacatggctttcttttctgtgtatgtgtgtcccaaatatccctctgcctttttcttataaggacaactgtaattggattcagggctcactctaaatccacgttgatctcaccttaagatcctcaccttaatcatatctacaaacgcttttgctttttttttttttttttttggaaacagagtcttgctctgtctcccaggctggagtgcagtggcacaatctcagctcactgcaacctctgcctcctgggttcaatcacttctcctgcctcagcatcccaagtagctgagactacagatgcgcgccaccatgcccagctaatttttgtatttttagtagaggcggggtttcaccatgttggccaagctagtctcgaacccctgacctcaggtgatccacccaccttggcctcccgaagtgttggaattaacaggcatgagccaccgcgcctggcctacaaaccctttttctaaatgagatcacattcacaagtcccaggtggacttgtcttttgggaggcaaccctccaacccactacagaagaggaaggcacatttctgcttggttggcattctgaagttatccagtacatcctgtcgtttccttaatgcttctgtggaagaacaaagctccacgaataaggtcgggccagcagcctcttccaaatactggatgtcctaaaactcaccaacctatttgctctcaaatatttcctttgcctttgagctctgggaagtttccactgggagaagggaggaagtcatactttcttgtatcactcatttattcattcaacaaatacctattcaacaccagctatgagcatggcacagggataggcactggtgaggaagggcaaggaatcataaggtccttgctgtgtagaagttacacagtgtgcccaaaacagggctcagtgggagagttaagtcctcactgtcattgaaagtctagtcttgctgctgaggcccctcctataggtgtggcatcctggtactctccctggcttctgaagacagatcatcccatctgttcatgtctatgccaccaacttgccttccctcatcccatttctataagataaggggcagcttctttgtgccatatgttctctctaaactacactaaaatcctgcaaggcagccagagctttgcttctttccttcatgcaatatatatccatagttttcactgtgggtcaagccctgtgctttatgctggatacccagtgaggaacagcacacacctttgccccccaggagctcatagatggaaatatataactgcatgagaaaatacaactaaggccattcttagtgtacttcgtacaagtatggagtttcctccgtaatgagagctcagagccttcacaggcaaaacaagggggcatgcactgtgatttgagggattttagaaggccagttggcaccaaatctctctcccatgcccactgtcaccaccacaagtccatttctttgggcaaagtattgccttctccatcttccttttttttttttttttttttttttaaattgagacagggtcttagtcacccaggctggagtgcagtggcacagtcatagctcattgcagcctccaactcctgggcataagcgatcctcctgcctcagcctccagagtagctgagactacaagtgcataccattgtgcctggctaatttttcaattttttaaaatagaagtggggtctcactactttgaccaggctggtcttggactgctggcctcaagccatcctccagccccagcctcccaaagtgctaggattataagcatgtcaccgctcctggcctgtcttcatttttagaattcacatcctccctgggagggatagaatacatttcctaactccacagtccaagcattcatttattcattccatcaacaaacgtttattgagttgttctatgttcaagccgtttgcagaagttgtcttctttagcacttaatgtcaacctcagcaagtggagaacatggaggggcccgggtgtgaggttgtccagggctgcagggtcagaaagggcagagctgggattggtgtcccacgtgtccaatgctaaagctctcaccaggtcaccctgctgccctttcaacccaaccttgctgaaaaatggctctgctctggagaccaaaaaaaggatccggtgctctgggccctggagagcagtgggaaggatgttgatggatctcctgtccacaatcctttccgcccgtccccaacctgtactatttgtcactgttggtgttggtttaaagaactgtgagttgttgcatgtgaatgatttatacccccagctgactctctggcacatccagatcaggatcaattacccctccggtggaactttgcttcccagaaaaaagaaaaatgaggttttcccattaattttagtaaatgtactattcctggagactccaggagccattatggagaaaataatattctggctctaaatcattccagtccctttgtcattagagcgatgaagcaactcatctgtggatgtatatatcctgttgtttttcagtagttacagggcccgggggaaccaccctggtcccaagactgggtaatcaaggggtgcctgaggaagctggaagtcctgatgctgacgggaaggcctgacttcggcctaccaggtgcacctatttcagaggctgcacctgttgggttttatccctcatcaccttggcctgattctccggttttgactttcccctgatccaggtgtccttttcacaagttccccaggtcttgaaaaacttgcatggtgcttctgctcactcttcctgcatccacctggtgacctgagttagaaattgcagcaacctgtctccctctcgctcacatagcttaatggtcagacccgctgattttaccctattatttttcaaattcacccctcctgacccatttttgctcactctatctttatttaagcatcatcccctccagtctgggcttctatagtgactcctcacttgtctccccactttcccttcagtcttggtccgccctgcaggagatccttcaagaaggagcatagcttactgtgttatttctctgctaagaaatcttttatggggccggatatgttggctcatgctttataatcctagcactttgggaggacgagtgggaggatcacttcaggcctggagttcaagaccagcctcggcaacatagcaagaccccatctctatgaaagagaaagagagagagaaagaaagaaagaggaaagaagggaaaggaaggaattaaggaaggaaggaaggaagcaacaaagaagaatttgctacgtctgctggcatgtacctgtagacccagctactcaggaggctgaggtggaagattgcttgagcccaggagttcaagattacggtgaactatggttgcacccctgcactccagcctgggtgacagagctagcctccatctaaaaaaaaaaaaaaaagaaagaaagaaaacaacaaaaagatcttccatgggtcatgggtctccattgccttcagaacaaagttcaaactgcttcctatggcctacaagaaatctaacctctctagatttttccacctctggttgtctgcctctcatcctcttacctgttctacttaagcataaagacagatgttgaggactgctgtagtttgaatgtttgtccctcaagcatcatgttgaaatttgatcctcagttttgccattaattttagtaaatgtgctattcctggagactccaggagccattatggagaaaataatattctggctgtagattattcctgtccctttgtcattacagcgatgaagcaactcctctgtggatgtatatcctgttgtttttcagtagttacagggcccggggaaccaccctggccccagaactgggtaatcaaggggtacctgaggaagctagaagtccagatgctgacgggaaggtctgacttcggcctgccagatgcacctgtttcagaggctgcacctgttgggttttacctgttgggacctcataggaggtgtttgggcagatccctcatgaatggcttggtgcctcctcatggtaacgagtgagttctcactgtgttagttctcactggagttcccctgagaaatggctgttgaaaacagccttccacttcctcctctctgtcttgcttctgctcttgccgtatgatctctgcacatatcagctccccttccctttgtgtcatgagtggaagcagctaaggccctcactagaagcaggtgctggtgtcacacttcttgtgcagcctgcagaaccgtgagccaagtaaacctcttttctttataaattactcagcctcaggtattcctttatagcaacacaattgaaataagacaagaccccagtgccatgttactccttgattcaccgcctttatcctcatgcatcctgctgcctgcctatgcaaatttcaaaactcaaatatcaggttaagcacctcctttgtgttcccgtaccccctgtgcccaccccatcaatgcatgtgtcacccagttattgtaaatgccgatgttcttgtcttcctagagagagaaaccctgagagaagactttacttgactcgggctgcaacctccatatcagagtcaggtatagggtagatgctcagtaattgcttgctgaataattttctcagcattttgaagttttacctcttaacagaatggctcaaaaaagtacatcttagaaatggaaaattttaaatcaaccaactgttgtttgtatcttactatgtacctagccctgtgcctgatgttgtgggagatgcagacatggatggactagggactgtgcccttgcatttctcaagatctagaggaggagatgcacatgtccctcaataactctgacacaagatgggatgtgtggacaaaggaagaaatggtttcacacaaacaggagccctaggggagattgtatggaagatgcatcattcatctgaaacttgtatggagtttcttgaatgataaagcaaatactggctggcagctttgggggagcagtgatccagtcatgtttatcacgacatctctcacttgcattcagcaagtgtctagtgaatgcctgctgtgtgtcaggcaatgtccaggttgccggagagtcagagagaaaccagttacagggatataaacacagactcttcacccctttcctttcttctcttccttctttctcattgcagctcccctactgcatgccaattgcaaaatctcttcctcctccctcttcaacctgttttcttttgctttccttgttcttccttattcttccttagttctcacttgtctagacttaggcatgctgtttctctctctctctcctctttctctttctcctctctctctctcctctttctcctctctctctctctctctcacacacacacacacacacacacacacacacaattgttttgactcaggttgggaggagggtctgtgttaaatttctaggctaccataacaaataatcaaaacctggatatcttaaaacaacaggaacttattgtctcacagttctggaggctagatgtctgaaatgaagatgttgggagagacatgctcctctgaaggctctaggggagaatccttccttcccctggtggctccaggcattccttggcctgtgggctgcatcatgcttatctctgcctctgtctttatgtggccttcccctcttctctttctgtctccatgtgtcctcaaggacaccagtcattgaattcagggcccaccttaatctagtatgacctcagcttaactcattacttctgcaaagaccctatttcccaataaggtcccattctgagtttttaggtggatatggatttttgggggacgctatttaacccactatacggtggttgaaaagagcattgcgcttggagtctgatacctcagacagctaagttaacattgaagcaactcaatttcctcatctgtaaaataggcataatatggcctgttttattgggtagctatggggattaaatgagatcatgtatacaaaagtgtcaaatgacagcccataataagcacctaatagatggtactttattttctttcttccttttcttactcttcctttgagtttctgattttctccttccactcaagctttatcatattctaccagctccacatccatgcagtgcccgtgagtggatggcagtgatgttaataggatttaatatttgtttatcatatactgtatggtgggtactgggttaagtactttacatgaatcctctgttttgagaacttgtttggaggtttggagatatacccttgaccgaagactggtcctcctctatcagagacagtcatcctcttgaagcatgcagctttgggagggatgaacatggagtggtgaggggggaaggggacacccgcctagccagctagatcagccagatcaaccctggcgatcaacagggtgacagatgttacagctagatcgccctcacatccgaatcccctattttgagcctcaccgttggaggtaattgtccttattttatcattaaagaaactaaaatccagacaggtgaagcaatttctccaaagtcacattcccagtaaatggcagagtcagaatttgagtgcgggtctgaccgactcaatgaattttagatacgcagtgtttacgtgttcaagtacaattttaaaaaattaataatatatgttaatattgcttctgattctgtaatgtagaggttctcaaccttggcattattgacatctaggatcagatcattctatgttgtgaagactgtcctgtgtatggtaagacatttagtagcatccctgtcctctacctactagaggcaaatagcatttctgccccgtttaccataatcaaaaatgtctccagacattaccaaatgtcccctaaggggcaaaatcaccatctgttaagagcaacctgtctgagataatcctcaccataaccctttagttaacaactatgataactccccattttacaggtggttaaactgaggctcagggaggtgctgtgcccaaggtcgcagggcagctggagaagggggaacgtcaggaaaggagaaagtcaagaatggaaagaggcggaaattagactccctacccttgtaggaaaaaaaccggtagcggttccagcaaaatccaatcccaaccttcctgagacccagaggcgacttcacagcagaatctaattctgagtggaattgaaggccttgctgcagactgtgtacttttaatcatgtttaaataaaacatgggaccatgggtgtgatctcctcactgagcctggcttgtcagccgcttgggcaaagtcataaatagttaataggcaaccacttatggctctacttctgttaaatctagcatcaattatatatggttcatgcattatttatttggtgttactttggggtatatcttccaccttcgggggaaaagtgtaaagaatgggaggcgtagagcagatttgaggatagcttgtttccctctgtactggtcaatttgtgaaggccttgttcccctccatattggtcagtttccctcgaaggaaaaagcccattgatgattaggagatgattaggagatgaatttggatctgagaggactttaccagaccaccaggaaaaaagatcggggcggtgatgtgctggtaaatgtttaacaactgcctttccagggcaggtggattcctggcttgtagtgtttgccaatttctgtggtgtaaattctccctccagggctgatttcaacctaactacatgatgtcaccaaggcagagttgggaagcaatgcacagtagcgcatcattatatatcatttgcaccatacaggtacaaaaagcacaaataccttcaaaagcatagttagagcaaaacgttagcaaaataattagaaagcaatgtgttttgagtacgtattacctttgtttttcatatatttagttgtaagcttgtatcatttaatctttaataatagctgtgtttgacaactggcttgcaaaattccctaaaatttagctatcagctcttgccagccaatatgagccacttcctgcactcctgtgacctggcgtctccttggggtggtgtccccataccctgttagaaggcggttggcagagtagaaggagtgaaaggctcttaatcaagtctcatcgctcactgactgtctttttaagcaagattacttcaccattagaaatctgtccttctgagcatgctcttttaactcatgtataaaatagatgcaatcacatctcctggaaaagactaaaacaagtaattcatgccatgcttctagatctgcctgtcacataactgtccccaaaagcacacctgctcctctctccctgttcattttctcctgccttctgagaatctgaacatagtaggtaggggccttaggaagcccaaagtcaggttctgttttttgtttgtttgtttttgtttttgtttttgttttttcatttgctttaatttttttccactcccaaaccccatgttttcaaaagtccccttccatctacttactccatggcattcaccaaacccacagtgaaggggttcatttcaaaaagcccttggtgttttccccctgcaaatggctatgaacttgaaagcgtaaagatgaattattctggctgggaactgaagtatttaaaaaggcattccacatggagggcatttggggccatgagccgggtgtaaataacacattttatggctctcctgacagggagatagccctcctaattactgccccgttatctcagtgggatccaaaatgacccaacacgcttataaactctgtgttcacagatttccttttaatccctactcctaatggcctcccgcatgctcagagagctgacaggggaacccgcgggtatttctgtcactcccctccttctaggcactgtggtttcctgtttgtctccctacaaaggtttctgtacaaaagaaacttagtcctaataggcatttaggtgctgctagcctcagacatgtttctgaaagtgaattctcccaagctgtctttatctcacatggtgaatgtgcttgtctcaattcaagaggtgttaccatctaacgaaagagtttctttgcgtctggctctgagatgagttatcctgataataaaatctattaccaaaagcctacctaggaataattgggtctattactccccgacttgtggctttgtttctgcattgaaaacagactctccagcaattaatcagaatttaaagttgctaataccaattacaaataatgcgctgaggctcaagatggcaaacagaggagcagatactaatcttgtcccttgagatttcatcaattgaactttcgtcacttcagacttgctggaaattagagtaacttaactctgcaaagttaattacttaaaaaagaaaggggagagatattgattgaatatggcaggagtatattaaattattcaaataaatccaatttatattgtttagatgagattatgcttcacttaattgtatgccagggaggcttaggaaggttagtcttcatggtagaaagcttgatcattgttacgatttgacatctttaaaagatagtggtcccaaggaaatccagggggccccaaatcagacacttcatgtttttgattcatttccaaagtataattcggtttgaagggtaattctctttttactgttcttttttgacagagcttaaacaataagaaagggagaggggatctcagaatatgaggatcgaccaagcagttgggaagcgaaatggtttttttgggagaattggctggtttggaattcaaagtgtatttagtggggaaagatgaatataacttgtctaggttatggctcttttagttgcaagtgacggaaacaaaattaaattggcttaagcaaaaggaaatttattggctcatgtaatgaaaaagtttcatgacctctggcttcagactcagtgaaattcagggactcaaatgatgccaacaggctgaattcggtgtgctggggtcaacccgtatctgtttgccagagctgactgtgtccatctcttcccaattccatgctccatgacatcacattggtagcttgacattggccattgtgggattatttacactatggaaactggcaaatgttaaaggatttccactcatccccacagtcagttttgaacatttaccagcacaccaccgactgaatccctcccttcccattgccttggagttgattgccattctcagacaggctttcccttcctagtggcaacagagttaggctgacaaacagcaaggctatcaacctcaacagaaagagggccccttccacccagcggctcaaacaaaggccaagaagtagaatctcattgaccctgattggcctggtttgggttatatgcccacacctaaaccaagcactggtatttgaagggtagaggctggattgaacagttctggggtacatgcccagccctgaatccaggagtagagtcagctccaccctagccatatggatggagagtagaagaatagattcccccaaggaaaattgaaatgttagtgccagaaggaggagaaatggtttccaaaaaggcaaagcctttggatgcccactgtggaagccacatctgtgggccttgactcttgcagagatctctctgccttgccacaggccccttctaggttttatcttctctgcttgtgttcctgcctcctgcttgactttttcctcctcctttttgtatattttctgttactcctggggctgggacatcccataagtagggtggatcaaagaaaggaaatggaggccggaagtggacagcctaaattccctttctatcttctcaaagggagtggctcacacagtaggaggagcttgccttgaagccaggaagtctgggtccaagccacacttctgcctctgactgactctgtggacttgggcacatcttttcccttgctggactcactttctctctctgtaaaacggaccagacgacttttaaagctctttctgctgagacccctgggcaagcccagagctggttggtcatagagctgcaagctttgagtgtgtctcaaatggctgatagtcatggtggcagcttcctctgaaacaagcacattcctacaccccaagagcaatgcacagagtcacacaatctcaaacctgaaggtgcccaggcctcttcattccaactggtatcttctccaacctcagactggtaaaaattccatctctgttatgcaactgtggggttggggaaattactacctctgtgggcaacaacattcccatagacctccccttctccatcccattctagattgattctatagctaccccacaactggattccagatgtgtcaccttatctgttggagagagggtttcaaaggacagagagatatcccttgcttatctcacctgggagttagcaaggaggtatccagagattaccacgtttttttcttcttttaagtagccaaatcttattttaaatccatagctgatacagatttgtggtaagtaaaagcagagctccccattagggctcatctacttttccaccctggcccctgaggcagcaccataaaatacagcttgataacctatggtcagatctggctgctgtcctgatttttataaataaagttttattaagacatagtcacaaacatttacctattttctatggctgctttggggctacaacagcagagaggagtatttgtgataagaccatttggcctacaaagtccaagatatatactacctggtcctttacagaaaaaaaaatcacttacctttgccctagaacattgcttagcacagagtaggcataaaaaaatacatgctgagagaagaaagagcttgacaggacaaagaactgggaataaggagacttagatgcaaatctcagttccatcatgtccttactgtgtgactttagtcaaggcactcactttctctgtttccctgttaactcataaaatggagacaattattgcaactgcttcacagcattgtggggattacttaataaaataatgtgtttaaatacttattacagtgcctggcacaaagtaagcccgcctatcatcatcatcataataaccatcatcatcatcattatcatcatcattgccatatcatcttcttcatcaccaccaccatcaccaccaacacatcatcttttccaccattcccaccatcagcatcacctccattgttaccacaaccattaccatcattatcttcatcactgtcatcatcaccaccatttgcatcatcatcaccatcaccatcaatcatcatcttgatcaccaccatcattatcatcaccatcattaccaccaccaccatcatgaaaattattattatcactctcatcactgtgaccaccgccatcatcatcacatcattatcagagtgagactagaatcaaagagcactgcagagccccttcaagagtaggcaagccctgtgattcagagcaggcatataagtctaggccagtggttgaattatttcctatttgaaaattctgtgaatgacgtccccaaatgcagtataccccaccttgtgacctgtgagttcatagatgcctccttctttgtgctcagtgtcctgagtgtcagcttcattggaattctgccttctccagccttgtcttggctgcattccaggtaaatgactcggagcccatcttgctgcatgtcacctctgccgcccgcccgcttggataattagaatcaacacattcatttccctaacagcattctcatctccccctctcaaagttttcaaatggaaaaagaaaggcaaaaacaagctacatctgtccttgttcaggcaatttgcagctgtctgcagctgacatccacccagctgggcggcagaactagctttcctgtttgcttttggtggaagatgatgtggttgatgctgttattaaagtttggcagtggtttggagacaaagcgtcctgctggagagagacttaaacactcagggggaatccttcaggctcctgcctttgtgagctaattgcttggtgggtggggagaagaaaaaagactgatgtcacttttcagcaaacaaaaggaaaggaactcaagaaataagatgattttcggtttttgcttctttctgagagcctgctgagtttgcacacaggtagcaactggatgctctgatccagggactggcaagtattttctgtagagggacaggtagtaaatattttagactttgtagtccatactgtctctgtcacaactactcaactctgctgtcgcagcacaaaagcagccctagacattatgcaaatgaatgaatagatgagcgtggttatgttccaataaaactttatttagaaaaacagatggtggactggatttggcccacgggctgtagttggccaactcttgctctatgctctgttggaagaagaagtggagttggaggcagacagcagagctgggtttaaatcttgtctcgatctctttcaggcacctgtcctctttgagtctttgtttcttcatctgtagaatgggttatcaggtagttgggagattagaatgttttgcacatgttaagtggtcaataaattgtaattctttgtagtactcacccgctgaccccagccaaaaaacatgagagagtgaaaccaaataaagaaggctgtctgctttcctgttggccctagctatggttacagttcagtgatgcagatctttttgtagctcatttgagagtctggcagctctgagtttcccaggatgatccttctgttgtctgttcctaccagtgccttcccacaccaagatgccttcctgtgttcagactatttcgtttccatcacaaaggcgcggcctcagttaggaaatcccaagtatgcaaattaagattctgtttatgcacttttgttgtttagagagagtagtttttgttgtagttgggtcgacattaaagacttgttgtctgtaagccaaagacatggctgcatgtcaaatctaacaatcatgtttgcattttaactggtatgattttcaaacagggtcctagggacaattcagacttatgtgtgctgatactcatagttaagattcacttaacctgaaagggcaaaaaaaaaaaatttttttagtagagacggggttttgccatgttggccaggctggtctcgaactcatgacctcaggtgatccacctgcctctatctcccaaagtgctgggatcactgggattcatgccactgcattccagcctgggtgacagagtgagactgtctcaaaaaaaaaaatacatacatatatatataaataaaatatatgtattttatatttatatatgactcacaggtcattacatatatatttttccatgaatatatgcatatatatatacataggaaaagtgtgaccagaaccccgatttgtgattctgtggttagttgcttgcttggtttgcatctgttaaggatgtcagctggaggtatattttaagttgcattatgtatagcttgtatttacttgttattattacttatataacagcctatcatttgtgccaggcctgagcatgttttatacctcatgtcatttaattctcttcaatttcgtgtgacttatggctttacttttcaaaatatattcgcagatcagcagccttggctatagaaatgtagagtctcaggctcagccccacacctttgagtcagaattggctttttaacaaggtcccaggtgactcctaggcacagcagcatggcaggagccctgatgtcggtatttcatcagcactgaattgcaggtgaggagactaaggctgagagaggttagagacgagatctcggctgggcacggtggctcacgcctgtaatcccagcactctgggaagccgaggcaggtggatcacctgagggcaggagttggagaccagcctggccaacatggcgaaaccccttctctactaaaaatacaaaaattacctgggtgtggtggtgcatgcctgtaatccctgctactccggtggctgaggcatgagaattggttgaacctaggaggtggaggttgcagtgagccaagatcgtgccactgcactccagcctgggtgacaaagtgactctgtctcaaaggaaaaaaaaaaaaaaaaaaagagataggatctcctcccatgcagatctcacccacacaatccactacacaatttagctatggttcctgcctctgtattactgatttgtttttttgcttctagatcttgtttctgaaggacactatctacttcctattgttaagcatcactttcttcttggtgcttccagtgtggggtccagaagctaaccacacacttagtaggtgttccaatatttactaattgccgagtgaacccatgaaacattcacacatgcaaaagtgagagcttactcttaaaaatggggtggtggtggtggctgtgaatatcaatcaaaagggtttcctgagcacatctgcccttcagggctttgcatttttagaacatagaacaatagcacctcttagaaccttcagaccatagaaatatagaacacagaacgtaggacagaacccagtggctcttggcctggagttcctccagttttctcccatggggtgatttcagcagacagaacaagtgaagtgccataatttctctgatatttagattattttctatctctctataacatatatgaataccctaggatggtgttgtcaaacatggtagccaccagcctcacagggatatttacatttaattgaagtggaataaaatttaaaattcagatcctcggtcacaccagccacacatcaggtgatcaatagctatgtgtggctagtggctaccatattggacagcaggcatgatctcaaacaagcataatccttttgtgcataatccaaatgctttgtgttcccatcttatttgtaattgcctcccagacttctccctagggtggagggggctggaccacatgccacttcctttccaatcccttttgaactcacacatgacttttctcatcatcacatcattgtcacaaggagggggacctgtttctggggcaacaaatagtaatacatactcatctgagcctcatttggtcccacagctgttttgggtcaaatctcaattgtgtcttaggtcatcctagtcttaggacggtgaggaggcaaacgttatcatctcacatctgtatttcatccattttttccacaaggtaccatcaacttgcattttttgaaaaattaatttactcactaaactcttttatgtctgctaattaatgttcataccttttcttcctctaatacaacagcatctcttaattatcaatatggctactcaacaattagacccgccaaatctcagcgtttggaatgatagcatcctagaactttgatatataagaccttagagccttcaagccagaaaatctcaggattaatagaatcttgaatcatttgacacgcataatattaaaatcttattaaattgaaccatatgaatttgccacttgtataggtcaaaattggttcaatatagctgattgtaattggctcaacctaatagaaatatggaatattgaaatctatacattcttagaattgttagctcctaatgctacacaattttagaactttaggattttagaacaggggccagtcaactttttctgcaaaggaccaggtagtaaatattttcagttttgcaaaccatagagtctctgtctcaacctccgaagtctgtcattatagcatgaaagaagccgcagataatgcataaatgcctagttgtgctccaataaaacttgatttacgaaaacaggcaggaggccagatttgacctgagggttgtaaattgccacccctgttttggaacataaaactgaaagggtcccaccaagcacttggatttgcacaggaaactcatagacctctcctatggttccaaagggtcccattcaaatatggagccattttaagcacagttttgattggttcagtccactgtctgtcccagggcagtgtctggcctccagagagggaatgcgggggaagaaggagactttggaggctgtgaccaaagcgatccctgacactgggagagtgtcaaagagccatgtcccagagttggagaaaaatgggggagactgttggaatcaatgcctggcttccaaagttctggaagaccttgtgagtcaagcccctcgatcagaagcaaaagatgatcctgagtgcctgggaaggcagaactgatggacctggcaagagtcaatgggccccagctgcgaagtgaatttgatgaggctgttcatccaagaggcgtgcacaacctggccataaccttgagatgtggaggtaaaagagagcacaccgcttagcagttgtttttctttcctgatgagtcaataaatgaataaatggaccatgagtggccaagtggctgatataatttcagactccgtcaaaaggaagatcgcaaaagtgtacggaggtagcttcaacgtctttatgttccgccgctgtgagccccggcatcctaatatcatatagtctgagaggcatctgaaagcgaggcagagggcagcctggggattaacatttactgtatgtctactatgtgacaggcactgtgcaaagtgctttcgatataccatctaattaaatctgcactttcaaccttatgagcaaggaaatatttttatctctattttacacatttaacaaaagaggcttacaagagttgaagtgatttgcccaaggccagatagctaggaaagattgacaccaacatatgtgatcactccaaaacatatgctcttaaccacaatgtctgcatttctccaatatcacctgtacacagatcacccggggatattgttaaggtgcagattctgactcagcagatcgggggcagggcctgagattctgcatttccaaccagcaaccaggtgatactgatgcttctggcccagagaccccacttggagcagctggtactatatcatagtttctctttatgccagggcccccaaagttatgaaagggtgaggtttacacttttaagatgaggtcacacagcaaacagtggtttgtcctagattcaaattcacatctgtctgactccagagtccatttctttcaaaaataaagtctactgcttacccttatgcctgtagcttgaccctcagctgggggtgattttgtccccccagggaacattaggaaatatctggagacatttttggctggcacaacttgggtgggaggtgctgctgatatctggtgggtagaggccagagatgatgctaagcattctgaaatgtacagcatagccctgtgtaagcactcacaaagaattatctgctcccagatatccctaatgctgaggtcaagaaaccctgctttctcaagacactgctcagtgtcttttggtcagaaataaaaatccacccagaacctctctcttgaggccacttagtgcacttaatttagagttagtggacatttcaaccaattccactaaaaaatggccatgaataaataagagctgtagctaccaaaaaagtccattatgcaatcaataggtggaactttccactactttgagatgagggcttgctgtttacaactctgttaatatccttgtgccacagcagatggaaaccaatcaggtccagaaatcattgtcttaattttagtcattaacatgcctggccacatgctgtttattggcatcttttgctgtttatgttgcatgctccgttttctctgatggtagcttttgccttcaccctatttctgagggagatagcattgactctgatccaagcctggggaaggctaggatctggcattgatcaccagcaccaatatctccattccatatcctccttgatcaattcttggaagaacatatctaataatacaagactattgatgaggcttgatttgcccgagagggattgtttcccccttcttactcaagctcatttaagatgtttctttggcttgtggaaaatgctgattgaggtttcatttgttacgaggtgacgggatatgcctgaaaagagaagtgtgtctctgaagaatgaagaaacagtatgatagataattatctcctatgcattcagctctttacagtttacaaagcacctgaatgtaacttgggctgcacgatgctctgtattgaacatagggaaggaattgacatctattgtagagttgaggggccgactgtaggatgtactcattggtgcctggggaatccaaacagatgtgggatccatttctatgtcttgcaatggatgtggttctccttctcatatccgtgctgtttctccccggctatgcttatctgcatagctgttgggttacagtcattttaatcatcagtggcctggatggctttattcaaggggtgatccgattttccaactcctgtatttgtatttgtatttgtatttgtatttgtatttgtatttgtatttgtatttgtatctgggttgctgtgtctgtaacccaagtagagtctctcctgggactgctgtgaacatacatggatgctacaccaggttaagacctaatgtgccccagggggttgtcacattgggagtagtggttgtatctcattcttgggcatggtgaattgtgacctgacagtgaggaagtgggacataggacgagcatgtttttgtggagaggagaaaggaaggactttgaggcccatgctggggcattacaatagtttggctagtagagtacagagcacatgcctgagtggagagaatgaggggcacagggaagatggggtgagggtgagaaagcatcaaaacagaggagaccccccaggttggcatattgcacaagctgtcactcaatagttctaagaataggaaagggagctgatgtttattaagcacttgttatagtctatgcaatgtgtcaaacacttcctctcatcagtgactcttcagctagtcctatagcacaacaatgctgttattatttccactttgcagatgagaaaactgagggtcaagtgggtgacaagacttgcttggggtcacgttgcaaatggtggagctgggttgcaagctcctgtctgtgtgaatcgatggcccatgttggtaagacctgctgcatgctacccaagttatgaatttagggcaggaagagtttaaagttgaagtatttatgtggtgacttctaagttctgagtactacacgaggtatttgggatataaggccgagtacaaccttattcataaggagatcaatatagtagggaattagacattggcaaataattcctatctgatgggatatctgtctttcctagtggcttgtacaaatgctgggagcatagaagggaaagaaactaattctatgagagggagccagagagcacatcatacaggaggtgattatggaatggggtcttgatggatgagtagaagttcacttgtcagagaagggataaggcagagtagagcattccagatggagcaatggtaggttcaaaggcacagaggcatcaaagaacatggcatgtttgggagcttgggaatactctgggaattactgatgtggggtgcaaggtgtgggcagcaaaaagaaagggcgagttgggacagagactttaaaggacttgatatgcgaaacaacaaagttgggactgtgggaactgagaagacactgaagacttttcagcagaggaatgacatgatcaggttaaagagattcctccttggaggctttgtggaatacagttggagagtggtgtagattgatgagaggaacaccagtttaaaactatgtgaatcctggccaggcatggtcgctcatgcctgtaatcccagcactttgggaggctgaggcaggtggattacctgaggtcaggagttcgagaccagccctgccaacatggcaaaaccttgtctctactgaaaatacaaaaattagtaggttgtggtggtgggcgcctattgtcccatctactcgggtggctgaggattgcttgaatctgggaggcagaggttgcagtgagccgagattgcttcactgcactccagcctgggcaacagagcaagactctgtctccataaaaaaagaactatctgaatctttaggagatgatgatgaagactaaatttataaaaagataacagagagcagaggaaagatgcaagagattgtattgatgaggtacttgaggcctagagaagggatccagggtaagctataaattgttcccacgctacacttctttggagacaaaatccagtggccacttgagaagtttcaaagtccattttccctatttctgcaatcacgtgggctagtgggctgagaagaaatatgagctgcatttccatttaaattgaaataagacatgtcaaaggtggcttagtaattaccagctggaacaatggcagtatgatgtgggaagtgtagtgtcagtatatgcggtgcagataatttttgcagttgagacttaattatgttgatataattattcccctgtcaggaaaattgggtggcacagatatgtcatatttgtgtttgagcagaaaaatgaaatgccttttttattcagagagcaactgggtggttgactctgggaagttgggattggggcgtttggagtttaccccaggtcaggatgtctgtttgcatctgggggttttgtgaatcccctgctcagttggtatcaactttgagaaggttgttggggtcccatgatggctattctttgcccctttctgaggatgctgcatcggaagtcataggctggagaggatttttagggatgggaaagctaggagctctgaatagcaagagctttaaggaactttagagagatttctttttaaaatttttatttgcaaaccttgcgactgaaaaacccaaggtagagttgcgtgccttgaagcctgatccctcctccctttcccttccccttctccatcccaatgccccaagagagccttagccaccttctccatccctgtgtgataaggtcttgaggagtctgtgccatccactcctccccatccatcagggactccaagaaccaagtacaaagccccttcctcaccattgaagctccagtccctggcgctatgattactgaagtagctggaatgatgtccaggcagaaatgatccatctaaagtggatgaaatggagagaggggtgcacttgataagagagagaggacaggggtaggaaactcccaggttgtagttttttctctgccaccccgtgactgagcaatctttaccaggtgacttcatgctccaagactccgttttggcccctggtatctggcatgtgtgtccagagatgctcatgggatgtgtgaatgcacacagtagtgcagccgacttaggcattctgcaggcaaactctttatcatctacattttaaacaactcaagttgcctaaatgttaactttccagaaagctataaagaccctcaggcaacagctgagggcattttaaaaccatcaggttgaaaaataagaagagaaaggaaagaccagaagcaggtgcctggagcagcaagcccttctgcctgaagataagggagaatcctggcagggaaagctgggtggtgtacagttccatagagtcccctgcttggctgcagagccaactccattctgcctttaatatacaagtgttttacctgagcgtgagtcaaatagatgttatctatactcatacgcagaaatcaacacaggatggaaatacaccaacatattcatgaaaagcagttgtccccaagtaatagatttaaggatgattttcaaagttttcttttgtcactttttaaatgttctacattctctatagtgaatgctattagaaacagaaaagcaaagcaacggtgtttaaaagagaaagaaaagagcacgtggtgttgtattagttttttaggggaggtataacaaagtgccaccaactgcatggcttaagacaacagaaaggtattgtcctacagttctggaggctggaagtccaaaaaaccaaggtgtcagcaggaccatgctctcttcaaaggccctcggaaagaaactattccatgcctgtctcctagcttctggtggttcactggaaagttttgatgttcttggcttctagatacatcactctaatcctcaatctttatgtgacattctccctgtgtcctcacattctcttccctctgagtgtatctctgtgtccaagtttcccctccttagaaggatactggtcatattggattaggacccatcctgctgacttcattttgacttgattacctctgtagagaccttatctctaaatacagttacattctgaagtcctggggattaagacttcaacctgtcttctctggggatatgattcaactcataaacagatgtgtttctcgagatgagaagttcttcctttgtaggtatgggagtcaattgagatgggacaaatgtgaagatcttttgatgttactgtgacagccagcctcccagatggttctcagtgatctgtgtctctggcattcacaccccagtgttttcacctcccatactgcatcagagttgttctgtgtgacatattgattatgtcattggtaataggttgtcctttctgaggttaggctataaaagacatttggtggcagcaggatcacttgaggccaggaagtcaagaccagcttggacaacacagtaagaccccatctctacaaaaataaaaataaaaaaattagcctggtgtgatggtacatgcctgtagtcccaggtattcaggaggctgaggcaggaggatcacgtgggatcaggagtttgtggctgcagtgagccatcatggtgccacagcactccagcctgggctacaaagtgagaccctgtgtctaaagaatgatcataaagatacataataaaaagacatttggcttctgctgtgttctctcttggatcacttgctatgggaaaaccatccactgtgtcatgaggacactgaagcagctcagcgggtgtattagtccgttcttgcattgctataatgaactacctgagactgggtgatttataaagaaaagaggtgtaattggctcatagttctgaggctgtacaggaagcatggctaaggaggcctcaggaagcacaatcatggcagaagttgaaggggaagcaggcggtccctacatggctggagcaggaggaagagagaaaagggggaggtgctaccagatcttatgagatcttatttgctaacatgagagcagcaaaggggaaatccacccccatgatccaatcacctcccaccaggccggcccctcttccaacactggggattacaatttaccatgagatttgggcagggacacagatccaaaccacatcagtgggagatccacgaggcagagaactgagccttcctgccaacagctagtgaggaagtgaggcctccagccagtagccacatcagtgagcctgcttggaaggggaccctccagctgcagtcaagcctgcagacaaccaaagccctggctggcatttcgatagatcctgtcttcattccctactgctgctgcaacaagcaaccactaacacagtatcttaaaacaacacagatttattcttttagagctctagagatcagatgtccaagatgagtccaaaggcattcaaaattaaggtatcatcaggattggtgccttctggaggccctaggggacaatctgttccagcctcttctagcttctagtgtctgccagcatttcttggctcctggatgcaccactccaatctctgcttccatccacatccacattgctgctttctcccccactgacccccttgcctccatcttcaaagacccttatgattgagtattttagggactacctggagaatccaggacaatctccccctacctcaagatccttaagatactcatatctgcaagatgccttttgccatacaagggaacggatttacatgttgccggattagatcatagacatctttgggaggactttatacacgctgccaaataccttgagccagaaccacccagataagccactcctgaattctcaacccacagaaaccatgagagataataaatgatattagatatttcaaaactctaagtgttcgggtaacctagtatacagcaatacataactagtacagaatagggatctgtaatcctgcacttgattctgcagccttgaaaataataattctggtggccgagcacagtggttcacacctctaatcccaacagtgggaggcagagatgggaggatcacttgagggccagagttcaaggtcagccagggcaacatagtgagaccccatctctaaaaaaatgaaaaaacctaagtggatgtggtgatgtgcacctgtggtcctagctactgagtaggctgaggcaggaggatcatctgaacccaggagttcaaggctgcagtgagctatgatcacactactgcattctagcttgggtgacagggtgaaactctgtctctaaaattaaaaaaaaattcataattctggatgtcttacaactttttcctcaaaatatggacatggaaaagtgtgcaaatcacgtaagtgaacagtttgatgaatttgtacggactgaaaaccctgttgtctgtctgaaataatgaagcctaaaatgatcctggatccttcagagctctgggccagtcattgcctgttcactttcagatccactcctaccccttctctgttctgctgtagaattacagaaaaggacatttcctggtttccttgacttctggtaggttctgccaatgaaaggcagtgatggacacctgaaggtcaaaagaaagggagaagacaggatatctttctttggcactgccttgaggcatccatggaagcagcagtacctccttttaatccagatcttatcagggactctcctcctccatgaagcccatttcctctgggcagcgctattgaggtctcacttcccattggatggcccaactccttggcttttttgtccagccctaggttggcagtgccttcctgctgttgctaatctctcctggctttcccaaagcattctgtaaaatccttccagcttcaacaaaacaagtaatagattcttagacatcattttctgaaaaatgaagttgtcctcactaaacaccagcagccctcgtatttcccgtgtctttacttagaaagaaggaaataggaacctgtggaccaagtacgtgctaccaatttaggtaggtgaggtgtacacaattttacattatttcatttgttccttgtaacaccttttgtcaaggaataatacagtactgtcattttaccagatgaggaactgaaggtaagaaaggattagtaactctttgggatttgcgtagctgcttcagggttcatcttgttccaaagccagttctgttcctgctgtttgtgatgttagcagtttgcatctctccctctccccactcaccagggcctctctggaagtgtgattagcttcagcttcactcggatccacacaatactcaccaatctttaaggagaaataaacctgcgaaccaactaactaatataaatatcttctttgaggatttgaataccatttctaggaggattgggatcatttaaaaatgtggcagaggctgggtacggtggctcatgcctgtaatcccagagctttgagaagccaaggagggaggaccacttgacaccaggagtttgagaccaacctggggaacatagcaggaccctgtttctacaaataataataataataataaatatctgggcatagtggtgcatgcctgtagtcccagctactgaggagactgagatgggaggatcacttgagcccaggagttcaaggttacagtgagctgtgattgtaccactgcactctccagtctgggcaagagagtgagacccccatctctaagaaaaaaaaaaaagtgtagcagagttgagagttctgatcgatgctggcagatgaagcacaggacagcactggaatgaaacacttggcttggtgagttgagataatggattctagcccctgattgcttgggtctctgctatgattgattagacatgcctgccatgtgtgaagaaaaggacaggaggtattgttgggtatttgctgaccctttagaaattgtgaaggccccaacttttaatctgtcactttctagctgtatgaatttgggacctttgatgagtctctctgtgtctgctatcacatcataaaaatagaataatactggggctgggtggatcacttgaggtcaggagttagagacaagcctggccaacatggtgaaatctcatctctactaaaaatacaaaaattagccaggcataatggcaggtgcctgtaatcccagctgtttggggggctgaggcaggagaattgcttgaacctgggaggcagcggttgcagtgagctgagatcgtgccaccgcacttcagcctaggtgacagagcaagattcactctcaaagaacaaaacaaaacaaagaaaaagaaaaaaatagaataatgcaatgaatcttcaggataattatgaggaaaggaccctgtagaatgatgaccaacttcttcccagtcgttattcctgctggagactgggcatacatttgggttttcttagggccactccaactctttcctttcccaaagtggagcttaacaccacctgctgatgctcactccattaccagtgtggcctttgagctcttgctggaacacaattcacagggcgttttttatttttattttttttttgagatggagtctcgctctgtcacctaggctggagtgcagtggcgcaatctcggctcaatgcaccctccgcctcccaggttcaagcaattctcctgcctcagtctcctgagtagctgggactacaggtgcatgccaccacactcggctaaattttttgtatttttaatacagctggggtttcaccatgttggtcaggcttgtctcaaactcctgacctcaaatgatccaccctcctcggcctcctaaagtgctgggattagaggcatgagccgccccgcccagcctacagggcttttattcccccacttcacaccctccagcgtcagcctcatttctcccaggcaagtgaccctcggacaatttgaaggaagcaatggcagttcctcatagcctttctttctgggaaagattccctcacctggcatcattggatgaaacaggaacaattagaagcaaagctggacagagccatggactgccgtcaggagacctgagcttagctctagatcttttcttggttgtgtgtccctaggcaaatgagttaacctctctgagcctcagcctgctcatctgtaaaatggacaggacaaagtgatgaagattacctctcagcatggagcaggtggatgaggagattgttcattatagcatcagagaggaataaagtatatattttttaacttgcctatgataaagataattcttattctttacagaaaatcttgaggagtgctcaaaggaatgtaaaaattgcctgatatcttaccacagagagataatagccattgctaccactttgttgcaataatctcagctcactttttatgtttctatagtacttgactctgagggtttcaataaagattaaatgagataaaatattttgaacatttagcagactgcctgtgtatgcaagaaatgtatctaaatatattcacttatttaacacgtatttattatgttcaaggtttgttaaacatttaaggatatgaaaatacttgattattttcatcaggtttcaggatataccctgatctataggataaagtacgtgttacaggcaaaattcaactccattcgattttcaagttgaagccagaagggattgctgtttgctaattctaatcagcaaccagattctaataaatacgtccttaatatttgttaggtatgctatgtgccagatgctggaaatatttgggtgtgtatctacacatgcatgtattgtacacacacgtttgcatatatacatgtttatatatatttataatagcatatgtgtgtgtaatttttttcagcaccaggctctgtaacattttctgcttgtctttgctaaatcagaagaaagcaacaagatgaattttcgtcaagtttcaaaagtgtttcgagatagtctgatctatagtgtaaattgtgtggcacaggtgaaattaactttggggggccttgggagacacctcagaaggtttgagaggcaacctccagagctgcagaaattaacaaatgagagtcttgtccatttgcagagaggagagggtcctctgaagattgagatgctctgggcagagaaaacaaacaacaaacaacagttttaaatattagcctctaattgaacatcacaagaggagatgattttaattgcagccattaattatcatatgaactgcttctcacatgggcaactctgtgatatgctccagagggagtagcccgggggtttaacaagaaatcatagttctctcaagtgatgctggggaggtcggcaagtatgcatattatctacattctacatattattgtactgatctctgtatacacgatatatatatcctccatatattacatatgtatcatgtatattatgtatgcattagaatgtataatttatcccttatccttccctcattcgccactaatagtcatacaatagcaccattcatttcatccccaaacatgtattgagtacctcctgtgttccagacactggtaatacagatgatttccctgcaagaacataagctctgtggaagtgaggactttatttgtattgccggcacctagatcagtgctgcgcctcataggtgctcaacaaatgtttattaaatgtatgcgtgtatgcatgaatgaataatatatgaatatataatatataccaggatatatggatgttgtttgtctacagtgtgtacaccattatattgtagttttagattatcccgggaatgtggtgtatatcttagtggatttctgctatctatgcatctaactatctaaatcattttgtatcctaattatcccccacctcccaatttctctccatgcttcaaatctctaaagagagctaataacagagaagactaagctcacaatcgacctcagcacacaaccccattttcatggagcagccctgagccaagcccgagcaagcgtgattgtcagatgctgtcgttgcctcccgcccacttcctgtttcatgagaggggcactggctcacttccccttctgcttgtgcatcccttccgtgtctccggaggggtctctggctggggccttgtattatctgccccagggagactgtttggggcactgcgtttgtttagcctaatgaaatggtctctgcaatcagcagactccatttggttttggagttgaagcaggaaagatttgctgattgctgattacaccaacactaaatttctccaagctttctcctcagggtgcgcccactgagtctgatgcttccctagcagatggaggatgggatgcagagggcggcaagggggcaatggtggagggtggaaggtagtggcagatccacgaaccctgtccttggtccacatactctggcctaactaatgatggctttctggttctcacctcttcttgctgtgtctaagccaactcaccttctatgcagcccttgtttttttcatgtcttttctatgtaggatagtgaaaaatcttcagagccagagtcctgcattccaatgtttttatttggtttgtgaccttggcaaatctccacagtgacctggggatgacactgttcttcctgagactccttctcctatgagaattaaaggatagctatgccactgttggtcaagtttccactctgccaagctcatttactcctcgcaaaagccctgtgagggagggtctgctactggccccatttccccagtgagacaactgagggtcagagaggttctgtaacttgctggaggtcacacagccagtgagcagcagagttgggatttgaaccccggcagctcggctccagagcctactttcacttttatgatattgtggatttgactcattttagactcctatttcttctgcccacttgcttagtcccagccgaggcccacccatccctgagacactgtgcctctttctgtctctctcctctaccctccaggaagctccctgaggatgtggactgtacaccttgctgctcctgcatgacactgacatgggcaaggttcacctaagcaaaacgaggaggggatgtctgtacccttttctcatgtctcagcacatgtgacttaaagggttcccacttaagaacccaagacctggatgcacatctcagctttgtggtctcccggcggcgtgacctcagacaggtcatttggttagacattcgttgaaccaatgcttttaggattcactgtacttaacacataacccacaatggcccagatgtgtggacttgggatagaatctaagacagaaatacagatttttctgcctctgtgtcttacaaagatacaggtgccacatctgggagaaagtggctaatgcccagtgacactgttgtcctggtccagtagaacagagtggagctggccgggcgtggtggctcacgcctgtactcccagcactttaggaggccgaggcgggtggatcacgaggtcaggaaatcaagaccatcctggctaacacggtgaaaccctgtctctactaaaaatacaaaaaaaaaaaaaaaaaaaaaaaaaagccagcgtggtggcaggtgcctgtagtgccagttacttgggaggctgaggcaggagaatggcttgaacctgggaggcggagcttgcagtaagccgagatagtgagactccgtctcaaaaaaaaaaaaaaaaaaaaagagtggagcctgggcagatgctcccagaagctgccgggattttgcacctagctgttttctaggtgcatttatgagctgacatgctgatgtcctggggtgagcaccccctccttcacagtccctcagtgtcttttgtttcctctgacagcctgggggccccaacctcgggttgtctctcaccttgtcaaggctgagatggggatttcacagttggtggcttcaatcaactgggatggactggcagctccttctcatgccaccaccacggcgtccttcccgccaccccttctccctctcatcagcttgacctggcccttaggcttactcagtctttgcctgctgcctctctctctctctttaaaatcagaaaacactggaaaggcacagacttacaataatgtgaatgggcaagccaatgtgcagagagctgagtgtgtccctgtaatggtcctcgctgacttccattggggaatgcagtcatagccccagaaagagcactggactgggagccaccaagcccagggttcagatcccagctctgcgcctttcctgagtgacctcgctgactgaccttgctggctttagtttcctcatctgcaaaataaagaaaaatgaggccgggtgcagtggctcacgcctgtaattccagcactttgggaggccaaggtgggtgaatcacttgaggtcaggaattcgagaccagcctggcgaacgtggtgaaatcccatctctgctaaaaaatacataaattagccaagtgtggtcgtgggtgcctgtaatcccatctacttgggaggctgaggcaggagaattgcttggacccgggaggtggaggttgcagtgagctgagatcatgccactgcactccaggctgtgcaacagagcaagactttgtctcaaaaaaaaaaaaaaaaaaaaaaaaaaaaaaaaaagaaaaagaaaaaaaaaaagactccaggctaagagaggggctgtgagccattcattttcacttagctactcagttccatggggagctgggaattgcgctttgaccccacatcctcaaatttctcccctcccactgtcctcaggtggtatgtatgttcctttacacagcagtccaaaaataaactttacataattagagccggttacaagaaaaatcccatctataaccccgctttgccccatccataaatattctcaattctccatgagtgttatttgcatagacttgagcatgatactgctcggatctattccgtttgcttcatgttatttcaaagaagcactccacgctgccacaattcttatttctaatgttgatgtctgcctaagagcatcaaagtgacacactgtgatttccctaaccattcccaattgctgggtgatgaggcagatcccagcctctccttgtcatcagtagcactgctgcaaacatcctcgggcatagagctgtgttctgtgtcttgatttatcccccgtaagatgaattaattaccaggaggttagatgctgggtctcacccagggtttcagactcagcaccgtggacattcaggccggataattctttgtgggattgtcctgtgccttgtaggatgttgaacagcatctctggcctctacccaccagatgccagcagcatttccccaagttgcgactgccaaaaatgtctccagacatgaccaaatgtcccctggggggcaaaatcactcttaggtaacaatcattatgtgttaaagggtagcaatgtgtaggttgcaaattaaagtcagagattttcccaagagtccagataaaatccaattagaaaagtaccagaaagtattgatcacgaagatgagcactgagaggggcgtcagaggcaccgagcttgagttccagctccgccatgaagtctttgcttcttaaggcctcagttcctcatctgtgaaatgggagaagagtaaagactcacctgctgggcctgtgaggcatgagtgagatcctggctgcaaaatactcaacacagctctggccacagaaagagctccgtaaatgcccatcgcgcttgcctgttctggagggagcccagctgggtttttcatctttgcttttgctgctgtgaggacagcaaggtgggggtgtttaggggacagacttgaaactatctttgttatgttctccccatgacctcctgcaccagatttatccttgaggctcagcttcctaaaccagactccatgacccttcttggtttttacgtttactcctccatccaagatgggctgagtatccactgtgcgtggtggtgcagattcagagcatggccctggggtcagatgcattgggagcagcaccccctgcacaggtgagcaagctctgtgtgccatgccctggagtatctattccctcctctatgaaacttggaacacctggttgaggatcccataaatctgtccgcagagagagcctctcacggagaacttaccacttcataggtgctcagtgaacactaggctcagcctggggcgtgtctcttccccagtgcatgcatgggtggtgcatttcttgcccaaggccaacgtgtgtttgcatcttctgtccccaggagaagtacgtggaggaacttgcagcagtgaggcaaaccctccagacagacctggagacatccattcggcggattgccgacctgcaggctgccttggaagaagtggcatccagtgacagtgatactgagaggtaacttgctaggggctcggcggggctgggcgcagcaggtgggcggcatcctggggagctctatgccctttagccgggctggggccacattcactgggaaacccaaagatgttcgggggctggaggcacccctcgtttacttgggtaaggagagactggatgttgccctgctggtttaacctctccttgctgttgctaaaacctctcagtccagcttaccaagcctttggtgaggcaatgtgactggaacaaggactagcgtatggtcttctacaagttccatgtccaatcttggcctaattctctcatctgtaaaatgggcataataatattaggatgaatcacatgcaattgccaagattggactatttttgacctacagactggaagtttcatatattcaatctactgcctatttcttagggctgttgttgagagttaattgagttcacagatgaacatgacagatatgtaagtgctatgtaagtggaagctatgtttgtacagaataatggacattattttacaagggcaatggctgattcaaggttgcaaagttgggctggtaattagcgagaccacccaagttcaatggcagggcttcttgcctttctcagaagataggctacttttcaccatctctgcttgaatctcaagctactgcaggccacaggtggaccgctcagctggaaagagtttgaggtatcccagctgggcacatgggtccaggctgtccaactcctgtagcattctgttcccaggagctacctttgtacccttggcttattgcttctctaggaaccacagctgcctgtcttgccacacatccctgcccccgttctagcctctgtggcaaagcctgggtagcagagaagacactttccttacacagcttttcaataaagaatctacagggtggttccctcctgctgcctgcaagctgcccctgtacacacctgagcaggccacattaaaagcctgtttttcttagtcttcctctctgcgaaggctgtttttttctgcagccaggacagtcaaacatcagtccttggaatgcatccctctttgtttccatatgaggaccctgactttagagaagttcaaggtcacacagcaaattagcttcatacactgagctagaactcaggtctgctgaagttcctacccagacctttgccattcacacctctcttaagggctggaggcaggggtagctgctgacctttgggacttgtgggtgcgagacaggcaaaggaagcagagagggttacaaatcagctctggtttagccagaaggaagaaccagacatctatattgtctatattagagctgactatgaatagtcaaggaaaaaaactggaagaaatacaccaacattctaacactgaggaaaggcgttacgggtgacaattttttttttcttcaagtttatttatattttctgaaatctgtgcaatgaacatgcacacacatctctagctctactagtactctctttaggagattttgctcatgtaagttatgtactccatacacctaattttagaatgcgcataacctcctcccttaatgcagtcctgggctggtcatagctgctgagggatttgtaacctcagactctccagtaacgatgtctgcgctcagcaggagcaagatggagagccactggactctaaaactccatgttcttggccaggcatggtggcccacacatgtaatcccagcactttgggaagctaaggcgggaggatcacttgagaccaggaattcaagaccagcctgggaaacataaggagtctccatctctacaaaaactcctttttaaaaattagccagacatggtggcctgtagtcccagctactcaggaggctgaggtaggaggatcatttcaacccagaagtttgaggctgtggtgagctgtgatctgtgattgtgccactgcactccagcctgggtgacagagcaagaccctgtctcagaaaataaattaaaaaataaaagttcatgttttgcctgtaaataaaagactttgtcttaaaaaaaattattcaatttgtgcaaaagtggcttccatgcacattccaagtattcccgctattccctgctaattggcacagctgccaaactgctggtgaaagggcaaatcctgatcttgcagctgctttccagctcatggttgcatttaggattccacctccactgccccctcctcctgttttattaattagtgtcatggcagaacttagtgtaattacaaactccttttgtcaatattacttgtttgatgcttgggctggcttctccattcatagaaacaatagagcttttgcatgaattacaccaggaatgaatggctgtagttacaaccatctttggccagtacacaaaatgtttaaattattttcacttgcatagcaagagattgcttttctagtaaacaatcaaagttaagtaaacataaccaaattggaaggaggcggagggtccatgcttgaagggtgggtgacaggctggaagaaggtgcaacaagaagcaagggacagtgtccatcaacagatgaatgaataaagaaaatgtgatgcgtatacacgatagagtactattcagccataaaaaagaatgagattcggtcatttgcggcaatgtgaatggaactggaagtcattatgttaagtgaaataagccagacacagaaagagaaacatcgcatattctcacttacttgtgggatataaaaatcaaaacaatttaacccatgggaatagacagtaggaggtgggatggctaatgggtacaaaaatgtagttagaatgaatgaataaggcctggtatttaatagcacagcaggatgactgtggtcaatgataatttcattgtacattaaaaaataactaaaggagtatagttggattgtttgtaacacaaaggataattgcttgaggggatggataccccattttccatgatatggttgttatgcattgcacacctgtatcaaaacatctcatgtaccccataaatatatatgcctactatgtacccacaaaaattaaaaataaaaacattataaaatgaaaaggaaaacaagaagcaagggacagacatctcactgggagaatgagatcccggtggtgaggtcacagaaagttgcagacatcactccagtcttggcgtaggggagaaatcccctctggctttaaagggaccctgctgtcaccctcatcctaataagagacacctttatctgtctcctctgttctgatctaccctttctgagctccatgccctggaatccaatctgaattctttctttctcacttttcatgatcttctgtctctagggacttaagtcttcctccctgctgggcgtctgatgtttttcccttgactggatctctagtttccatataacacctgtctcatagctggaagggacatcacctgcatttcagagttgctgtgaggtgtgacacgactacagaaaaccaggtgtaaagaaatgcatcttgtgcctgtacctggaaaagccccatgcaatgtgcaggattattacaatgggaagtcaaggaagaatttgagagggaataggctttgcacatcaacaagtctgattgccaattagagatctaatggttaatttctgcgtgaccttggacaagttattcaacctctctgagcctccgtctctttgagtctaagatgggttaataataagaagcaagtgaaaaagtatggcttcctagcacattaccttgcacatagtaggggctcaacgagaatcatcatcaattgcattcattcattcattcatttgataaagttttactgagcacctgttgcgtgcgagatgctgtgttaagtgcttgttttattccacttgcttcttgttatcgttattctccctcttacagatgaagagaggttgagtaacttgcctgaagtcaggcagaaatgaatgtttggaactgtgtctaaagcccagtttggttgaattgctgaggaatagagagggagaagagcctaggggtggtcctgcttttatcaaacctgcattctgatggtggagtgtgtgtgtgtgtatgtgtgtgagtgtgtccaaaaatagagtgcacagattgataaataaaacacgagaatacaattggagttacgaggccagagaacgtagtgctatgatgaagagcagggtaggcagttgtagcctcccagagaggaaggcattggaattaagacccgaatgaaatgaaggagccagctgtgggaaggcctgaagaaaatgagtaatggcagatcaaggcacgttctaggaagtgaaagaaaaccagtgtcccccgggaaggtagatgagggagcagcagccctcttgttccccttttctctttctccatcgcatcttcctctttccctttctcctacctttcttctcctctgaagatgacccatagaaacccactgacaccctcagtttcttaaaatgccccagtgccccaggcaggattggccacgtcatttgtagggttcagtgtgaagtgaaagtgtgaggcttgctgggcgcggtggctcatgtctgtaatcccaacactttgggaggccaaggcgggtggatcacttgaggtcaggagttcgagccccgcctggccaacatggtgaaaccctgtctctacccaaaatacaaaaattagccgggcttggtggtgcacttgggaggctgaggtaggaggatggcttgaacgagggaggcagaggttgcagtgagctgagatggcgccagtgtactatagcctgggcaacagagtgaaactctgtcgccaaaaaaaaaaaaaaaaaaaaaaaaacgaaggaaaaaagaaagtatgggtctccttgttaaaaaattatttaagatttcaagacagtaacacaagagcattaaaccaaaatgcaggcccttctgggcatgggtcgcaagcccctgaagccagccctgaccccagggtggttcttagggagcatttcctaattctcagcaggccttgatcctaatatgttgacttagaacttggatttgagtggaaacacagtgtagacttcagtaatatcatagaaatggggaaactgggggaaaaaattgcccatgaagtctcaacacatttcaaagaattaatattgtataaagcatgttgtctgatcacagtgcaattaaattggttataaacaatgaaaagaagtatttgtgttgctaggctgtaaatccaccgtccatagcagaacccccagctcctgcccaggccccagtctatagtctccacttgctaacagctccacgctacacttcactcctaatttcctcatcaccctggggtaagaggtttggattagagcctgagggactggttcgaggtacttctccaaacagagttctcaattataataaattcaaagccaacccaggagagaaacacacacacacacacacacacacaaacacacacacacacacacacgagagagagagagagagagagagatgcttcagctgcaggtgaggttctttgagagacttgttcaaattacaaaaagtcacatttccccatgttgggaattagatctgagcataacaggccttccaggctggaaacgtggctacgtgctcagaaagccaggtagcctatgtggcagcatttaaacgtgtgctctcctgcactagagccctgcattgtaacttgcactgtggcatcaacctccttagattaatggagaaatgctttaagccagtcacccaggcctaaagtatgctcattattcttggagggaggaatatgctggctgacacagccctgtctattcatggcccaggggctgcggctgctctgtctgtcaccttggctagggggtaaaggggtttgggcgagatgtagagaggtcagtgaatgacctcttgctcttgggtcggctgaaagtgcataagtaccagctggcccaatctgagacgaatgctctgaaaaaagagtcctcagttgctttgttgagtgtaagttggacattttccaacgtacatccttttataacctggctaaaattaggctgcagtaggacaagtggaaagatctgggtctaacggaagattctggttgctactgagggcacgcttctgagttaatttattcatgagtggacccaggctctgtccaaactgtaaagtttcttgctacctagtaggacagtcattggaacttccaacagctcttttcctgcaacttttttactttctagtttgtcccctatgagtaatgaatgtgctccaggccagggagaacagcttaaagcattcctattaatctgagaaggttgatgctgcagttcaagttgcaatgcaaggccttagtaccatataacacctgtttaaatgatgctgcatagaccacctggctttccttctagcccatatatccagctagtaggattcacagagagtcagggctccaaactactttgtctattccagcattacgggaaataatgataattgtaacaataggtaccttttcttgagaaattactttgtgcaggtactgtgctacctgtttggcatatgttatcctcaaaacaactctctgaggctcctaccattattcttcccagtttgcagatgaagaaactgagaagtcaagaaagttgccccaatccatgcagtaggtgatgaagccatggtctgatgtccaggctgaccccataacctaaactgctaatggccaagcgttgttgtcatgtcaaatgtaacctacttcctcctttcccttgtcaaggtctctgttctctgcccagtaactgccctgtcgttaaggagaacttgtatctgtcactgtgagatggggccaatgaatttacatgttacttcccaggcaacatttgcatttagactggaattgtctggcaaagactgaccctaaagaagtacagctgaagacattgaattaattatctcgctcatcatcaacaccctgtttataaattcctggcacaagttcaagttcttcttctctctccccctccccctcctccccctcttccccctccccctcttccccctcctcctcttccccctcctcctcctcttcctcctttctcctccttctccttctcttcctcctcctcctcctcctcctttctcctccttctcctcctcctccttctccatcttcttctcctctcactctgtcacccaggctggagtgcaatggcatgatcttggctcactgcaacctctgcctcccaggttcaagcaattcttctgcctcagcctcccgagtagctgggactacaggcacacgccaccacacccgactaatttttgtatttttagtagagacagggtttcaccatattggctaggctggtctggaactcctgacctcgtgatctgcccgcctcgcctcccaaagtgctgggattacaggcatgagccaccacgcctggccaagttctttttttaaaaagccacttgcaccaaggggagagaaaaccactgaccgcatgtcaggagatgagggtcccagacagctgtaccaccaaatgaatcaggaccatggacaggtcatctgccctttgggcccctgcccactcagcagaaaacaatgaatggacaccttatgtgttgggacagggggtacagtagggaacaagcagacatggacttgccttgtggagcttgtagcccagagacactttcttcacatggtaaaagggccaatgtgtttcaaacgtcctccttattgtagaattcgttttttataccaaagctaactcatgtacaaaattctagcttaggatggagtgcagccatcctctgattggagtgacagaggaaggttttgggctaagccttcctcctaggtctctcttcttgaccccttggtacccacactttacatggggtctcctagaactcgagggctccatgcaccatggtatacaaactcaagtactttccaggaccaataacctgtgacttacgtgcagtctatatggtagtgagttctgcccatgtggtttaatacttctcaggagcagacagtacaaagctccccactgcttctgcctgaaagccttttttttttttttttaaatctcctgtcccgaaggcttcattgcggatcatctcatgataaaggtgttaggtgccttcagcatttgttcgtacaataaacgtgagctatagttcccagaagctcttaattcagccttcttattttaaacatactctcattttttggagaccatctcaaatggtaggaagcatggggtccaggtcagatatcacacttggtgtggacagtatttcatcatgaatgaacaaacagaccagctggtgggtcttgacttcagccttagatattctgtgcaagtttagtgaaacaggttcatgggcaaaagcaaccagtgtgcagatactataaaaatgtaggattaataagcagctatacttccatcttttttatttgtccttgtggctagttcttttccagatcagaagcttaggaggagctagtaaggattgccgataatcttaggctcttataagattgtccctttagattcttcactgttttttttttctcccacattgtgacactgtgattaagggtgtaacagtagttagcagtgcagtgttgggtcatgcctgctgtctgcttcttcctcatataaactattggcctagtaaatgcagatcttcctgttaaggtagaaaaagcattgagattagctattgtaatagagtctggcagaaactgaaagacaaactctaaatgaagagagcttaacaaaaggactatttacaaaggtgtgaggaagctccaaggtatagatggcgcagcacctagggaatagcagcaactgagagcagtaactcctgcaaggtctgaagggagaaaaagagggtgcaattgctggaatccagaaagaaagagagtgagagagaagcctgataggaggagctctggcctttggttgagagctggagccaacacaaggaaaggcagtagagagaaatccagaaatccaggacaataagtaacttcagcttccctgtcttccctccttcctgtcaactgtcagttgcattccctattggctgagtccaagagaaagccatgggatagggaacccattgatgttgtccatacagatcagccccctgtgtggacagagtgggtcagagagcaggagcatgtggaagagtaaggagatgagaagatgcccagcatgattagacatcaaggagggaatgggtctctagtgctggggaagagccctttggaagagggtgaatctgaatgccgagtccacccgtggggctagtactcatggagtcagccagggtaaatagtaaacaagaactaacaccagtgtgtgctttgattagctattgggctataaagactttcctgagtgctggattcaagtaaagattggtgtttagtcaaagtaggtgaggaagtactcaaaatgtaagtgaatgggtgactgtgttccaataaaactttttccctgtacagaaacatattcccttgttttgggggttagaatgtgaacatctttggggaccattattctgcctcctacaaggccattcacaaaagctgcttttgttccactgcagagtctttttctttaaaagggctagatagtaaatatttagccttttcatgccatgttgtctttgttgcactactattatggtgcaaaaacaatcacagacaaaaatctctatttataaaaataaatggtaggctagaattggcccatggctgttgtttactgacttttcttctgttggattcaccaagcattgtctgagaacttctggtctgactgagctttggggctgaaggatgaataagacttgttcttggtccagaagggatgttggtcactgcctggacaaatgcatgtaaatagaagcccccagggtgacaggcttttgagggtgggagccaaggagcagcaggtgcagctcttagaggaaacagcttgatcttctaaaagaggaattgtccagattacagcagagaatactgagaagccccagcctgatgatccagattaaaatgatgtcctaggtgtctgaggtttgcggtttggctgtctgcacccacccactgaacaattgcatgctgattaggagcatgagcttaacaggcctgggatcaaaagctgtgtgacttagacaagtatgtcaggttcctaatctctaaaatggagacacatggggtaggtagatgagattgtgtgggtagcatatttgttgaatggagggatgctctctaaagaacagctaccatcgtaattagtattggagtttcccacaatgccctgggaagctgccctgctccatgtctgatttgctagcactcacaaagaacatacagctaataccttgcttgttagcaataacaatgctattaataatagcagtactagttgtactaaaacaagagtagcggtaatggttgctaccacttaattagcactatctatttgccaggaaccatgctgagatcttcacaagggttatctcacttactctgctccacaacagagccccattatttgccacattttaggaaggaagaaaggaagctcagggaaggcaagtgacttccctgagatcacacaggggcaaaggttggaagtgggattcacactcatgtctgtctaacgtcaataaccatgcttccaagcccctggcagcacgaggataacacactctttcttgtgcctcttactagtgtccagacggcagtggattgtggcagcagcggccgaaaagagatgtaagttaaccccaggtagaactgagcagctcacaagggtgagcccctggctctctctgtccagtttgcagagggaacatccatgtccacttggagaattatcagtgatgcccatgagactaatgccttcatggtcataacctatagcactaggaacatcgtattgaactgccctagttcttttagacagaaagaagcctatgccttctcatgctactgtcctcagacaccttcaatggctccctattgccccagaacagactttttacactgatgtttgtattctgcacattcagacccttgccttcccctccaactgtgatttctggtttccatattgtttatgccccgacctttatgacctccgtacctatgtgtacgtgattccttccacccaaaattccgttcttcagtccctgcgtggccaaaccctaaccttcaaagaagatgtagctcaactttcactacttgatgtctttccttaggcctccaagaagcaaatcaaggctccctctttgaaagaaaaaattattaatgctttatagaggcacagagggtaggttttattagaacctaccattactaatgctttatagagggacagagagcaggttctagtaaaacctaccctctgtccctctataaaatattaataatttttaaaaattttattgttatttatagagatggggtcttgagggacagggtcaatgttaagttcatgtggacaagaactggtgcttggcataaatagagcgtcctattaaaaaactatatattataatatatatacacatacacacatataaataatattaataaatatacacacatacatatacacacacatatacataatgttgaatgagtatatcaacttacgtggtctcattgaggacctgtgacgaccccctctctttctgtgccgctttcagaatcaggggacataaaagtagagtccctgttttaaagatgatccagataaggtaaggaaggagttaagaccttcacacttgatatattccttgaacacatcaaattcaatgccaaactttactcctaaattggagagacctcaacatttgtagtggagtgtgtatctccccaaggaagagtgccatgattaatagcatgggcattggaataaaaaggaacagggtttgcatcccaatttcatcattgactagctgggtgaccttggccaagacccaaattggcctctccaaatctcagtaattccatctgtgtaactgtgacagcactggctcctacctctctgggatggcgagtgaggttatgcaggtatatcacttagcacaatgcctggcttatgctatgggtgaatatctaattattgctgttactgtgattgtcattgtgctgatggtgtcctgcaatcttattctagggataacgtctccatcctcagctcccagccagagggcagcctgcagtcctggttgagctgtactctgtccctggccacagatactatgaggactccttctcgacagtcagccaccagcagccgcatcctcagccccaggtaagagtatctccttgctgcctctggatggctaatagcttgaagaatctcagactttgaaagttgttgttcaagtctttcattgtctctggcataggcaaaaacaagcatggtcctgaaagtctggggtataactctgccacttcctagctgtgtgactttaggcagatcctttaccctctctgagcttctacttcctcatctgcaatacatggaatataattttatttactgatccaaatggttgaagcaatgaggacctaatgcagtcctctccagagcatggttttccagatttttaaatagcacagggtgaacattttaaaaaatagtaatagttgttatagttgccttctacttaaggcacatcatactcttttttccatttatgggtaattacaggttcaaaaaatttttaataaacatattcacttaagcttttttaatggaaagtcattataaagaaattgggccagatgatttatcacctggagattttagctttattcaaattttagctttatttttaattttataatttccttaccacagaaagggatgaattcaggtgtggcctgatatgggagcctcacaaatctacagaattgccaacaacaaccgcctccaataaatgggcctttggattcacccttagttgcacagtttctatcatccatcttccttcttgcttttcagctccatttctctgagctcacttggtttcccttttcaagggtggccctcttgtaattaggagttaatggccataagtcagaaattatggattaagatatgcataattaagatgagatgctcacagtttttgtgaacagaaggcccaatatgataagactggaaaaatcacagactcacggagcaaacccagacaaccgcttcctgactcaaaacgtgtttgctttgatgcaggggttgtctttacaaaaagaagggagtgggagtttatgctaaacttttgggcatatttggcaaatggcaaatgtctggtgcatgtctgcagataatcttaggctgaaagacttgatgtagaaaatatcaaagacaggctccaagaatgggttgcttctggggagctaattaaagcaagattatctgattactgctcttaattaaaaacaaaggcctgtatgaagaagggaattgtgtcctctgtgaactccaaactatgaggactttatctcttctgaaaactaaatacctttgcgttagcctgtctgccagtggcagcaggagaattggaggcagccagagaagaatgtgaatgctcattaacataataaccaagtttcataattctaattatattagggtggataataaggatcctaacagatgaattgcagcctaacctaagttgtttggcacctgtttgaatgggagatggtagggtattacggtttcggtgcaggatctgaagtcagagctggattccaattctttttttttttcatttgctgtacatgtttaagatataattggcaatatcaatattgccaaaacaaaaagtaggcactttttacattgtaatggcctgttgaaaagttttagaattgttattctatacagagattcatctttaatcagtgttctggctgcttccaaattcactgaattctctagcactggattagaaagcataatctataggaaaacgtatacaatgtatagtttttaaagtcaacgtttttagaacaacaagacaaaccagtacatataactttcaataagcatttatcaaatgcttactatgtatggacccggacatagattaaaaaataatattccaattctttatttgcatatctgcagctgtgagattttggacaagctgcttaacttctctgttcatgtttcctcccgagtaaatcatgattgttgtcaggggtaatgtggtgatgcacaagccactctttactcagagcctggcacctagaaagagccacaaaaaattagccatttttatcagcagcagtaactatttgatgcccggaggaatcccgggagatagacttcactgtctatcttcatgttacagaagagaaatctgagactcagagaagggggagcaactgatccatgcatagatggtcttacagctcctgcagtggcccctcaggcaaggtgggtcttcagcatctcccagagagccctatccagagtctctttcccttttcttttccctttccccttccaagttcttgggcatgttcagctgctgtttggagtgaaagtgcttgcaccaagaacagggagggggcaggaggcaagggagatacttacacatctgtaagaagggatttcttgtctgtcttcctcatggccacatccccagggctggctcacagttggtgctcaataaatgtttgttgaatgaataactgaccagagcatcaaggctggaccagaaatattaattgtatttggtcacagctcagcattgattgtggcacagagagggttggtagtttactaatagcacaaagtaggtaagtggaagagccagaatttgaacctaggttggaatcccaccaaagcctctattttatttgccatgctaccacagctctctgacattcatccaggaggtagaccactcacctggtaaagtttactggaaaaatctgatctctgtttattagtactaaaactgcctaaggattattatgcaaccttcaatgttcagccaagacaaagtgctactgagcaccagatcctacgacattaagccctaaaaattatgaaccccttcctttgaatatgtttatagcttgaggactcaaggcattctgagttgcaaaggaccaccgggattatccagcccaacttgctcagtttatagatgggaaaacctgaggtctgcagagggaaatatcttatccaaatttatggtatgaactgacacagagtacaggtgtcttgacttctagctctttttaattgcacaagcaatctatgaatacttctctcaaagaacttaaaatatatcagaaggctgaaatgcccttggccaccactgcagtcttaagcttccttctcagaaggatccatcatcttcagtttggtgtatatccttctctatctttttctatatgtatatatcataaacatatacatgtacttgtagcaaatatatagcatatttgtgagatttttaaaaacataaattatataattacatgtaatgcttttcataaatttttacaatatacttctttccctcagcaatacaccttggagatctttccttaccagtatgcataagttcatctcattctttgtaattcctgcacaagctgccatgctttatttaactatagtgtctttatttcacttttaggtgctttccagatatttgatattaacttgtcaagctttgaaaaacacacattcttataaacatgggtaaatgattctctggatcaaagggcatttgcattttaaactctaatagatatgagtgtcctttctgctaggagactgtatcatagtagagaacaggactcctatttatacccgctcccatattacctggtgcatgggaagacccaataaatgagcctcttggatatatcccatttgactgagaaagaaggtcactctaaaaacagaagagagggagaaagcagtcttctgccaacaaaataaaagcattccccacattatttataaggggacgtcaactcaagagaaatacacctaaagcgttatgatttacagcctaggaatcatgctgctgccgctgataagtgcaagcgcttctggagacgaagacactaaattacctttgtggccacagagagggagtttatgggctggatggtggcagtcacactttgttcaggagtttctcttaacatctggccgcaagtggtgcctgggctgtccagggtctggcatgcttacgtcagtccctgctgcatgcctggcctctccttctcgctctccttccactgctctgtggatgagagtgcgagggcagtgaggctctcccaacttcttcttaccctgacaacacattgggcttcctgagcagggtctaagcctcatttctttctagatcctcaccccaagcccagtaaaaccctagccatggtcactcaccctgttctgcaaggtccacatgctgacaggcatgacgacctagctgtagagactgccaaggtattgtcatcgggcagtcgctgttctcatttcctgggcaattattccaaaccatcctgacttccctctgatctctccccatcactctcaggaggcaactccacttctgtttcattcaaagtaaaataataatgcctttaacttctgctgtgatgtatatgcattcatctctatttgcccccatattccctctggtctcagaagatgaggtccagtcctgccctgtctgaagctaattgggatccaggacttctttctccctaaaacactctgattcatctagtgtcacctctgtctcttgtgtcctcaactttccttgtttcagttcttcccccagaggttataaacagctgaggtcctccccatcctaaccatgtcctcatccatcaccttgctgtcctattgagttactgtttttccttccttttgattcgagcttctcagacgtgttgttaataggtaccatcttcacttactccacattcatgcctcaatttactacagcccagagactgctctgccactccattgaaacctttctcactgtgtcagcagcttccagagacacaaatcaggggacattctctagtctttatattttcctggacttttccccactgttgaacatttcatggaactctatctgcttggccttgacaagatttctgctccttggttctcctcaaacttctcttccctggtctttgcctcacgaccttatctccaaatgccagggttcacaggttactgccctcacttggctgattctctctccacctgatagctggcaattctccttttgtgattttggctctgcagctttcagcaggtgacccccaaatacagatgaacgtctttatattctcccaagttttaaatttatgtatgttatcttattgtctatactgatcaccaaccaggtatctccctgatgttttaactcagcatgtccaagaggaaactcatcctgccccaccagccctgtgttatcaggatcattgagtggttctgttattcataaagcaccacgttggagcccttgttatcttaggttatcattcccctctctcatccccatattcaacgaatccgtaagtcttgtattctaccccccacccaaacaaatactctttctgcttctctccatcccccactgccaacacctttaagtcaagctaccataattgtgctcctagactctggcaaagacctttcaactccaccctcctttagtccatcctctatactttagccagtttgattcctctaaaaggaaaatctggtttcagtggctcctcattgcctacagcaggggtcccagagtgcaggttgagggcagaagcatgtggtgggctcagagagttcaacagggcctgaccagcgggcctggaaaacatacttcaagaaagtaaagggtagatctgttttctaatacaacctctcctttactagttcctgactatgagcaagttacagtctccgagtctcagcccctccaccgttaaatagactttaataatattccctttgcagagctgaagaattaacaactgtagcaaattagcactctagagtgctcattggaaggcctgccaccaagttggtgtttaataagcagaaactcccttccatcctctgtccttcatcccagagcaggccaggtaatgctgctgtgccaaaggcatggatgctgacaggcaggaccagggaaaactaggactgggtgctccacataccagagattgcagaagtgggctaaactcacagcagaaaaccatgagcacaacagaaaacctcttggcagtgaaagtggagttttggtgagctcagttttaaatatgttaaacttcgtgtgtttggggacatccaaagagaattgtccagaagctttttaaactctgacctggagccctaaggagataccaagaaacctctgcgtaatgttaggattcttatgagtgtagatgacataaaacccatcaacctggccagagtaagaaggagcatttattgtttcctgtagctgggaaaccaaaaaggaaaatctagcttcaggcattactagatccaggaattcaaaaatgatcatggggatttggttccccaccaacctctctgctctgctgtcttctatgttggtttccttctggggcaacaagatggcggctaacagctccaaactcatgcctgcaccattctgagtccagtagtaaagagaatttctctcttcttcacagttttcacaaaaaatgcaagcctgagtgagcctgaaccagtcagaatggacaaggggactgaaggagcctcttacctttggcctaagtcagtcttctcacctggctcttggaaattcccaccaaaccatgagaacatgaagggaggaggggttccccaaaggacaatgaagggccttacctgaagcaggagaatgaggacttggtagatgaaaactataagcatagaaaatgttttccaccaagggggaagctgaatgaactacaggaatgggcaagactatgaagagaaagaatggtggggaggaaggaaacttattaaagtgtttggggtccccattcagtaaccttgggaaatctaactaaaatggtgtctcctgatcagagactttatttatccctaaatttcaatggccaatctatcatcacataattagtgatgctgtgctttgaatttattaccaagcctggctttctgctgttgctattggacttgtaccatattgcaatgtgagcatggagattattgtataaattattctcactcacataatcatcgtgattttaattactgtgtaatctttgctaattactgttgtatgtatcatttgctttggtgccgatttaacacaactgcttttcgtttggctaaaagatggcattacaacttttcctttttgcaggagaaaatttgctttctgtaaacatttgcagccccaaactcttggcttgcagttcttggtttaaaaggaaagatccagaccctaccaccagccctgtttgtttttatttgggataaggctggcttgaataagtaaaaaggtctaaattacacagtattgtctttaaaaaaacagttgcgttactttcaaagaagggcaattactctactacagacaggaagccaaagatgggtcatgtgagggctgcttaaatgatgagataagactcgtttgtaattagttcattaattatggatatgtgaataaatggtacttagctttaaaaaacagctcgttcccaaagtggggtaagcatctgatgctaatcttatttcaatagtacatttatttactggtctcggcattcttagaaatggagctcaggataattttaatccatcctggaaatacttaatgaaagggcctctcatgaatatggttttatgtcttcctaggacataaggagtctttttagttttatcagtattaggaagattagtggaaaagattttgaaactgaatgcacagaaatattaaatgcaaacacattaaccatggaccaaaggcctgagcaagtgaaaacaggtgaagtctgaatgtagacacaggatttatccttaggacccaaatccctctcagacaggtatttataggaaggaaggctgtttcctgtctagaactcgaggtcttggatggtaggtctatggaccttttagaaaatttgaggttcacctaagctgcaagtttgtagaaaactatttggatacatcgttgatggttcagaacattcttttaaaatctgtggttctctgattaagctaaggttttgttacgcaaatttaccattgaaatatatatacaggaaagtggatcttgaggaaattttcaaaaaattgatcatacctaattaatttgtaattactaacaaaatcaagactggaccattacagtgcccctacaacttccttgtgcccattcaagccaccacctcctccttcctcaaagaaacccaccatcctgacttctaacactgtatattagatatgcccctttttgaactgtgtaaatggaagcatccagtatgtcctcttttgtgtctggcctctttctttcgatattttttcaagatgcatctacactgttgcatgtagcagtaattcatttattttcattgctctatagtctatgtcagtggttctcaactggaggcacttctgcaccactacccatctcaacaggggacagctggcaatgtctggagacatttttggctgtcatgctactggcatccaatgggtagagttcagcgatgctgccaaatgtcttacaatgcacaggacaggccacatagaattatcgggtccaaaatggcaattataccaccactgagaaaccacagtcaataatatgccattgtgtgaacatagagtaataattaatttattctattattaatagacaattaggttgtttatggtttcccatgattatgaatagtattactgtgaacaatcttgtacacatcttttgttgcatgaatatacagatttctgtcgggcgtatactcagcagtagaattgctaggtgtgttttcagctttggtaaatactgtcaaaacagtcattccaatttatgtaaccataagcagtgaatgaatgttctggttgctctaaatccttgccaacgcctggttttgttatttaaaaaattagctattctaataggtgttagtagtttcaaattttcatcttcactcacatttccctggtaaataaacctttttatatgcttatatcttcattcgaatatcctctttaatgaagtgtctgagaaagtcttttgtccattatttttattcttctttggttatccatctcttttgtattgatctgtagttctttatgtattctaaatgcatgccctttataaggtatgtgggttttcttccactcagtcacttacctttttcactctcttaatggtttatttttataagaaaagttcttaattttaatgtaacccagtttataatgttttcctttatggttggtgctctttatatactgttgaaaaattatttgcctactttgaaatcatgcagtattttcttattttttgtagacattgtattgatttaccttttatatctagatacacaatgcatcatgaattgatacttatttgtgatgtgaggtagggctcattgtggtgtgaggtagggctcactcttttccatatagatattgagttggtctagcacatatattttagagaaatgatactgtccacattacacaacagtataaatttgtcataaatcaagtgatcttatgtatatacgtctgtctattctatttcacttttctatgtgtccatccttgaaccaatatagcattggaagtataagttctccatattaattattctttcaggtcagcaaatgactctcagggaaagtgccacatcatactgtattcaccttcagtgtatttccctctttgcaggatttggccttttgagtcctggctgctttgatggcttcccactgtccttaaatttgaattctacttttctggctttccaagtagctctggtgcaagctattacatctggaagctgagtgctgagctaggcttttattctcttacataaataaacatttttttttccaatgtacacttccaccaacagtgtataagcattcgtttttctctgcaacctcaccagcacctgtctttttttgacttttaaataatagccattctaactggtgtgagttggtatctcattgtggttttgctttgcatttctaatgatcagtgatgttgagcttctttacatatgcttgttggtcacatgtatgccttctttttaaaagtgtctgtgcatgtcctttgctcactttttaatgggttttttttttcttgtacatttgtttaagttccttatggatgctggatattagacctttgtcacatgcatagtttgcaaatattttctcccattctgtaggttgtctcttcaccctgttgataagtctcttttgctgtacagcagctctttagtttaatttgatcccatttgtcaatttttgctttggttgcaattgcttttggcatcttcatcatgaaatctttgcccattcctgtgtccagaatggtattgcctaggttgtcttccagagtttttatagttttggcttttacatttaagtatttaatccatcttgactattgtagaaaacagcatggtgattccttagagaccaaaagcagaaaaaccatttgacccagcaatcccattactgggtatatacccaaaggaatataaattgttttaccgtaaagacacatgcatatatatggttcatcacaacaccattcacaatagcaaagacatggaatcaacttaaatgcccatcaatggtagactggataaagaaaatgtggtacatatatgctatggaatactatgcagccataaaaaagaatgagatcatgtcctttgcagggacatgaatggagctggaggccattatccgtagcaaactaatacaggaacagaaaaccaaataccacatcatctcacttataagtgggagctaaattatgaaagcacatggacacatagaggggaacaacacacactggggcctatcagaaggtggagggtgggaggagggagaggatcagaaaaaataactagtgagtactagacataattcctgggtgatgaaataaactgtacaacaaacccctgtgacatgagtttacctatataacaaacctgcacatgtacccctgaacttaaaagttttttttcttactttctacacctagggaaacacgaactttcacttatattttcttccagtcctaacttagtgcatctaccaccccctctagaatgtaagttacttgaagacaatcactattcatctctatattgacagcatctgtcttcatgacactcaataaatgattcaggatggacgcaaggaaatattaatggatgcataatttccattcagttaaagctgcatcttcatggggaactgggtgcttttatgaatgagtctgagattttctgtcactattgccatttcaccatactctggtgagacaatgtctctgcatggaaagtgaagggatgcattaaattcacttaaatatgttgaatccaaattgaatctacaagccaagtagattttaattactctacaaatctagaattgtgttcttcaaaacattgtgaaaattgtagcagaaggtaaaagactcgagttgtagagccagtacttgcaccatctcatcagagtgtgacttgggaagttctattcccttctctgttttcctaggtgtagaatgaggggttcaaaccagatgaggcccacacctccctctcaatttgatatcctagaaattgatcacatcctgtagaaatgaaacaaggctcttggcttggtgttagaaatatggagaactcactttagattgtgtactggaagtgggttttgaatcttgtttttcagccaggagaagtggatgtgactgaccagtgagtggggatactgggttctgaattattcagcccaggtgaggcagccctttgcacattctttctgcagttccacaatcccccatctttctgttcctccattccttcattctttccattctacaagctttctttgaggcagtcctgatgctggggattcatagaagaaagacatggtctactccagaaactccagtatctcccagtcttgctgggagatacaaataagtaaatagacaaccacagtacagagggggacacaggaggctgtgggagccaggagaggccccagcccaggccagagggcggaaaggcttcctgggggaagctacagttgggctgaacattaaagggtgagtgaaaatgtttgtttgtgtgttttttctttaaatatagaataatggtttatgagaatcacctgcagagtgtcagttccttcctctctgactccctcctaactcttttttattaggctaatttccttccttccttccttccttccttccttccttccttccttccttcctctctgtgcctctccctccctccctcactcactcactcccttccttccttctttcctcccttccactccctccctccctccttctttccttcccttgctccttccttccttcctttttctttcttccttctttttttaaatttgttaacaaaagaggacactatcaactcgtagcttctactttgatagttgttagaattttccacattgactttatttctgtctttagctcctcctctacatctatgtttaaacacattttccttcttccttccttccttccttcctcccttccttcctccctcccctcctccttcctcctctcccttctcttttcctttccttccccttatgaaaacaagttgacaacatcacaacagctctccttaaatagtttcgcatctttcttctaagaaggacattttctaacgtatcagtatcgcacttaggaaaattaacaaatccataacattatctaagatctcaacttttatgttacccaattatcctaaaactgtcctgtatcactgtatttttatattatccccttatgtatttatttttcaaatttaatttttaaaagcagtgggtacatgtgcaggtgtgctacaaagatatattgcatgatgctaagattcaaagaatgattctattaaagaatgatactcattatatttgattatgcttctttagtctcttttaagaaaaataatagactttttagttttaagctgttttaggttttcacaaaaagagcagaaagcatagagagctcccatatatcctttttccctgttctgtttttcttattattaacatcttgcattactcctccatctcttttaaatgagaacgatccccttatcaccacccagctccaattttactgttttgtttttttttttttttttttttttgcgggggcagggggtgtagagttccaggggtgacttgaatgggcaactctatgcaaaaatcactgaccttagtccctggtagccagtaagaatgtgtaggtgaagtcaaggcaaattctgctgagtcacataaggcatgcaggcaggtgtccactcagggcagctcgatggattggtttgtaaaattgtcaaagactcggccccgaccttaagcatcagagagaacagcaagcaagccttgagagcgaccttgtctcataaaaactgccatattgtaaggaatgtaggatattcactgtgtctgtttcctgactctattccccatgtcaggagtggccaggcatggggacagcatggggacagattgctgctaatgtcacctcctcctcacttccctgctcccttggctatccttcccccaaaccccagcaccctccttgctttgaacttccctctcagctaggggtgggggagcttcctaagcctcagttttcttgcctgtgcaatttaggtatcagcccttgctggtcaagggttttgcagattgaataagctaagaatcaataggaggaatcttctgcttttgcttggagtgtctttcttgagccatcgccgccattgaaatcctacccttcttccaaagcctgactcaacccacctcgtcaagaaaggctgtgcatggccaggcgtggttgctcacgcccataatcctagcactttgggaggctgaggtgggtggattacttggggtcaggagttggagaccagcctggccaacatggtgaaaccccatctctactaaaaatacaaaaattagctggatgtggtggtggcgagcacctgtaatcccagctgcttgggaggctgaggcaggagaattgcttgaacctgggaggtagaggttgcagtgagccgagattgtgccattgcactccagcctgggtgacaagaatgaaactccatctcaaaaaaaagaaaggaacgctgtgcacccaggcaccagtattgactgctgtctcccttgccaatctcttgctgcatttatagtctgtgcttcacagtttctctggaatttcttgcattgctgacccttctccatggtttttttccagactcaacacctacactgctctccccaggaggggagggcagcccatcttctgctgctatgtgctgaaaacattataggtagacagaccagcatgggagtctcagctctgctccttctcagcaagcccatttgcctgtcttagcctcagcttcctcatttataaaatgggacgataaagggcagtagagcagagcagttgggagccatgggcctggggtaggactccttggtttaaatccatgttctcccacttattacatgacaaattactgattctttctgagcctcagttctgacttgggaagattgcaatatctgctttagaggactgttgtgagcgtaaacttgagtaaagtctgcaaagcctaaaggcataatacatgataactctaatgatgtgctatttacctgcacaccacagtggcttagtaagtgcctcccattccctgcataatgcatagtcctgggtgccatgtcaacttttgttacagactctctgttgttattttggactcagttaccaaatattcaggtcatcttcaaagagcatctggtttcccatctcaggcctcaccagtattaaagaacatcaatatgtttttaatttcctctttaatttcagggagtggatgaagaacggggggtgacagcacgctttgggggatgattcacggtgtcattaaatctgcattgagtttcctgtagctacaattggcccaggctatgaccacactcagtcctgggaattatgttttgtttgttttgctgtgtgattaagtctaataacagtaaatccagcatctccttgacttggactttcttggttcattacatcgcagtggatcttgaaaaatatgtatgtgtagatgtaagttcaactggttgagtttcccgtcagccttctgcccagtaggtgtgtgatgtagtggaagaagaagaatgggattcagatctggcccaccagggttcaaatgcaggccctgccacttagcagtatggccttgagcaaatgttttctcaccactgagcctcagtttcctcatttgcaagatgggatgatgcctctgattttgatgcggtgatgcttcttagcttgatgagatgctgcatacgatacatgcagatataggtgcctccttctttgttcttcaccgattttcatggagcatctgcttctgtggctgacactagagataaaatgatggggccccattcataagataatctgaaaggggaaggggtatggtccaagcaggagacactgtctcagacactagctcgttctgaggctgaaccaaccacttcagtctccacttcccttctctgtgctgttcacagtaggctcatacataggaattgtttactcttgaacatctgtcctcaatctggggacttctctagcactgatgaaagaggtcattaaaagcaatcagacaagggttaagattttaaaatttatgttatactgttatgtcaaaggattaactttgagataaataagtcatgtatggaagtttaactgtagtgtcttttgcctcattggtagtactgggggtaatggaggtagaagtggcttccactcttaaatactgaatatgcatatggcatgcatcatctctcatttctaacaagaccctgggacctagggcagtgtcattctcactcttacacctgtgcaagttcaggcttcaaaagataactgggggcccgggcaccgtgactcacgcctgtaatcccaacagtttgggaggccaaggtgggtggatcacttgaggtcaggagttggagaccatcctgaccaacatggtgaaaccctatctctactaaaaatacaaaaattagcctggcatggtggtgtgcacctgtaatcccagctactcgggaggcggaggcaagagaatcactcgaaccctggaggcagagtttgcagtgagccatgatcgtgccactgctctccagcctgggtgatagagcaagactccgtctcaaaaaataaagaaaagaaaaaatacctggcttggaatagacagagctgggatttgaactcaggtctctctgcatctgaagctctttttttgcttttagccttgcaggttagaaagagtggcaatttcagtattcctgagttttcatgtcctagtttacctaataaacttctataacttgaagcaacccatacttacagcattttcatataaatacccttattcatcagttcatttaatcagtccagtatttattggaacctagtatgtgacaagcactggagcatgattcataacttgaacatacattttattgagcacctactatgtgcctgaggactggcaattcactcatgtatccaacacatgtttatggagcacctacaatgtgttagggccctggtgcttccctcactcactcaacacaaattcattgagcacctactgtgtcctaagacattattctatagacactggtagcagtgaatacaatagataaaaatcctgccctcatggagttcttatctccacagcattgcaaggccaatctagtttccctcatttttcagctaaggaagctgagggttagagaagttaggcaatggtccccaggtcacatggctagtgagtggtgaaaccagacttggttgccagctgtgtgtgcttgcagaggttactcagcctctctgtgcctggaggtcataatccctatctctcagggtggctatgagggtaggagccatccgtttgctctctcctatattcctggtatccagcacagcacctggcgcacagtaggtatctagtcaggggtagctgttgtgaccaatgactatttcatccactaagttatagaaccagccccggcatctttgtggctggatgcttatcctctggctctttcccatagcaggtataccagaaggatattcctttttggacagactacagggtgggcagaagaagtctccaaggcttttctggagcctctccttgaagagtaacagtgcccctgcctatcctgcctcatagtgactctgagagccttctatacgtcatccctctccctggcccaggctctgggaagcaggcacggtaacatgttgattatctgacatccctccatcatgatgatggagagttccatctgagccacaccgacctggtcctgtgaggacagctagaaaaaaaaaaaaaagactcttactggtccccggatgaagtcagacaggatgtgtttgaagtgtccagtgctgggacaggaatggggatgatcatccagcctcactcagcagaacttgggatccttatcccaaagcctacaaaacggcatctgaattcagattaaattcttcagtctctatacagaaagaagtggatgcaaggaactttataccttgagaggtggtgcagacaggaagtagaaaaagcacttgcagagatgtaggtggatttctgcatgggaaagccaggaagaagcacttggccgtgcttcttgccctctcttccttgtctctcctcactcgacccctactgctcctctccagccccctaggagtctacactacgtggcttgtattcctgttttaagctcaccagctgaggtttcaaaggcaccagaccatttcagaaaggtaggactcagctcactccaatctcaagacattagaccccatgacagccaggctaggcctgagtggctgtgctgggacatcttggcttccatgccttgtagaaggcattgctcctcaagggccccagggaaggcgagtggatcttgccctgtgccagcatagctgggaaccttcctggcttgggcccagcaaacctatggcctctgtacctgattgccagcactcacagactgtgacctccagatccccatttctgggcagctggctacttcgccatggaccccagcctatctcgcctttttgttaaagccaagatggcagatccttagttgccggcctgaaaggcctctgtttcccctctctccttcttgcgtttgcctaagtctccttccttcttctccatcaccaccgcccttctgggtctccttcctctttctctccatctcatttcaacttctttcctgtttaaactgcctcctcttctttcatgctctagccttccttctcttcttcccacatttctttgtcctccctccacttttcttatcctgactacctcttctttctcatctaccttgattgaattcgacagcatttgctgagcatctactacatactgggctcagtgccagttccggaggtgcagaaatgagagtcagcaagacactgtcagttcagacttgtggtctgtgattctccttcctcctacttttatgccttttttcccccctatgtttttggctcatcttcctcctccctcctcctcctcctcctctacctcctccctcctcctccctcctcctcttcctcctcctgggacttcttcaccctccgttttcatgccctgccctggtgtccgcagccagcagtggcagtgggagctagggtgagcaggatggcagagtcccgggagattcagtgacaggagccctcaatgttgccctcctcaggtggcaggcggtggatgagacagagcatccaagacactcattcatcacacccgcctcctttcagggccaggacaggatggaaatgacttttgtcagttctgcggcagcccactgcccctggcagctccaagctgtttattaataaaaagtaaggaagaaaaaaaatacaggcgtgtgaatgccatcttgctgtgtattcgaggagggattccaaagcaatgaagttgacaaatataccttcagggaatcacaaaagagccctccatctcctcttccagcccatgtccagctatgttgggaacagacaagaaataggaaaggagggagctgctctgggcaaacgtgtggcttttgttttagcacataggaaccaacctttcttcttacggtgagacagaaggtcacttgcccattcattcttctatgcatccctctttgaacttcaattgaggcttttattgagtccagtgtggggttgggttctggagattcagaaattaaatagtagtaatattgattgcctttaattattaatgattaataaccatttattattggttataaattattcatcataaccactaaccattatttgggtaattaggtgccagagacagtatcaagggtgtttctttcactgtcccagctgccccaggaggaaggcaccatgactaggggtcggggagtagaaggagtactccgggtagaaccactcctgcaagacccagaagcagggagggcttggcctatcccaggagaccagcgtcctggagcagcatgagcaagagggcaggaatagcaagcctgatcacacaggagaaggattgagggtgatggtcagagagagaaaggaggtagctcctccacattgccaccttgacacccaggtcttaccgtcaccagaccgctgctgtaaccctcctccacccatctgacatagggagtaaggagaggcagatgatcacagccagctctatgtcttgtcctcatgaagccctttagccgggcccatcattgccatggcgatctcacacaggcccccagcctggggagctcctgccagacctggaggagataggtttgtgggatcactgaagctctgtcctcaggggcgctcaggaaggcagggtctaggtgcctgtctcagtctcttctggctgctataacaagaacaccatagactgggtggcttataaacaacagaaatgtatttctcatagttctagaggctgggaaatctaagatcaaggtgctggcagttacatttgttgtctgattcatagattgccatctcactgtgtcatcacacagtggaaggggtgagggagccctctggggcctcttttataagggcactaatctcatttacaagggctccaccctggtgacctaatcacctcccaaaagccccacctcctaatatcatcatattgaggattaggtgtcaacatattaattttcgggggagacaaacattgaatctatttcagcccccacctatttccctgggaaagacactgctctcctaccccagccattccctcccgtgccttccatggccatcacctcaagggagctttgggttggcttccttcccagattcaaaagcccattgggtcactgtggtcagttctatttctcctaaactgtcctgtgtgatcaggagtggaagtggtgttacccaactgggtaagcaagaagtcttcctcaaagtcttgtagcagaatctcagtcaccctttatacatagagttctgaatcctacaatcgtcctgattgttacagttccagcaacaaagcactcagaggcagggaccccatgattggaaacccgcgtgtgcatcgccctcagcatctcttcaggcctgagcccacagtggctttatctgcagtgccaacactctgacatttggcaacttttttacttttttaaaaaataaattataactttggtgaggggagggaatggggtcgtttctcttagagagaggacaaatagattttatttattaaaggaaaggttgatggactccagtctctctcctttgaatgatgccatttattttacagtctataatttggtcccactgtgagcctcctacttttcagaggcaaagtgtttttggcgctgctgccacaaactccctctgcataaaaaccacgtctggtgtagtcccagaatagaaaccgtctgtcctcttgtgtatagtcttggttttaagttgatttcatgtgaatctttcccttttgggggaaaaagattttacctacaccgtcaccccatgaaacaatcagggatgtcatggggtatcccgtggagacacatatttgggtcttgactctcagaagccccacttggtgggactgtcctctaggcttggccccaaataaacaaacagcccactgcatgtccccttccggtcttgaagaagcaaactacttatttcacagtaagctctgggatgataggtcctatcatgtcagatatgatgcctcataaatctaattcatccgtcctagctgcagttttaatctactcaaatgtacttagctgggtttaattatagatagaaattgcattcggaaagcaacaagaaatcatttacatggcttgaatttgcacattaaatcatatggttcatttgagagtgcggtagggatggtatttccaaagaaaaataatattagtgcctgtgcttaggggctctcacaccgattgcacaaattgtatgaattgcacaatttctacagactgcatttttcttcttggcacaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggtaaaagcaacaggctggggctattcttgggggaatgagagttcaccttgcagccttggggagagcaggtgccactactgtccttaatgccacaaccgatttctctagagaccaagatttttagaggttttagctgaagtcatgtgttgatggatgcaaagcttttcagaacccctctgctgggtacctctacttccttgtactttgaaatgcagacacatcagaaagtaagaggttcctgtgggataccgctaaagaaggtgccagatgtagccgggcgcggtggctcacgcctgtaatcccagcactttgggaggccaaggcgggtggatcacctaaggtcaggagtttgagaccagactggccaacagggtgaaacctcgtctctactaaaaatacaaaaaattagccaggtgtcttgacgggcgcctgtaatcccagctactcaggaggctgaggcaggacaatcgcttgaaccagggaggcagaggttgcagtgagctgagggtgccaccactgcactccagcctgggaaacaagagcaaaactctgtctcagggaaaaaaaaaaaaaaaaggtgccagatgtttaaagttacctcaccctactgtcattttcttttcttaatgtcattccacctgggtttgaaggagctgtgatggcgttctgtccacataatgacagaagatccgtggtgggatcacagacatgcaaagggccaagttggaagagaccttcagaatagtggagtccacttgcattgcatatggagagaaactgaggccctaggttcaggggggagggaacaagtacaaaaatcacagagcaacaatgcaggataagtaactacttgctgcccttcctccctctcctagcactcatcctgccactcatctggagtcaaggtaagaagaggaattcaggccgggtgcggtggctcacgcctgtaatcccagcactttgggaggccgaggcgggcggatcacgaggtcaggagatcgagaccatcctggctaacacagtgaaaccccatctccactaaaaaaaaatagcagagcgtggtagcgggtgcctgtagtcccagctactggggaggctgaggcaggaaaatggcatgaacccgggaggcggagcttgcagtgagccgagatctcgccactgcactccagcctgggcgacagagcgagactccgtctcaaaaaaaaaaaaaaaaaaaaaattcattgctaaccaaggcttacatttattgagaggacacatcagacagtcatttagtactcctgatatccccaagcagtggtgaatgttatttattcccatttaccaggttgacagactgagtatcagaaagattaaagtcacttgtacagaatcaccagggcataattgggtttccagctctagaatccctacatttatctttaaaagttttccctagggacacattccaggcatcttcatgagtgaaattagagctgtctgatagcgtatgagccttcgtaaatctcccagtcactgaatctcagaacttgctgcagctcaaggctctgatggtccagcgactgcacatggctctcagggtgcacctgctgccacccccaggcctccttgacccaaatgaggcacacgtcctctatttctttgagagacagcctcagcccatcaaaaagccattgccccttccgtggagacaggtttggactctatcagagcaaactaatttgacttaacatggccttctctctgctctcaattaccgagtaaagatctgatattcatttacattattatgctctcggggacacagaaagcagtttcaaaggccaagtaaagggcacacatccatgaggggaacagtccttagcagaagtcatcacagaacatcttgtctctgccattccgttttaaactcaagtcctccttccctaccctgagcaaggttcttctccaaggatgctagtttttcagctatacaatgcaacacctccaacgatgcaaatgcatggtgggctttggaaccaaacaagaccccccaaagctcagttctgccctgtaactagccattggaccctaggcaagtgatacagtctcaccaagcccctgtgtcctcagttggaaaacaggggtaagaataccaactacctaaagtaacgctgtggatttcatgagaatatgagagattcctggaatagagcatggcaccccatggatgcagtaaatgccaggttactttggaatttttggacctttgggaaatctatcccaactttttctccttctgccacctacactctgccatccctttctgtggagttgctacagtaacgccacctgggtatacagaattccaggccctccaccccattcattgtctctatcaaaatgtacccatcttcctggccaggcacagtggctcatgcccataatcccagttctttgggaggctgaggcaggaggatcacttgaggccaggagtttgagaccagcctgggcaacatagtgagtccccacctctacaagaaatacaaaataaaaaattagctgggtgtagtgacatgcacctgtaatcctagctacttgggaggctgaagcaggaagatcacttgaacccaggagctggaggctgcagtgagctatgattgcaccactgcacactagcctgagtgacaaagtgagaccctgcctccagaaaaagaaaaaccttacccatcctttgtcccattcatcaactctgacctatgtttgcttccagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccctgaacgcatgcgacacactgatatatatgcatcctacaaatgtgcacccacatcaacattcaagaaccttgaatttattccctttttaccaaggcgaagctagcatatgtgtgcccacatttaggtagcaaatgctgcctttatttaaattcccactagcatagactccatatcctaccccaaatttgtctccatccccaggacccctctggtgtagccaatcatagctcccacccgtgggagggaattcccatttggatcacagttgtgttagtgtttgctagggctgctgtgacaaagtaccatagctggagggttgaagtccagattcaaggtcagctgggtaaattccttctgagagctgtgagggcctctctccgtagctggtagatggctgtcttctccctgtgtctcctcagttcatcttctgttcatgtctgtatccagatttccccattttatattggatagggtctgccctaatgaccttattttaacttggttaccctgtaaataccctacctttaaattaagtcactttatgaagtactgcgggttagaacttcaacattttttgagtggggctggggaagtgggcacacgattcaacccataataactggtaaggtcactccaaaaagaggagctctcatctctgatcatcctcactagagactctgggtagaagtgaggcaagggaggaggatggggcaggagggaaattcactggagacctcaccgtctctggagaccttcctgcctctctgatggagcacgttggtggaacagtggaccctgttgtctctgatgcagacacagtctcccacttattgaatccaccatccacctcttgccattcacaggagggctctgggtcactggagagtgctgggacacacggggaaaggggccaggacctctgcggagtcagaagccctggcaaagaggaggcaccacccaaaagctcgccaacacttaggtgtggggtgggaatgggagaagacccaggctcttgcacgaggttctcccaaagctttctgcagtgaaatccatcaagtcatggagtcttagccaagtcacttcccttgctgggtctcagttttctcatctcagtaatgggaacaacagttactaaactctaataaaacctgggaaagggaaagtatagcatactgtattagtttgctagagatgctgtaacaaaattccaccgcctgggtggcctaaacaacagaaatttatttcctcatgtttctggaggcaggaagtctgaaatcaaggtgtcagcaggggtggtttttcctaaggcctctgtccttggcttgtagatagtcgctttcttgctgtgtcttcacatggtctttcttctgtgtggctgcacctctggcgtctctctgtgtccacatttttctcttataagaacagcagtcatattgaaacaaggcctatcctgatggcctgattttaatcaccctgttttttttttttttttttttgagatgggagtttcactcttgtggcccaggctggagtgcagtggtgtgatctcagttcactgcaacctctgcctcccgggttcaagcaattctcttgcctcagcctcctgagtagctgggattacagacatgcaccaccaggcccagctaattttgcatttttttagtagagacagtgtttctccatgttggtcaggctggtcttgaactcccgacctcaggtgatccacctgccttggcctcccaaagtgctgggattttaatcacccttttaaaggtcccgtctccaaacactgtcacattgtaaggtatggggggttagaacttttaacacatgagttttaggggttcacaattcagcctgtaacacacaatgcaaaaggaagtggtgatttaattattattatcacttaatctattaatttattattcatacagaataattttcatacagaatgaatattattatacagaataatttactattcatacaggatacatatgtcccaagctcccagcttggtccacaaacagaggtaattcgggaagtcaggaagagattatcaatgccggagggaacagactcacattgccttcctggcattgatgtttcctgggcattttagagcctggaacctttgagtttccatgcacttcttctcttcatgtgccagtaatattatttattcagtccgtattttctgagtaccttctaagtgcctggcaccgttccccacacccaagctctagtgagcaggcagagtcaccctgcctttcttcagggaatatcttagctggggagacagacaataagcaagaaaatgaatatactgtcaggagcaagctgtactatgaagaaaaataaagatgaaattatcttgtgagttccgtgttaaaaatttataatacgtttattttatgaagcacgtttttataaaagaagaaatcagtcattattcttcaatgatgtgtaagggatgcatccaaaaaggttaatttcaagtaataacagcaaagtcttcctcattatgcagcagtaaacagaaatcctgaagatgctcattaaaagtcaattcaacatgctacaagttgacaaccatccccatgcctctcaaatcccccaacccaacacagcctggagcagaaggtacttactcaacttcatcctctttcttttcttttctttctttctctttttctctctttctctctctccctctttttctctctgtatctttttctttctttttctgtctctccttccttcctttctttttctcttcctcccttccttctttctttctttcctttctttttctcttcctcccttccttctttctttctttcctttctttttctcttcctcccttccttccttctttcctttctttctttccttccttccttccttctttcttctctttttctttttttggatggggttttgctcttgtcacccaggttggagtgaaatgtgtgatcttggctctctgcaacctctgcctcctgggttcaagcaggtctcctgccttagccttcgtagtagctgggattacaggcgcccgccaccatgcttggctaatttttgtatttttagtagagacgaggtttcaccatgtaggccaggctttgagcctctttcctacaagatgactccagaaattatgcagtgggccctgatgtcacataggcagtgtgctcacccttagcacccggcgtagtaagcgtcatccaagtctgtgacactaccacttctgctacctgggatatcaacatggcctggcccctggcctgggctttgccacttagccccaggtcaaagagtctctctctgtgtgacctcacagatgtcactgctttctgacctctccttcactcatttggaaaataggtctaaactagtaccagcttcccagcatccttgtaaggaatcaagagctcatgaatcagcccattgattggcagatagcctgcagtaaatggtggcatcattgttctttggtctcagaactgctccctgatgcctctgtggctccaaccatatggctgtgccctgctatggcgtccctgctgatgtaaccaaaattatttcaaaggtgaggatgttggtggtcatgaatccatgtggattaaatgctctcctgcaaatgtttcctcttgcttttataccctgaggccatttttaacagggcgcccatgtcttgaaagaaccctagaccataaggactagatgaaagcctcaaggtaattttacaggtggggaaaatgagtctcagagaagaaagtgagttttccaaaggcactcaatagcaaagctgagtttagaactcaacatttattcattcaacaaatagcacctcatgtcctgagcacggttgcaggcactgtagaaaaagctaagaatgggataggcaaaggccctgtcttcgtgaagcttatggtttactgtgggggacgggtaatatacttggaaatacatacattggccatgtccctaccacctgatgtcccaccagtagtccagaagctacaggtcatccttctgtgtctgcatgatattttgccaaacaccaggggtttggcctaagtccagttgctcatatcgcagaccatgagtattgccagggaagaaaatctttattatggaaatgaacaattatcaaaatactaactgcagtagcaaataacaagcccaagagtgtccaaaccaaaacagtcagggtgccttctactctcaagccagtcaactgggcttgtccaaactgcaacaaatggaaatttctttggaattcccccagattgagaggagagactcctgctgtcagggacccatagagagcactcacctgtctggatgcagatgtcagatttcaaagcctgttcttcctaggcaatcaggaatgcaattggggctggcagtggtgatgcagaagagaaggagactgaaacccatctctggccaaatatgcctgggaagctgctaggagggcttctgaaatgctcctgatccatggccactgagccgtaagcaatgaattcctgatcggagaaccagaattttgttggcaaactccaggggtttgacctaggtctggctgctcaccacacagaaagccaatcattgagacaacaaatgttgctccagaagaaaagctgtattggaggtgacgtcagcctaactgtcaaacctctccctcctcaaccaactaaagttaggggtttgtaaagcagggaaggagaacaggagcagcaagaaagaggagttggtcaacaggcagcaggtgtgtctcattgtctgggtgcagcaatctggaaagcctcagctttctgataccatccaggaggctcaaaggtcaatttcctgagaaaggaactcagataagccaaatgtacgtttctcaagtttcagaggccctctccaggccaacacagacccaaccctgtttcaaggcccctggctctctgcagagttcaaggatggggagttaaggctctgcattctttcccactcccaaagattgtacataggaagcagaggagaggggagactgttgttgcagctagaagaggcaggtgtcaaaggatgttggatgcagccgtagaaggctctggttgtgattaatggcctggccaagctcctgctgctgtcttcagaaggtgatggacagttcacactggactcccactccctggacctggttgcttatttagctgtcaatataggcagctcccttcagagcatagtgacagatgttagcagctctggtgacaaggtgacacagtgaccctgtcaccctttgttaagaatcatcatagctcccattcctgtgtgtctgtgaggagataggcactgtgcttggtgatattcaaacatcacttctaagagacagtggttgggatccactgtcctatccatgtgttctatatgtgcaaggagaaatataaaatgactcaaaatgctcctttgtaaatagctgcatgaaggcccagtagtcttattctgggctcggtgggaaaatcattctcatagttcaggcctacagcttgtaggattcactggaatggcttatttaatcctctttccatctcccatctcctagagtctaaagtttatggtcttcctgcttaggcttgctgcaaagggtaggggaagacatggctgcatttaccaaaagcccttggtcttcccttgatcctcagcttatgcataaagaggttctgcagcaaaaggtggaaggacattggaggatgcagtcccttaaagcacagtggcctcacccttggtaaagtgagtcagtgtctgtggctgatggtgatcaattaaagagcaattttcattgttcagcgagtgaggagagagaacgtaacaaggggtcaagttaatgacttttccccataccagccattgagactcaggacagaagcacagacaagtggagctgggatttgaactctgggctctatctccaaatacaggcattcttggtactaacaccatgggctaaacttgcagtgtagatcgtgctttcctataaggtcagctggctgaacgggcctatggatcacatcacttcacctgtgccatctcctggctaaacaaacctgggcctgcctgctccatctgggaggcaacggggaccagtgtctaggactaggcttgggtttactcctggctttgccatcttttaagctgtgtaacctcaagtggtttgttaaatccctctaattcttggtttcttctcgagtaataaggggtgggagaggagaccctatctttagagcctgtctggccagcaggagcatcaggacaaggattattatgcccattttacagatggggcagctgaggctcagcaaggccaagtgactggcctgagttagcagtgcagaagctgggattagagttcagagctcctgactcttcattcagtgctcttcctaagacagtcactctgaccccgagtcccaggcctggttgtccggccagtacagggaacatttgaaagagttccaaagatttccctgcactagcacaggcaggcggtgctccaatctgggcctaacacagcactgagccctaggaggcattcatccctattgttcacttcaatctcaagcgacctacctcaaaaatggggtggggtaagaggattgttccataggtgcccagcctgttctcccttctcccatgtttgagggaacccaatttttggcatcaaaggcctctagaagagtttaaatgtgtcctttcctaataaagagaagtactggaaattattcttgctgctggtgtttcactgggtgtctcatttagggctatgtgggcatcatggctcatggtccatggactaataccccatacctgtgcatggaagtcccaggagtgggtttggagggcatggatggggacaggcaagagtgttccttgtggctgaggagcaaacactgctggcagggcccagctggtacaagtacattacactggccccatcattattttatatgcagaaacaggaccagagaaggagcatctattgcctaaagtcacacagtaatttggaagcagacttcaacctagtgttttccctctaattcctgctgccttccacagctggagagaaatgatttgaggataattcagtctttgggtcaattgtaaataactagggtgcactaaagaatcctgacagcacctccaagttctggtctcaaagatttaggtctacattctttctttctctgcaatcctgagtggcccaaattctgttcaatgtggtgctaagctcaccataggcgagctgtatgggtgggcaaggtatgtagcctctctgtgcctctgtttcctgctgtaaagtcaggacaacgatgatattggatccatctcatgagccttctcaggttctcttggtatcataactcctggaatctcaattgcttcctgattcacagccattgctatggcaacatactccatgcccatggagtcccaccacctgaagccaaagtccagggtctctggctcctcctaccacatgcatattatgaagaggatctcctggcagggtgcactttaagcgctgggaaacaggagatttgagggagctgtagttacactctctctccactcctcctcctgttggattacaccacgaaattttcctatgtggtctaactggggacagaccacattagccaaccaactactgtaaccagcttggtaatgcgtgactgaccttgtatcttatctttcctgcctcatttccttctccccttagtctctctgccctgagactgtaccttccaagggcatatgagcatttaaaacttgccccaggtgcattttctagggagcctgcatcaagactaaagccaaggcaaagggtattgagaatttgcatgaaaaagcactttgaattggtcctagcactttgtaagcacccataaatgtgagctgctgtcattattattgtggctgttaatatctcttggagtctgatattcgaggtaaagaagcatcaagcaagggagaaagatgaagcctggaagactgagtaaatctgcttttccatcttctcctgcctgctctgttcttggtgctctggcagctgattagatggtgcccagccagccagattgaggatgggtctttctctcccagtccactgactcaaatgttaatctcctttggcaacactctcacagacactatagatgttactatacctggctcttccgtgatgtggtctctacctgtcttgcctgcctctgccctggatgctgctccaatcctagcatgatctttctcccttctgggctttcttgcatgcttttatctccacctggaacactcatttattcattcatatgctcactcatgcccaagtattttttgagcatccactcaaaagaccatccactggtcttaaaggcttacactagtctcacctgccttttcaccttgtcaattgccctcctccctccagatgtcagccttccttgacttccaggtggggctgggaatgctgccacagcctcctacacacctgtgcctccctctgtttttaggtttttttgtttttgtttttgttttagttatatatgtatatataatttcaatagtttgggggtacaggtggtttcaggttacatggataagttcgttagtggtgatttctgagattttagtgtacctgtcacctgagcagtgtacactgtacccaatatgcagtcttttatccctcactcccctcccaaccttccccctcaaccctgagtccccaaagtccatatatcactcttcttttcaaggcaggctctcactgtattgcccaggctggagtacagtgccatgatctcaactcattgcagcctcgacctcccgggctcaggtgattctcctacctcagcctcctgagtggctgggactacaggtgcatgataccaactctggctaattttttatactttttttgtagagatgggtttctgccacgttgccgagactggcattatatcactcttactgtttatgcatcctcatagcttagctcccacttataaatgagaacatataatatttggttttccatttctgagttacttcacttagaataatggcctctagctccatctgagttgctgcaagacattattccattcttttttatggctgagtagtattccatggtataaagataacattttctttatccattcgctggtccatgtccgcccttaggtttgcagctctctatttacttggggctctctctacacagctgtggggtccagggcccaattcatggttgatgctaaggaaatttatccataaaacacctactaggtgtcaggctttatctggcaccagagataaagcagtaaataaaacagacagataattcacgttctcctgcaatttacatgatagttgggggtgggagcaaatggtaaacaagaggagtaagtgaactatacaagatattaggacgctgaaagcctggaggaggaaaataaagctgtagaagggactagaaggcattggaagtggtgcagcgagcattttagatagagtgggcaggagaaggcctccttgggaaatatatttaagtaaagatctgaagaaagtgaagcaaccagccttgtcttgaacttggggaagagcattctaggcagagggaacagtcaatgcaaaggccctgaggtaggagcatgagtggcgggtttgagcacctttaaggaggctagtatggttggagtagggtgatcgagtgggtgaggaatggtggacaagatcagagaggtgatgagggtcagatgatgtagggccttgtaggactttgtaaaaatgttggctttaactgagagtaaggatgggagccatttagggtgaccaatcatctcactttgcccaggactgagggagctcttgggacacagaactttcggtgctaaaacagggaaagtcctgagcaaactaggatgaggtttgacctaggtcctagagc

SEQ ID NO: 327 - DNA, 329443 bp, Homo sapiens
tttaatatttaaatgcagtatttaaaatataatattcttccttgaatatcaggaagctggggaaaaaatctgaagcacagttaagcatgttgatcacactgatcaaaatgctggtgctcttcaatatctagttccttgatttttttctcctgtttatattttcttcttaacaatatcattgaatgtaatatctatcttgcttcttcaaattctctctgaagaggggcaaaatatgaatacgaataacttccattataattgaaacttgtgccagaaatgtcagttatgatcctaccttctcaaagctccttaaaaggggggcaagtttaggcaaccaccttgggttttaagtggccttatccactatgcaaaaagatttttcttttcttttttaaaaatcagactagggatggaatccagattccaaagtagccaagcattcagtttataagattacttaacatgaaaagcttttccagaatagagaccagtttgaccaatcagaatctcatttccaggaattaaattgtggaccaatgagaatatcaagcagttggcagtaaaagctgaaattaaaagcagtcacacagaaaagcctgcagagacttcaggtggggtacatgtgagctgaggttataagtaaacaggagtattaggagcagaaattataaagaagcaaggagctattggaatagaaaagatatagaaaggtgaggaactaagtgtatataaggcagggccatatataaggttgagtaggtattccttacacagggaatctggctcggggggagtagggaaggaaatccagtgtgtgctgcttgatccaaattgtgcccacccaggcatggctgtgccagccagaggaagatgaactcagtagtgctggccacaggcattgaaggaaaaaagactgattcagaatgaagcaaaaaatctaaaaaagtgaagtcccataaatgctacacagacctatgctggtgaggtccctagatgttccccagttgctgaatgaccttccagttccatactccttgagacctggaccttctgtgattcagagacttctcatgaggcctagatgtttggcttcatcccatgggaactggctgcctgtgagccttggctgagacttctgttttccttattcttaagtatatgcttaaaataaatcacagaaatgtttattgtgagttagcccttccatagagtctacctaaaacaaacatcaatgtcaaatggtttgcctgccactcagcctcaattttccttcataatgctttggaataatatgctgatgtgaacaacctcccttctgtgcttacagtagtttccagttgctggtgtaacaaaattaccacaaactaagtgacttacaacaacacatctatttacttctagatctatagatcagaagactgacacaagtttcaccgggctaaacttaagctgttggaaggactgcatttcttctagaggcactagggaagaatgtttcatttcattttccagcagctagaggcagtctgcatttctttgctcttggcctgctttcctcacgttccaagtcaatcatcacatcacaccaaactctcctccccagcatcagatctccttctctagttctgactctctagctttcctctttcattcacaagacccttgtgattacatcggcctacctggataatctggaataatccccccataatcaagattcttaatttaatcacatctgccaagtcctttttggtgtgtaaggtaatatattcacaagttccagggattaggatgtggacatttttgaaggactattctgcctaccacaaagataaagtaaaggcccttgcctaatggaccactttttcaaactcgttcatgggaatgaacaattcatctcctttctataaataaaaatatccagaacaataagagagaacaaacaactacacataaatgtaccttctattggttgtcctcagtggaactagagactcctaggtttgagattattttttctcccacattatttttaatgaaaaactttaaacatacagaaaagttggaagaattatacactaaacaccttcataccaaatgtgtatattctataaacattttgctctttttgctttgtcactcagctatctagctatctatccttctattcaccaattgattcatatttctgatacatttcaaagtaaattgcagatatccatatacctcacccctaaataattcagtgtacatattagtaactatagttcaatattggtttatgatgcttttttgagatttatatagaatgaaatgcacaacccataatatttgagatatccatgcacctgtgcaaaccaaacccctaccaaaatacagaacattgttattgcccagaaagtttcttcatgtaccttctcagtctatccctgcccacactcacttccagaagcaatgactattccgatgtttctttactaccataaatgtgggttgttgagttttgaaattactgtatttatatcaagaatcggtagaatgaggtcctaacactcaattaccaatttggttctggtttgcttctgtagcttgttgcttctctgttgcactgacaacatttcctgtggccatttgctaatcagatgtcacctgggacattctgccggaaactacatgaataaaaattatttgacgcaaaaagacaaaaacataaaacaatagtagtttaaagtttaattaactgatatggaccaaaaaaagagtatgagcctatctgcagggtttttttggggggtaaaacagaggaagaaaaaaactaccatcactaaggtttaaaatctggttttctcaattacaccctgagttcttattcaacatacaagttaatcctgtgtggctgagaacacagttggagaagttagcaaaatatactttggagtcagataaggttgtattttaggtttagtagctgctgattttggtatttcatgtaatctttcagagaccgcttctatatccataaaatggagaagataatatgtatttcttagtttgagaatttgagataaaaatatcaagcacctggcaaaatatctagctcattgtggtactcaatacattgttgatattaacattctactacatcatattacatcatagtagtatcggtatcatattattgtgcttattaaaattaatttggccaatggagaaagaaaaacaaatttttaaacccaggaaattctggacaactcagttctaatttgttttcgttcaagaaagttttttgttaaattgggaccacgaagtaattttcaaagtctctggactataaatgtgaaaagaaagactaaaatttcaagagggtgacataggaggaaaaaaggctaacatttgctggttgatttcctgcaggttctcccaggtcctagagttatttttctggacaagtatttttgttctctaggaaatggcaaggaacaaagccatagattaaattatctaagaaaaacttgctaaaggaaatgtgatgttctaattatgaggtctgatgatctggagagcttaagttgtaatgttcaaacctgggcttcctttctcttcatttatttttaggagaaaaacaaatcaacccttaggaaggagaatccatgacaaacatcagttgcattacctaatcaggggtccagtccaaacgattggtttcctaccatttttagcaaaagatctgcatcccagtctcagtgctataaccaaataactatggaatcaaagaagtctctcagattttcccaccagtttccattcctgtcaaaaggaatagtttttgcactgaaaactatcatttgcatcaatttatagatagcagatcttttttgataccctataccacataccctcaggccacctctgtgcaccctaatggcatcccacctcaagaccaagctgtctctttccacgttttcatcccaggtcacagtcatcaaatgacccagactgcaggtgtttagttggacaattctggaaggcatcctattcttggaagtcctatgagaatcaagttctagtgcctgtagtggtgaccttgctgcatccttacctgaacttgtctttctttcctatctcactctccttgttttctcactttcactttctaggattacctcccaagtaaactatctatactgaatttttgtctcagtctctgctttaggtatgacccaacagaagacaatatatttttctccctatctattctgctggcaccctggtccatgtcaccattatctcttccttagaatattgcaatgacctctcaacagatttgcttctttgacctcaaattgattctctacacagcattcaaaatgacctttaagtcatatcatatcactgttctgcttaaaacccttaatggtttccttctacacctagaagaaaacccaaatttcttgccacggcctataaaatttttgatgttctagtcccaacccaaacctccaactttacctcgtactgctctccatctctgactgtgttcccactataaccttcttttttccatgaacataccaaaactatttacacttcagtgcctttatgcttcctcttattcctttgcctagaatcctcatcttccaaatatttgaatggtaagttcttgacatgactggctctttcacaattttcacatcccagctaaaacttctccaattcagagaggactctccaaccaccttaagttaagcactcatcaatcctatgaatttcctccatgtatcttataatgacacacattattttatttgtgtttacttgttgattttttgtctcttctcaccaggacaaacatttgctaagggcaaagatctcatttttcaccacaccctccagcacactgtttgacacaataaatgtcttacgagtaaaaaattaaaaccctaaaagaaaacctaggcaataccattcaggacataggcatgggcaaggacttcacatctaaaacaccaaaagcaatggcaacaaaagccaaaattgacaaatgggatctaattaaactaaagagcttctgcacagcaaaggaaactaccatcagagtgaataggcaacctacagaatgggagaaaatttttgcaacctactcatctaacaaagggctaatatccagaatctacaatgaactcaaacaaatttacaagaaaaaaacaaacaaccccatcaaaaagtggacaaaggatatgaacagacacttctcaaaagaagacatttatgcagtcaaaaaacatacgaaaaagtgctcatcatcactggccatcagagaaatgctaatcaaaaccacaatgagataccatctctcacaccagttagaatggcgatcattaaaaagtcaggaaacaacaggtgctggagaggatgtggagaaataggaacacttttacatggttggtgggagtgtaaactagttcaaccattgtggagggcagtgtggcgattcctcagggatctagaacaagaaataccattcgacccagccatcccattactgggtatatacccaaaggattataaatcatgctgctataaagacacatgcacatgtatgtttattgtggcactattcacaatagcaaagacttggaaccaatccaaatgtccaacaacaacagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacactgcatgttctcacttataggtgggaattgaacagtgagaacatatggacacaggaaggggaacatcacacaccggggactgttgtgaggtggggggagaggggagggatagcattcggagatatacctaatgctaaatgacgagttaatgggtgcagcacaccaacatggcacatgtatacatatgtaacaaacctgcacattgtgcacatataccctaaaccttaaagtataataataataaaatataattaaaaaaagaaattggaatataaaatttacaaaagggcctggtgctgtggcttatgcctgtaatcccagcaccttagggggccaagatgaaaggatagaggtttatttgaggccaggagttcaagaccaacctgggaaacatagagagactctatcccttcaaaaaaaaatgtaaaaagaaattatccaggtgtgatggtgtgcacctgtagtcctagctactcaagagactgaggaggaaggattctttatgtccaggagttggaggcttcagtgagctatgattgtaccactgcactccagcctaagtgatggagccagactctgtctcttaaaaaaaaaaaaaaaaggaaattccctctcctaaataaacaaaaaacataaacacaaaagcattccctctcctaaataaagatatgattttaaaacaatattttatataataaatctaaattaaaatgttccattttcaatcatgctagcaatagtacgataattctttgtaaataggtatgaatctgcacagcaatttggtaatatgtatcaacaataataaaaaatgttcacaccctttgacatagtcatatgtattacatttaaaaatttattgtaaggaaatgatataaataaatacatggaaaatgtctatgcaaaaggaagtttactgaggctatatttgcatagtgcgtattgagagaagacaaataaattatactatattcacttgtataaatagggattaaaaacaatgattatgtaagcaaagtagcagcatgcaaaaataaccatgctataaaattaaattgaaaaggatacaaaaatgcatgtgtatgattgcaaatttttttaaatatgaaaaataaaatacataaatatagtaacaaagaagtgattggatttaaattgctttttaaagtttattttctaaatgttttgtgtttttttactaccataataaaaataaatatctgctctgcttatctgaaaaggttgttgtaaaagtaaaattacagttgattcattcattcttcaaacattcagatcctgacatatgccaaaaacatttaaatcctgcaggtttaataaggccatatttgtctttaaaaccatacattgaggaggcagagagagatgaatacagctaattgcaaggcaaagtaggaagtggtaagtactgcaagggacaaacaaaatacaatacctttctctcagttatccatctgtatgagaaatcgatgatttctagttccccataataggatttggttgttttcaatgtgctgttagcgtcgcaagctgtattagagtactctgttacgtgccaccaagttcagaagaccaatgcagatgtttttagtcaggtggctcttttgatgcctcttccctaagcaatgacttaggcatcaagcgctttccaattgatgatgctgacatcttccaagttctcctgagaaaggtaccataactaggggaaggtatgccagatacacaaccacttttgcctaaaatgctatatcaatccatttcaattactagaatgagtcacttgctcccatgcctaaagcaagggtctggaaactgtagtgcccaactgactagccaattcccagcacaactactctacgccatggaagggtaggggccacttccatggcaggcagcgagtataggagccaatgtgagagtgaactcaagttcaagtctctgctgtcaaaaaaaaatcaaggcatacataaggaaagactttattctaaagaattattacaagagcaagcaatggggttatagctgtagggagaaggcactgaccatgagatctgcaagtatttcgaagttaagcagaaaagggctttcctttaatagggaagagtgaacaatgttagaaagaaccagtgaagggaagtggcaacaggttgaatgggtgatgagacagtagacaagagcatgtttacactgaggccagcctactctcaggaggggctgtttagggagggttagatgctggctcaggttgagggtgggctgaagttcaagatccttgaggaaggagagaaactcagttcacttaagcattttgttctgattgatcagtggggacaaaactattcagctaaccatttatgaggtaaagagtgggaatttggaggacctatgtccggccttaatctcagataaacatggggcatccatgagtcttacctaagtcctatgaaaaaggttggcttttttttttttttttcagtaagccactttctgaaatacaaaatgttaggaggacttcttaataattgctgttttccaggatcctagggctcaggtcaaatttaacattgtcactgctctcttaatttcagtcttagttcgttcaggttaccataacaaaataccataggtcaggtggcttataaacagtagaaatttgtttctcacagttctggagactggaacgtccaagatcagggtgctgacagatttgttgtctgatgagggtctggttcctgtcttattgttgcatcctgacatagaggaaagagtaagggacctctctgaggcctctcttatgaggttactaatcccattaatgagggttctatccttatgaactaatcacctcctaaagtctcacctttgaatactctcacattgggagttagattcaacatatgaattgtgagggacacattcagacaataacactagtaggtacttttgtggccaaaaacttctaaattttcaccaaattaattgtgtctttctcctggatataaactagtttacatttcccagctataagacaaattgtagacaatggaatgtgagtggaagtgatatgtgccatttctaggactggcccataaagtcttctcatatgtgagcatttatcctttctctccaagccaggaagcttggaagccacttgttaaagatggcagagccacaggatggaaagatccaaagtctttaaatccccacagtgcctgcttatcagaaacacttatcgagactttacatacatgagaaataagtttcaattccgttaagccactgagattatgttttgtttgttttgttttgttgttatagaagctaacattccttaatctttcaaaagcctgaaaggttttggtttaaatatttgccaaaaacttcttagcatcacatccggtccatagcaagccctcaataaatgttagctatcattataaatatcattctatattaggacagaaggcttgcctgaagaaatggcatttgagttatgccttgacatacttgcaggaattcaactggcaagaggtctaagggacagcatttcaaatgggatttatgatgtagagagaagaaaaagttcaggaaatgagactggtccagtgtcactgggcagctgggaagctagagagaaccaatggaggatatgataggaaagttgattgctgcccaatactggagagtcttgaattaaaactgaggcttgactgacattcaagcataaggaaaaaaagtattaatatgcatattaaggatcctgagtgatttttccaactttttttctaaatgaaacaaaacaaaacaaaaaaacaaagaaacctactgactttctgaaaatcactgacttcaggaagaaagcttagactgtcccaaagtccaataaatgatggtgaagcaggtaggggaaatgataatagtgaaagcactttatcttaagaaactaaggcactattagcagcagcagcttggacaatggctttttattttgatcccagaattctttgagaatgatggaaactaaggatccctttgtttaaacaaacaaaaaaacaaagcacatataaatactaagtcctcagagtccatctgggccccaggttagggacctctaagtcagaagattttaaaagaagagaagaaaggcaacctggattatgctcagtgaggtgtctggctgaaacctgacaactgaatatgtccttctatcccatggtggcaaaggcatcatgccgctggcaagctaacacgctgatggtgacaggaaaagcatgactttgctgcaaggaccatggtgtgatttccagcactacgatccacagcacagcattgggcaagttaatgtaatgatcaaattaagtttcttcatctgtaaaataaagttgttaatatctgcagaagacatatataaaattgccttctaaaattctaaatagttaattcctatataaattaatgcagcttatttgttcaataatgcagagttttctactttgctccctcagaggctaaattattacctctgtttctcattccctgaatgaagtatgtattgagtgactaacctgagccaaatgatgccctaggtgctggggatacaatggcaatggagacactctcagccctcaagagcaccacatgctagtgttttgttctcctctgaatttaatcctatcttctcaggttaggttctcccagaaacataccctgaaacaagaattcaagtgtaagcagtttatttgggaggtacaggaaatatcagtaagggaggggagtggcataacagaggaagaaaggcagcaaatacatgatgcattatcattacagctaccactgtagacagactggagctccatcccatgagaaacctctgggaaactgtaaaacacacatttcaggttaatcccacctgagcaccaagggagctgaggtttttatacacagctttcccgaggtgttaattcccagcactcctagcctatcttgccaagagaccttctccagcttctgtgaaagcccttggagggagagatgtagatgttgacagttagaattcaactgaagattattaaagtagaaagacccaagggatataaagagagaacaggcagcatctgccctatgtcctaaaatagtgaatcccttactccttagctttgggtggtttcagactttcctgagcctcatctgaattggtaaaggagatccttagctagaagactagcctagggaaactgcaggctccattccaatgatcatctgttatagaggttctgcaaacattttccttcacaaagtccatggagttgtttaatccacaaggttttgtgcataggagaaagcatgaaaggaagagacaaaccacaaatatgatagccattatgtatgaagcccttattaagagtcaagtgttaggttaattgctttatgtgctctattatccttcaacaacactacaagttaggtcttactatttccatgatgaagcaaagaaactaaggtttaaaaggattacatgaaggactaggatttgaacctagtcagttataatacatagaagacattcttaagtatcatgttaggttgtgctgtgttggaagaagtaagtttgggtctctcaataagccatgttcttctcctatggtgctagtgaagaaatacaggctgtcctcctatggatgtcaattttaggaaaacaaagatatgaaatccaggaacaacaaagagtcctggatctgcaaaatgtgaaggaacaccagggctccttcttacagtagacagttctccaggaagaaggcctttctgttcaaacctggcccctacttcttcagtttcaacaacccagacatctcaggagcctggaacattcttctgctagccaggaaggggtaagtaaaccagtagtgttatctgcattcctaggaaaggacgagtgccaagtaatgtttttttaaaggtagccatttgcctcagcaagcccagcatcatccagcaaagtctaattccttcttattcacctttcttcctccctccactcctcaggtgaatgcctaataagtattcctcccaggctgagttaaggcacccattacaggcccttcccataatccaaaggggattggcattttcctcaaacaaatagaaggggggcagtaataggtattgagaaccacctatgagccaagccttttcgtatcagcttcatattgtcttatcctctctgtgcaacagtccaatgaggttctattattcccatttttcagatgaggcagatgagcttttgctgaacatgaaagtttgagtttgcttgttccttgaagtttttctaagacttctcacaaaatatccattcaagaaggccatgaatatagctgtgaagaccactccctctaggccagtaaagaactctctggcttttggggaaaagaaataagaatggacaatattccagataaaaacataaacctcataaactccttctgtggatgaaagtagctcagagattgaagtcctggctgtgtaactttctaggttaattgctttgattttaggcaggcacatttaggtagtttcatctgagtgtctcccttagagagagtgtgtgcttatattgttaatcaacttcgtattacgttagagcctcatctaatttccttaagaacatgcagtgagaagatagtagcagaggggagcctggggagattgtgccccatgaggagtcctaaatggtgctttctatgagcctagaatacaaagagaaactggggagtcctccttgctccctagaggctccctgcctcttcccaggaacagcattaagactcatgtcccacagtggtagaaagggcagcctagtttcagatgattgctcacagcagccacttcccttcaataaactctgctgcaaatgcatacatctttgatgcctcactaccacctgacactgaaatgaaaaatgtgtccctctcttgcttcctgccttttatttccggatagaaatatataagacccttttgttgcctatcagagtgcctaatacataattaatgcccagtatcagacagatggataaatggttggattaaggaatgcatgacattttttaaatgaatgagtgaatgaaaaactaagctctcttcaaaacaggcataaagcactgagtcaaagactgtatcctatgttctctctgcatcaaggaatggcccacagatgtttctagattatttcagttggctgaacaaattcagaatggcaatacttgtcatgattcaggcagcattgtgaaactagattaaacagactgagctataaaggaaaatgtcagtctacatagagggaaggtctcagatgtttgcttatgactctcataccgtgaagtaattgattatggtttctctgtcattttttcctaactcacttgcccacataaaccccttccaataattcctgggaactctaaaagtaaggaatcagcatgctaattaagttagataaccatcaaattcataagaaatacatttacagactggcttttccaagaccatcattctaaatagtggcacatagcagtttggtacaaaaaatccaccaaaccatgatcccaaagatttgggttacatgctaccattcattcctttttgtaccttggagtctaaaagttttaatacttccaagtcctaaaaaggctaaggttttctcaccatagtgttgccagaaagaaaagcaaccttctgttgctcttggcttcaaatttatagtatgtcacagctgaaagagaccttagagatgatccaatctagcatctagattgttgctagttaatacaaaaactgttttgccttcttccttttctttgcagaatagaaggctcatgtttccccacatctcaaagaaaggtttgagaattaagcctgtactaaccgctgagaacagaacaagttgttgagttataatggtcctgggcctgagttaaataagttatcaagctttattgggcaaggaggaggaaggtcctaagcaagttttcatagcaggataggtcagctatataggaagagcctggcaagtggaactcatcaagttcactgcattgtccaaatgcccaggaactacctaggaaccgatctgtcatccccaactaccaagcttccacatagtggtgaatattttatcacccaggtcgaggggcctttgccaactgtgcctccccatgaacacccactgaggacttaactttgtcagtatgcgtcacttccacaaagatttgtgatcaggagtgacatgtgatatcacatacaacagtcggcttctgataacttcctgcagacacccctcaaaacacagcaagaacctgggaaccccaaagaaggggaggaaccctacaattggaggggctgaaatgaaaatcttaagactgtgagagatgtgaaaagtgtttcttcagtaatattttactttagatatgagaaaatgaaaattcacagagggtttgtgatttttcccagtcacagaataagtaaagacagagccaaatctagaatccaagttgcctgggttcgtggtcagacatgaataatatgcctacaattgctataacttatagtgcctatcctaaaatatttttaataagcacaacctaaaaaggtcaggataggcaacctcaaaatttgttgaagtgaattcctgattgacagactccctgcaatcatttgactctctcacatggaaccctagacaaacctttcccttcaccctctccagcagccagatttcttgggtctcttggtctttagtcttaaactccacgaacagatccagcctgcttctcctattatctccctgaggtggtgacacctgcttatttgtaaatctgaaatagggacctgcatttcaaaggccatccttacccaaacagggagccccctctcctcttaggcacttttgtattttgtgatgtctgctccttttcctatttttttttttcttcttgatgggtctgaattgtttgctctaatttctcctccaggtagcctcattcttggtctttccaagaacatgatcctttctttcatcccttatctttaattttctgatatgggtttggtaactgctctctcctttggtaactatcaattaacaaaataataccattcattcacagatcttctcatggcaaaaaaaaaaacaaaaaaaaaaacatgcagagaagagccctcaggagtcaaaggccaaaccagcaccttttttctaagcttggtagatggacaggagtacaggccagtaataaacttcggtcattgtagttaatgtcatggatcttccctacttgaagggcaggtggttgatgtttttctagtactcctggcagagctatattgaacttcctatgttctttttctctaagatctttataaaaccaagaacatattgtggcagggtagcaaagatcatagagtatggtcatagagaagagtggcctcactgttccagaaagggaacaaacctatggctttggaaggcaaagaaagttgacatttactgtgaatctagattctgtactaagtgtcatcacctgcgttgttttattctcacagcgacctatagtaggggtggtattattcccaccctcattcttttcagattcataaacagaagatcaaaaaaaaagtttatgtatccactcaatatattcatattgaagtatccttgatggggcaggcattagggatgcaataacgacacaacagccactgtcactctttcatgggttttgcagcctgttctctaccaagtaaacagacaagaaacaagccaaataaaaaataattacaaattatttctgcaaaaaaataaatatcatagagtcaaaataacctaagaatgcatggtttacaaacagtagagggatttttccaacccacatgtttctgacccagagcctgagttctgtccttctcagcatcttgttctttaatcgaagaaactgatttaagaatcaccaaattatacgttatcatgaaaataaggagaggatgggagatggtggaatatctgctttgacctaaaacctagcaggctatttaattataaggttttctgtatatgccagtgaaaaatccctgcaggttttagtttagtctacttttcctttctgtcactcaagtgtctgctgaggcaactcttcaaggtttaaaggaaatggactcaagacttgggtcacagatcttgtggaaagtggagcatcttctctgaaataaatgtctgctgttttttaaccttggtctcaatttcactttccctcctgtgactggtctactcacatctttttgttccaggtgtgcccagactgggaacttagtcccctttccttaattttactcgaaatctatcctatgatggtttgtatattgcacagaacttaagggccaatgctggctgtttacattgtgagagagatagggaggacaagggggagttaaaattggacattagattcctcagtccttagatgcctttgtgcttctgttagccactatgttcatcttatcctcccatcaaattgccagatttcccctctccttcacttctgtcctttcgcaaattcctgtttatatcttaggaaaaatattatgtaagggccttttccttcatcatacaattgccttcttagtcatttcccctaggcttcatgttcatcttctacatcttaagtgtcttatcagggcactagcctaaattgatattgttctttccctaagaaaaactttgctgccagctctttaaacaatgctatttttcaccctgctacacttgtttggacacccaaaatataccaccaaatgaaaaaaaagaatgcagcaacagaatttaaaatgactttgtatttaaagagtacaagaaaaggaaaaacaaagtcacagctgactcaacccaacattttgatactcaagcactgtgtaagtcagtgaaggaacctaattaaaagattgcctccttctcccagacaggtgtcaaagctcacaatcacattggagaaaaagcaaatggcaggacaaaggacattcacatcgccacaccttttcaccagtgtcatttcacccttgtccctggggagcagcagcagctgaaaacctgtccacagcctggcactgtcctctgagggccacttgagaagggaaagcagcaggcactgaagggcttctcagcatcatcccttcataaaaattgacttctcattgctcccccaattctttggatcaattgtgcagactgagctgcttagctgtggattttggcaacttattgcacgtttcacatcatccactgggcaaacacattaaccatctcttctgcttcagttcacctgataagttagcaggcatgtcatgtgtaaataagccaaggcataacctcagaaaggacaagagcctctcataacatgggtcattgaaaatactacttggctgcagctatctggctcaaattcagcattaaaagcctatgtctcattggatatctcattgccttgtggaacacagagaaattaactgggattcttaaatacatcacacatgtttccccaggtagttttgtaaagtgattaagaacacagaccctagaatcagactgcataggtaaggaccctatctttgccatataacgcctaaatgaccatagacaactgaactctacacactctattttctcttctgcaattacagtgtgaaattatagtagctacttcatagagttgtaatacacataccatacctagaaaagtggtacaagtactaataaatatgagtgattagcaaaacatgaataagcagattcccaccagctcaggaatagaagatctaaactccacataccagtttctaattgagctaatgtgagaccaaggtaggcagcagcatgcctggaacattcaaagcgacaagataaatgtaattcatcttcccaaaatatcagtttgactcctaagaagtaatttaaaggaatgaactcatctatctgtattagtatgtatagatctcaaaaaagtcatttttgggtgaaggcaagatacaaaattatgtataatataatatttatttttgaaacacaaaacactatatctgttttagttctggctgttataacagaataccacagactgacataaacagtaaaaatttatttctcacagttctaggggctgggagtctgaggtcaagttgccaacataatcaggctctggtgacttccctcttccaggttgtagaccctagttccttgaattctcacgtgggagaaatggggctgcagtgctctctaggtctcttttaaaagggcactaatgtcattaatcagggttccactctcatgacttaaattatctcccaaaggccctaccttctaatactatcattttgaaagttaggatttcaagacaagaatttggggatggggagctgggagacaacaaatgttaagtccataacagtatcttttcccagcacaaataaatgaatgcaaatctgtaaggaaaaaccacaagtaaatagtagtaattacttgtgggaagtcaagtgaagactgggattacagatggcagtcaagggagactgtaaccatatctatcatcttccaaaggtgttcaagctgggaggatagattggtaaatcacttgtataattaacttttttcttttcaaagtaatttaaaacattattttacattttggcatgtttctgcagtggctggtaccagttgttcctttccatgtttagtgcttcttccaggagctcttttagggcaggcctgatggtgacaaaatctctcagcatttgcttgtctgtaaagtattttatttctccttcacttatgaagcttagtttggctggctatgaaattctgggttgaaaattcttttctttaagaatgttgaatattggcccccactctcttttggcttgtagagtttctgccgagagatccgctgttagtctgatgggcttccctttgtgggtaacccgacctttctctctggctgcccttaacattttttccttcatttcaactttggtgaatctgacaattatgtgtcttggacttgctcttcttgaggagtatctttgtggcattctctgtatttcctgaatctgaatgttgacctgccttgctagattggggaagttctcctggataatatcctgctgagtgttttccaacttggttccattctccccgtcactttcaggtacaccaatcagacgtagatttggtcttatcacatagttccatatttcttggaggctttgttcgtttctttttattcttttttctctaaacttcccttttcccttcatttcattcatttcatcttccatcgctgataccctttcttccagttgatcgcatcggctcctgaggcttctgcattcttcgcgtagttctcgagccttggctttcagctccatcggctcctttaaggacttctccgcattggttattatagttatccattcgcctaatttttttttaaagtttttaacttctttgccattggtttgaatttcctcctgtagctttgagtagtttgatcatctgaagccttcttctctcaactcgtcaaggtcattctccatccagctttgttccattgctggtgaggagctgcattcctttggaagaaactgcatcaactaaggagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggattaattcaacaagaagagctaactatcctaaatatatatgcccccaatacaggagcacccagattcataaagcaaggccttaatgacctacaaggagacttagactcccacacaataatcatgggagactttaacaccccactgtcaacattagacagatcaacgagacagaaagttaacaaggatacccaggaattaaactcagctctgcaccaagcggacctaatagacatctacagaactctccaccccaaatcaacagaatatacatttttttcagcaccacatcaaacctattccaaaattgacaacatagttggaagtaaagcactcctcagcaaatgtaaaagaacagaaattataacaaactgtctctcagaccacactgcaatcaaactagaactcaggattaagaaactcactcaaaaccgctcaactacgtggaaactgaacaacctgctcctgaatgactactgggtacataaagaaatgaaggcagaaataaagatgttctttgaaaccaatgagaacaaagacacaacgtatcagaatctctgggacacattcaaagcagtgtgtagagggaaatttatagcactaaaaacccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaactaatgaatccaggagctggttttctaaaaagattaacaaaactgatagaccgctaagcaagattaataaagaagaaaagagagaagaatcaaatagatgcaataaaaaatgataaaggggatatcaccaccgatcccacagaaatgcaaactaccttcagagaatactacaaacacctctatgcaaataaactagaaaatctagaagaaatggataaattcctcgacacatataccctcccaagactaaaccaggaagaagttgactctctgaagagaccaataacaggctctgaaattgtggcaataatcaatagcttactaaccaaaaaaagtccaggaccagatggattcacagccaaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagctcatccaccatgatcaagtgggcttcatccctgggatgcaaggctggttcaacatacgcaaatcaataaatgtaatccagcatataaacagaaccaaagacaaaaaccacatgattatctcaaaagatgcagaaaaggcctttgacaaaattcaacaacgcttcatgctaaaaattctcaataaattaggtatcgatgggatgtatctcaaaataataagagctatctatgacaaatgatatgataagccagtatgataagccaaaatcatactgaatgggcaaaaactggaagcattccctttgaaaactggcacaagacagggatgccctctctcaccactcctattcaacatagtgttggaagttctggtgagggctattaggcaggagaaggaaataaagggtattcgattaggaaaagaggaagtcaaattgtccctgtttgcagatgacatgattgtatatttagaaaaccccagcgtctcagcccaaaatctccttaagctgataagcaacttcagcaaagtctcagaatacaaaatcaatgtacaaaaatcacaagcattcttatacaccaataatagacaaacagagagccaaatcatgagtgaactcccattcacaattgcttcaaagagaataaaatacgtaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttatagattcaatgccatccccatcaagctaccaatgacattcttcacagaaatggaaaaaactactttaaagttcatatggaaccaaaaaagagcctgcatcaccaagtcaatcctaagtcaaaagaacaaagctggaggcatcactctacctgacttcaaactatactacaaggctatagtaaccaaaacagcatggcactggtaccaaaacagagatacagaccaatggaacagaacagagccctcagaaataatatcacatatctacaaccatctgatctttgacaaacctgacaaaaacaagaaatggggaaaggattccctatttaataaatggtgctgggaaaactggctagccatatgtagaaagctgaaactggatcccttccttacaacttatacaaaaattaattcaagatggattaaagacttacatgttagacctaaaaccataaaaacgctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagattcaacaggcaacctacagaatgggagaaaatttttgcaacctactcatctgacaaagggttaatatccagaatctacaatgaactcaaacaaatgtacaagaaaaaaacaaacaaccccatcaaaaagtgggcaaaggatatgaacacacacttctcaaaagaagacatttatgcagcctaaaaacacatgaaaaaatgctcatcatcactagccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtgaaagtcagtgtggcgattcctcagggatctagaactagaaataccatttgacccagccatcccattactgggtatatacccaaaggattataaatcatgctgctataaagacacatgcacatgtatgcttattgtggcactattcacaatagcaaagacttggaaccaacccaaatgatagactggattaagaaaatgtggtacatatacatcatggaatactatgcagccataaaaagtgatgagttcatgtcctttgtagggacatggatgaatctggaaaccatcattctcagcaacctattgcaaggacaaaaaaccaaacactgcatgttctcactcataggtgggaactgaacaatgagaacacatggacacaggaaggggaacatcacactccgcggggactgttgtggggtagggggaacgggggagggatagcattaggagatacagctaatgctaaatgatgagttaatgggtgcagcacaccaacatggcacatgtacatatatctaacaaacctgcacattgtgcacatgtaccctaaaacttaaagtataataataataaaatttaaaaaaacaaacacattatttcacaacaagcatatacgttacctatacatacaaatagaaagtaaaatttgcataaattttcaaaataaaacataccttgaagaagttgttttatttggggggcaaattacatattagagcctcacaaaatatgcatttaccttgttttgttgttaaaggaattttgaaagaaaactttcagaagcaccatagtagctgaatgggatcctactccatttccttctaatttgattgttaacacatttatccacttacccaggccagaatgtcagctacccatttgtcatgctcagggttaggttctagccccagctgagagctgaggggaatgggtggatgggggtcagggaggtggaagaacacacaagagacagcaggtaaatgagacatggctttattcagcagagccttcacagggtcagtgttacatttgtacactacacaaaaactggtggctgagagccaggtggggagcttctctatgttgtgtgtacatggctatgattatctaagacatgggactgtgcgcttgcaccccaatcctgctgcgttatctatgctgtttaccttggcctatgcctgctgctctatgcctgcttcgctgcagcacagccatgttccttacaccatctcttcccattcccttcatatttaaccagtcttcaaggcctgcctcctaaatttctctagaacttgtcaaactcctcttaattctcacttatctaggtcattcttatctctcacctgaattactgcaaaagtctcaaaattggttcctttgcctccattttcatgggtttttttttcttttttttttgtagagacaggggtctcaaactcctgggctcaagcaatccacctgcatcagcctctcaaagtgttgggattataggcaagaggccccaggcccagcctttatgattctttttaacccactgacacagtgttacagtcatgacctttaaaatgtgaatatcatcaggcattctacagcttagaatttttggtggctcccagcatctataattcatttaagcaacttagcagcaaaagagattcatgacacaaaagggaggctaactgaccaccagaagttttgtcttcattagcatagagttttagcttgaagatagatgctattgtgtcaaaccctattaatctcaatagggaaaaccccaggatcaagaggtcaaagaagagaaccagagccaggaaacaagacatggggttctattaggggcttatatacaggagagtccagtggtggtgggtgtgacaggaaaactgcaaccactgaaaaacaacatgctgttgatagagcattttcatttgatactctcccattaattacttcgacctcgcaaccttcatttaacccaaaactcagggcctcaatcccctgtatcacccacgttctatgaaatgggctagggggaggggtctcagatggtcttcatagaaaaggaacaaatctcctgattgactataccaggattccctggctcagaacacacaccttcagaagtgtctgccatatagggccattctaagggtatgcttaagttattgctatcaggggtatttatagaagttcagaaggaaactgatttcttagatcacctggcatctagataagccagttgacaaagtctgatctgtggcaagcgagcaaatgtgatgggtgcttctgtgtttcacaggctcctccttgctttctttttccttcatcagctggatgcagatgatgaggtttgacagatggtagggccatgagatagaaaggacctggtctgtgaatcaccacagagaggcatctgccctgttgatcacatgcatgggaaataagctcctgttgtagttaagctattctagatttagggtctgttacagcagttgacctacactagctaatgcaaaggatatggttcctgctatctctcaattattcattattcccaaattcccactttacattaaaacgataccaaactatttgctttgctctgaaaataaacctccatttttttcctttttttttttaactgccagtgcacatttgttcatatgttttctactttctgaaatataaaaaatgtagtaagtattgtttatgggttagatatgctggttatgaaaatgcacctcacagacctccaactacagggacttccatctgcagggctccagctgttgcactcttaagcccacagtagggagctcgtgcttcctccgactgcccccattatttcagctaatactaatgaagaactgttagagacacagaaatcgtctgtcaattttgactgaaggactccttgatgccctgctgaaccttccttagctgcatggaagtctaggacttggccatccaatcccccttccctctctccttcactgagagtcagattcccatcacagtctcaagattcatccagtttcacccactttcttccctgtagtctcttaagtgatttcatcaaataagatccttgcatatttaattttatcttggtgcctgcttctcagagaaccccaatttgaacacaggatatagtgccaagcatgctgtacaaattaggtaatcctcgcaaagtcttctcagataagtactaatattttacaaatctctagactgaggtttggggatactgagtaactttcccatcatctcacattttcatcccccacccccattgcctggtaaattttcacattcaaatctcaacttgggggtcatacttcctacatttcttatcatagagagggttaaactacttttttttttctgtgcaaactcttctttgttgatcctgttttttcacatgactgtttcccctattagacctgtgaaccaccttgatgtgaggacttactcatttctgtatttgtagcaccagtgttagcacagatgcctagaataaacaataattagattcagttgaattgtgtttgatttagctgtgttgattctgaatgagataatatagctacgtgtgagaaaatgaatttttggtgggtagattgaactcaagaaacagggtataaaattgaaatttcaactaggcacctatgtttcaataaatgtgaaactacaaagcaagttgccaaattagcacttgaagaatttataaaagaattctgagaaatggttctataatttttggacctcttggccaaatcaaggagttagaatatggaagaaaaagacttgcaaagagatttctttacagaaaattgtttctctgctgtaagtctaccaccacctagggggaagggtatatagtactaatgcaatattttccagctgcagaattagatattccttcccctctccaccaagagaaatttagccagtgagaacacagttagctgccttagtggtgtgaagagaaggctgtgtgcttgggattcttagggctctcagagttcagtggggcaacggatgcatgaattcttcctgtgatcaagaataggatcaggtagtagaagagagacaaagcatagagtagtaagactttttccaatagggtctcctcaggggacagggtccccagtagcaagaatatggaggcaaattgacccattcctgagaagcactgaggaagcaatcccataaaattatctgtaatagagatgtatccatcccagtccaggtaactattaaaaagtagaacccagcagaaaattaaaaaaaaaaaaaaaaaaaaaaaaaaaaaaaaaaactccaatgagctaatgaaagtgtcacacaaaaaaagagttagtttcaaacatctcactagaggttagtggtttgagaccagcctgggcaaccctatctctacaaaaaacaaaaacaaacatacaaacaaacaaaaactaagagattagccaaacatagtgttgtatgcctgtagtcccagctacttgagaggttgatacagaaggatcatttgagcccaagagttcaaggctgcagtgagccatgattgtgccactgcactccagcttaagtaatgtaaaaagaccctgttaaaataaaataaataaaataaaataaaataaaataaaagtgcttgacccaagagcacaaagctagctgataaaggtgccagttcaagtaagaaccatcctgtcctctgaatctcctcccacctccttccttcctatttcacccctctccactagaatcccaagcagcagctggtgaggaaaaaggagaagcacctggctgagaaacatagattacgttaccaaaccacactttctcattcacagacttgctccctgaagcagaccaaagccagggtggggatggagagaagagcttttataagttcagttcagggaattgaatggtacctttgactgaacattttaatcactaaaagcaagcaaactgtgtttttacctgtctattaataaaagtgaacacaaaagtcaaaggcccgcctgagttttcatttgaaagagaaaattatttcccctgaataaattttttaaagttgatgggaaatgaaaataaatttgtactttgatgtgtgagcgtggcccttataagttctgcctgttccatatgccagtgtcatcactgtcaaaaccactgtgatcatcataattcagagtcagggtagactgcagacaaacagattttctagaatatggaaatccacaggcagaaataccattcaggctcacctaggcaagactctactttttctttcaaggtgaagtgctaatctttgtagtatcaagtatggttcaagaggctcaatattttttaatattctcttaagttggaccatataaaattttagtgcagaataatagctctcagagtgtgatctttagaccaacagcatcagcatcacctgggaagaggttaaaaaatgcaaattcttagttcacattttaaatttactaaattagaaattcagagtgggggcccagcagtctatgtttaacaagtcttgtaggtgatactgatggagctgaagtttgacagccacaggcgtagcatatcccagaatatagtactgacacaattccctgtattaaaagtcagaaattttacaaaattttagcttttttgttttaaatttaggcagcaatgggacaccacctgagctagtagacaattgtaccaaaatatagatgggtatcacgtggacactactaattgagcagaggaatgacagagcaataagtaatacaagaaattgtgctagcctcctttgacaagtgttttatgtatcaataagcagtaatggataggactaagcctagtacaaatgcatttcttacacaggacatgtaaatatcaggagcatgactattctgcatgagcaattgttttaaaaaaccttaattcctctttgagccccctccctttgtatgggagctctgttttcactccattaaatcttgcaactgcactcttctggtccgtgtttgttatggttcaagctgagctttcgcttgctctccaccactgctgtttgccgcagtcacagacccgccgctgacttccatccctccagatctggcagggtgtccgctgtgctcctgatccagcacaggcgcccattgcctctcccaattgggctaaaggcttgccattgttcctgcacagctaagtgcctgggttcatcctaatcgagctgaacactagtcactgggttccacggttctcttccatgacccatggcttctaatagagctataacactcactgcatggtccaagattccattccttggaatccgtgagaccaagaaccccaggtcagagaacacaaggcttgccaccatgttggaagcagcccaccaccattttggaagcagcccgccactatcttgggagctctgggagcaaggacccccaggtaacaatttggtgaccacgaagggacctgaatccgcaaccatgaagggatctccaaagcaattggaaatgttcctcccaaggcaaaaatgcccctaagatgtattctggagaattgggaccaatttgaccctcagacagtaagaaaaaaatgacttatattcttctgcagtaccgcctggccacgatatcctcttcaagggggagaaacctggcctcctgagggaagtataaattataacaccatcttacagctagacctgttttgtagaaaaggaggcaaatggagtgaagtgccatatttacaaactttcttttcattaaaagacaactcgcaattatgtaaacagtgtgatttgtgtcctacaggaagccctcagatctacctccctaccccggcatctccctgactccttccccaactaataaggacccacttcaacccaaacagtccaaaaggagatagacaaagcggtaaacaatgaaccaaagagtgccaatattccccgattatgccccctccagcagtgggaggaggagaattcagcccagccagagtgcatgtacctttttctctctcagacttaaagcaaactaaaatagacctaggtaaattctcagataaccctgatggctatattgatgttttacaagggttaggacaatcctttcatctgacatggagagatataatgttactgctaaatcagacactaaccccaaatgacaaaagtgctgccataactgcagcccaagagtttggcaatctctactatctcagtcaggtcaatgataggataacaacagaggaaagagaatgattccccacaggccagcaggcagttcccagtgtagaccctcattgggacacagaatcggaacatggagattggtgccatagacatttgctaacttgcatgctagaaggacaaaggaaaactaggaagaagcctatgaattactcaatgatgtccactataacacagggaaagaaagaaaatcctaccgcctttctggagagactaaaggaggcattgagaaagcatgcctctctgtcacctgactctattgaaggccaactagtcttaaaggataagtttatcactcagtcagctgcagacattagaaaaaaacttccaaagtccaccttaggcctggagcaaaacttagaaaccctattgaacttggcaacctgggttttttataatagagatcaggaggagcaggtagaacgggacaaataggatttaaaaaaaaaaaaaaaggatttaaaaaagtcatggccctcaggcaagcggactttggaggctctgggaaagagaaaagctgggcaaatcaaatgcctaatagggcttgcttccagtgcggtctacaaggatgctttaaaaaagattgtcctagtagaaataagccaccccctcatccatatcccttatgtcaagggaatcactggaaggcccactgccccagggaatgaaggtcctctgagtcagaagccactaaccagatgatccagcagcaggactgagggtgcccagggcaaacgccagcccatgccatcactctcacagaaccctaggtatgcttgaccattgaggaccaggaggttaactgtctcctggacactggcgcagccttctcagtcttattctcctgtcccagacaactagcctccagatctgtcactatctgaggggtcctaggacagccagtcactagatagttctcccagccactaagttgtgactggagaactttactcttttcacatgcttttctaattatgcctgaaagccccactcccttgttagggagagacattctagcaaaagcaggggccattatacacctgaacataggagaacacctgcttgttgtcccctgcttgaggaaggaattaatcctgaagtctgggcaacaggacaatatggatgagcaaagaatgcctgtcctgttcaagttaaacaagaggggctgggtgtggtggctcatgcctgtaatcccagcattttgggaggctgaggtggggggatcacgaggtcaggagatccagaccatcctggctaacgtggtgaaaccccgtctctactaaaaaatacaaaaaattagccaggcatggtggtgggcacctgtagtcccagctactcgggaggctgaggcaggagaatggcaggaacccgggaggcggagcttgcactgcactccagcctgggcgacagagggagactccgtctcaaaaaaaaaaaaaaaaaaaaaaaaattaaggattccacctcctttccctaccaaaagcagtacccccttagacctgaggcccaacaaggactccaaaagattaaggacctaaaagcccaaggcctagtaaaagcatgcagtagcccctgcaatactccaattttaggagtacagaaacacaacggacagtggagcttagtgcaagatctcaagattatcagtgaggccattgtccctctatacccagctgtacctaacccttatactctgctttcccaaataccagaggaagcagagtggtttacagtcctggaccttaagaatgcctttttcggcatccctgtacatcctgactctcaattcttgtttgcctttgaagatccttcgaacccaacatctcaactcacctggactgttttaccccaagggttcagggatagcctccatctatttggccaggcattagcccaagacttgagctggttctcatacttagacactcttgtcctttggtacgtgaatgaaatcacttttagctgtccgttcagaaaccttatgccatcaagccacccaaatgctcttaaatttccttgctacctgtggctacaaggttttcaaaccaaaggctcagctctgctcacagcaggttaaatacttagggctaaaattatccaaaggcaccagggccctcagtgaggaatgtatccagcctatactggcttatccttatcccaaaaccctaaagcaactaagagggttccttggcataacaggtttctgccgaatatggatccccaggtatggcaaaatagccagaccattatatacactaattaaggaaactcagaaagccaatacccatttagtaagatggacacctgaagcagaagcagctttccaggccctaaagaaggccctaactcatgccccattgttaagtttgccaacggggcaagacttttctttatatggcacagaaaaaacagaaatagctctaggagtccttacacaggtccgagggatgagattgcaacccatggcacacctgagtaaggaaattgatggagtggcaaagggttggcctcattgtttacgggtagtggtagcagtagcagtcttagtatctgaagcagttaaaataatacaaggaagagatcttactgtgtggacatctcatgatgtgaacagcatactcactgctaaaggagacttgtggctgtcagacaactatgaggaaattaactaaaatcataaatccccatggccctcccttatcatatttttctctttactattttcttaacccctttcactctcactgcaccccctccatgccactgtacgactagtaactccccttaccaagagcttctatggagaatgcagcttcccagaaatattaatgccccatcgtataggagtttatctaagggaaaccccaccttcaccgcccacacccacatgctccgcaactgctataactctgccactttttgcatgcatgcaaatactcattattggacagagaaaatgattaatcctagttgtcctggaggacttggagccactgtttgttggactgacttcatccatgtctgataggggtggagttcaagggcaggtatgtctgatggtggtggagttcaagatcaggcaagagaaaaacatgtaaaggaagtaatctcccagctgacccgggtacataatacccctagcccctacaaaggaacagatctctcaaaactacatgaaaccctctgtacccatactcgcctggtaagcctatttaatagcaccctcactgggctccatgtggtctcggcccaaaactctactaactgttggatgtgcctccccctgcactccaggtcatacatttcaatccctgtacctgaacaatggaacaacttcagcacagaaataaacaccacttccattttagtaggacctcttgtttccaatctggaaataacccatacctcaaacctcacctgtgtaaaatttagtaatactatagacacgaccaaatcccaatgcatcaggtgggtaactcctcccacacgaatagtctgcctacccttaggaatattttttgtctttggtagcttagcctatcgttgtctgaatggcttttcagaacctatgtgcttcctctcattcttagtgccccctatgaccatttacactgaacaatatttatacaattatgtcatacctaagccccacaacaaaacagtactcattcttccttttgttatcagagcaggagtgctaggtgggctaagtactggcattggcggtatcacaacctctactcagttctactacaaactatctcaagaactaaagggtgacatggaacaggtcaccgactccctggtcaccttgcaagatcaacttaattccctagcagcggtagtccttcaaaattgaagagctttagacttgctaaccactgaaagagggggaacctgttttttttttttaggggaagaatgctgttattatgttaatcaatccggagttaatcattccaagaaagttaatcaatctggagttaatcaatctgagaaagttaaagaaattggagatcaaatacaatgtagagcagagaagcttcaaaacactggaccctggggcctcctcagacaatggatgcgaaggatatgaacagacacttctcaaaaaaagacatttatgtggccaacaaacatatgagaaaaagcatatcatcactgatgattagagaaatgcaaatcaaaaccacagtgagataccatctcataccagtgagaatggcaatcattaaaaagtcaggaaacaacagaggcagaagaggatgtggagaaataggaatgcttttacactgttagtgggagtgtaaattagttcaaccattgtggaagacattgtggttttttttcaaggatctacaaccagaaataccatttgacccagcaatcccattactggctatatacccaaaggattataaatcattctgctataaagacacatgcacacgtatgtttattgcggcactatttacaatagcaaagacttggaaccaacccaaatgcccatcagtgatagactggataaagaaaatgtggcacatatacactatggaatactatgcagccatagggatgagttcatgtcctttgcagggacatgaatgaagctggaaaccatcattctcagcaaactaacacaagaacagaaaaccaaacaccgcatgttctcacttatatgaataatgagaacacatggacacaggcaggggaatatcaaacactggggcctgttggggggtaacagggggctgggggagatagcattaggagaaatacctaatgtagatgacaggttgatgggtgccgcaaaccaccatggcacgtgtatacctatataaaaaatcttcatgttctgcatgtatatcccagaacttaaagtataattttaaaaaaagaaaagaaagaaagaaagaaagaaagaaagaaagaaagaaagaaagaaagaaagaaagaaagaaagaaaaagactctaagaatatcaaaatgccccaaccacatgaagctacactccaaagccagagagttgcaagctactagaggctagctcaggctttcaacaggggcccatattagggatttatttatgttaccttatttaatctccatgacagtgagtttgatatcattctcattacactttgaatgataaaattaaagcctggagaggttaatccacttgctcctgtcacacattaaaagagctgtgattcaaacccaggttagttcgagtataaaagttcatactattcccagtatgttatgctgattcccttgtataaagacacgtataaattatgcaaaatttcagaaacagatgaccttctttttttaccattagtatgaatgactgcttattataaatattaatatcactttaagtttcctccattggctttattgtcatgaaaaatgtgttccccttactgccagaaaactcttcatctatgtgagactagattagtcatttcacaatttttagtcactaccttcatgtgtgccatcttcatgacttttgctttttcaaagttggcagctacaacggattgccattattacctgccacaaataaaacacattcatagaaatataaattaaacaattacattagatcctagctagatgatgttctctctcattttggtgaaaatagagattaacaagcattccagaagtggtacaaaaaaaaaaaaaaaactaatatcaatctgaaacttcctgcttaacataaccagggaacaccatttaggaggtaatgttatttaatgtcttatccaggtactaactaaaatcatatcatatgccactgaagatcatttcctgtagtctccagtggtagttctaccatactttaggaaataaccaaaatattttcatgactttctggtcctacaatttcattaaaaaaatttctacttatgccttcaacaacccaccttttacataaattaatgatattcaggcagcactcagcaatgtgtgggtgtgtcataaatagtggtagtggattaataatacatacttcaccctcatttgaaggtacactaatgatcagaatacgagaaagcaagttgtccaatttgcttgtaactttaacagttccctgaaactgagtatgtctccagtgactaggaacaaaccctgaaaaaaaatctgcctgtcaaaacagaatgcaactcacatcagctcaaaatattgggaggaaattgacctggctattctctaccaagtaaaatgcactatcaattcacatctagagtttatctgtgattgccttccaaatgttcctttctgcctcccagaaatattttatttatatcaaagagttaagggagacaattcctcgggagaaagaaaaggctatgcagaaaaagaatgaccatatctgcttgtattctgcttgctttcctcaaaccacgaacattaagacaatgaatgatatattggagaaactgatgacaaagtcagtgtacttcataagagtccttaagaactgttctctgctgactggcttcactacagttaggcaaaagctcccagatatgcaaatactggtggttttcaagtaaaaatgtcccttctattaatatttccaattaccctcctgggaaatttcatctgaaaaattcattagatacaatttgcacctccataaattttgttctctttcatggccttgagagttagtggagagcaagcatgaatgatttagcaaagcaagtgaccaaatatcatgcttagttttaagtcatagctgaagatactatgcgaaggaaccagaagatactagcagaaaggtcaaggagaaaatccttgaaagggagtccctcatatctagtgtaactgtatgtcatccaaactggaataaatttataaaatgaagagggactgtattggttagatattgccatgtgagaaaccatccaaaaattcaatggcttaagggaagagttatgcattatttcttgagtctttgcataggctgggagttgactgacataagctgacattggcaggagtagctctgctccatgtgtttctaatccccctcctaaaaccaacagactggcctgggtatatctgctgtatagctacagcagggattcaaaagtgcaaaccctattgcaggcaggctttttaaagcctctgcttgaatcagttctgctaatatcccaatctcctaaagcaagtcacatggctgaattcagaatggaggagcagagaaatacactcgccttctcagtgggcagaactgcaaaaccacacgccaaagaacatggattgcactgatggccccagttcctcatagagagaagtcctggcaccatgaatacaatccacctcaggctacaattcataaactaactcatcctatatgacctgcctcacagagtccctgctgaagaaacattatagtagccaaagatccctcagctgaagtttcccatttcaaaagccagaaaatgagtcatagtgattctggccttggcaaggtaagatccagcccccgcaaaatacctgcaagtacaactaccttcagtaaatgtgagttttatgtagaatttgatgggggctgcagtcactggccaatatttacatatatgtcagaagaaaaaagacattgatggaagtaccccctatatggcaacgctcccatattgtatcattttaaatctgtgtggaaatccttcaagatgttcagctccccattttatgaggctggtgcaaaagtaattgcagtttttgccattacttttaaagagacatggctgatacatatggctaaatgagatatggctaaataagatggagattggttgagtattttactcatatattcatacctagtaactagaaacaggaaaaagctcaaatctacttgtctgaaaagactctcatacctccattttattacactgtcttaacctgactggaagattatgtctctaaaaaacatacttaaagaaccagattatcaaacacctatagtttcttctctggaagatacaatcccaactagtgctatttctgagagacagttctttttcaatgaggagcacacttttatttaggacatattttgagtattatttacattttatcagcaaggcactttaagcacatatctctaaatatgtttaagtgtgattttaatttaaacttttcacaggataataatccaagtaatagaaaaattaaaattaaaaataagttaatttcacatatttctgtgtgtttatttaaagcatagatatataagaatatatagtcatatttaatatagattatacattatatatatgttatatttgtgttattatagagtatagcttacagattataacacctaaaaccttttattatagttgcactgattattaaataattacctaaatatcttaacataatacctggaacatagtaagtattaagttatagctatatatggaaagtgcctgcttatcacataagaagcccttcctttaagcctcattttggagattaaaattcaactagctgatttattcatcccagatcaatacatttcaagaggctaccctcttgacccagaatttcaaatgatcttgctctcatttagtattgtaacgaaccaaaagaacctctggagaagcagcttttaatcatgcagatgaactgagaaacataaagtagatctcatgccactcctcacttgaaattcatagacaatgccatggaatataatgcagatgctgattaggcagactttgccctttggctgaacccccaaaggcctgtaagaggataatactttccacacaatttttgcaccaaatttttttctttctttctttcttttttatttatttatttatttattttgagacagaatttcattcttgttgcccaggctggagtgcaatggcatgatcttagctcactgcaacctccacttcccaggttcaagcaattctcctagctcagcctcgagtagcagggattacaggcatgcaccaccacacccagctaattttgtattttttttttttagtagagatggagtttctccatgttggtcaggctggtctcaaactcccgacctcaggtgatccgcatgcctcagcctcccaaagtgctggcattacaggtgtgagccaccacacccagctgcatcaaatttcttcttggccccctcttccttctgttcctatatgtgagtatgccatctttgcactatcctaatgacagtcatcaacttcaaggcaaaatatgtactcctgtctctgccttacatatatacgcacttatcgcaagcatttcttgagtatatgagactttactgaaaatttgagaatcacaaggaacatgttccagttatccattgctatgttaaaaataaaaaaggtctacctgaaataaatcacccccaaaatttagtgctgtaaaaccattgcaatcatttatttctattattgttatgactattataacacctcctggtcagcaggttgactgaggctgggctcagctgggtggttcccactcagtctctctcaagcagttacagaggctggggctggagtcacaaaggcttcctcacttatgtgtctggtgcctgggctgggaagactcaaatagttggggaccagacagctggatctcctcagggcatatgtcattctctttatggtttatccacaggatcttttctaagcatctgtgcttcaggatggccaaacttcatacatggcagctcagagtccccacacaagcatcctgagggagagctgggcagaagccatattgcctgttctaacctagcctaggagtcagctccaccacattgttacttgtcaaggaagtcacagtgtcacagtcagttttaaggagaagagacaggctatctcctcctgatgggggaatagcaaagttttgaaagagaatgtgggacaggacacctgtttgtgattatttttggaaaatgcaatttgctacaaagggataatctcatgaagtatcttattatcttattggcttctctcttcccttgcctccctgtcctacctccttactgccttcttcacgtattcccttcaagctccaaatttttctccctctactatgaagagtagttcagttgtcccccagatcctatttccattgctagacaaaacaaagggactccatttcccagaaacctgacctactatcattagaaagtaaggttttagtttgttccttacacagatttgaaagaaaataataatcgtgtccactctctgcagaactgcagagactagcatgagagaaaatgaagagaatatcaaaagactagacaatggccaatgagaaaaacgtgtggaaaggacccctcaggcttggattactcacagcatcactttatgatctatttgaagatggaggaattccattgtttcagcatagagtaagtgattagtcaacaagataagaatgtcagaccgagaaaattccacagaaaaacaaaattgtgtacctgctccaagaacatcaaaactcttcggaaatagttccctgcttcatacttccattctgtctcctgcatctccaggttacataaatgaaaaaaaaagtgatcatagtaatttttctgaagatgactgttgcattaaaattgttctgatacaatagtcccctccacaaagtattctgggaaaaatagttttcctgaggggacatgtttgagacacagctgtaccagcttagatcacattatgcagcatgtagttataaatctaattaatatgacttaaataattaaggttttcttccctcatataagtctaaagattgacagaacaaaatcattacaagggtcttacaatttcataaaaggttctgttttcctctatcttttcaagaccaccaactttagcgcctggctttcaagtatgtggttgcaatatagctactgctccttcagtcatcacattgacattccaggtcagaaaaagggggaagcaccaaaagccttctccttgtgaagtcttgtctttgtatgaaaaaggggaagttcccctcagtgacatctgcctatataatattaagccaaagcttttcacatggctacaacaaatcaagcaatattttagcttttcaaccacttcagtagaggaagataaagaatgggggctgttaataatgcttagttacaaaacttttgtaactaaagtgtctacacttaactgctttgtaactacagtgtctgccacagtagcagaccaggagtaatgagtgctggcttctatctaatcctctgacctaactaaacatctaactaaggggaagccctttaattctcaggattccagttttcccatgcaaaaaaaaggtgggggaggaacaaaaaggaataataacatagaagatctctcatgttctataattatttacatccaggatatctttaaggcagcatgatgaggcagacactgtacgttacttacccaggcatccctcactgtcttcctcactggcagtggccaactcccactgtaaaacctggtggggttttctgaatctctcttccagctagagtatgaccatgtggccaaaacttggccaagaagacccaagggaatgaatgccctgggatattttctgagaaagattttgcaacaggctataacatgataagtgaaaagtcttttggatccctcttctaccctctcccttcatccaattattcttgtcttcagactcagctgtatgcattatagcagccattttgtatcaatgaggcaataaagccaaaacattgaaaataatgaaatggaagagtgaaaatgaattttagtcattgataaaatcaatcatgagaacaccttttcctgacttcatgttacaggaaacaataatagtcctattttcgtatgctattcctgtttgatgctattacttgcagcccaaaacatcacacataatacaatgatctagtagaaacaattatagcttcaaaattagcgtatgtctcacactttaggtgaatatgaatctgcacaagcgagacttgttaaaatgtaaatttctgatgtggtatgtctggcatggggtctaacattttgcatttctatcagtctgttcaacgtatgatctgcatctataccttgaacagcaaggttctaacctatatttggccattgtatgacattgatcaaattgcatcactcctccagactcaattttctcatggaatcctgtatcttatgcttctaagtactatcacagggatataagttcagttcttccataaaagaagatatatatgaaaagtgaattgaggggggatagatactgtaatttattttaagcctcctgccaaatagtcattcatcttttctcttgatacaaactgtatccaggaccaggggcacacagtctagtgcttgtctccatgactatccaactgccccacctatacagaaatatcacaggaaaagaatgtcaaacttagctacatttgcagatgctccattatacttactatgtataatgtgtgtgctaatcagaaattcatttaataaatatttgaaaagatttagagtaatccatcctcttccccaccccatactctttcaatgagaataaagaatgaatgtgtgtgtgtgtgtgtgtgtgtgtgtgtgtgtgtgtgtgtgtgtgtgttttaaataacaaaaaagccatctgtctgcaagatgggattacagatgcctgccaccacccccagctaatttttgtatttttagtagagatggagttttaccatgttggccaggctggtctcgaactcctgacctcaggtaatccacccgcctcagcctcccaaagtgctaggattacaggcatgagccaccatacctggccccactcaagtattttgcattctgaaattcataaggtaagacaccaagggcagtgctgattacaagaaagacaagaagaaagattatagagttaatacgattgctcaatcttctgagaaacatctctcagccttcaatgtttagtaccctacatcaggccagagagctgattttaaaaactggttcctcctcagactcaggaagaggctgctgtgtttctctgtggagttagggctgtatttctcagtcactacatttctcggtaacaggtaactatttctgttaatgaagaggagaacaagttaccatttaaaaaaaaaaaagccctgcataaattgcaggagcattaattactatggcccttaggctcccaggaatttatgcagactttccatggtgattattgtgattatgtggtatttaactgtatatttagttctctacagatattgcagacatttttcagctcttctagaggagtttttaatcaaaatgagttaacatactcttcttcattctaaattaaactcaatatggttatgtgcatctcaaatgcatgatcacatccttgaacttttcaatgagaatttttcacagataacttgtcctcattgtcagtatctggaaaatcttgtgggatcatctgttctaggttgtgactttcagtattaggctagtctggtgaggaaatgccaaagtgcccagtctagatccttccacatcactgggctggaataattagaagctagtgccagattcttggggactcccattatttttgataaaacatacagaaatactttgttggtcaagtaaaagagcagctattcaagattgttcctgacaagtttgggagccaagggaatctcatgtttagggctttggtgtccctactatctcttcaaaatggaaatatggcttgcctaagccaacagggaagtagagtgcaatggttaatactgagcatcaacttgattggattgaagaatgcaaagtattgaccctgggtatatctgtgagggtgttgccaaaggagattaacatttgagtcagtaggctgggaaaggcagacccacccttaatctggatgggcaccatctaatcagctgccaatgccacaagaatgtaaagcaggcagaaaaacatgaaaaggctagactggcttagcctcccagcctacatctttctcccatggtggatgcttcctgccctcaaacatcggactccaagtttttcagctttgggacttggactggcttcctttctcctcggctggcagatggcctactgtgggactttgtgattgtgtgagttaatactatgtaataaactcccacatatattagttctgttcctctagagaaccttgactaatacacagggctaaatatagcaaattttggctttgattggaatatatttctttctctaccaactgggattctatagtagtagagactgagtgaatggcatgggaaagtaaagaactcatttttctaatgcatggccaaacccccaaaaatggccttgtctactcatcactagatcaggacccatcagcccaacaggtggtttagtttatcctttcagattaattatgttttaccaaaagagttcgaccacccttctaaatgatacagttcatgttcccatttcatccatgtcagaaaataaatagcatcctctataaggatcaaataatgtgaggtttaagccacaacggaaaatacttttcccctaaatctggaaaactcaatctgggaaaatcatattggtaataagaagttgactatacatcaaaggagagaatttaacataactttggtcaaacctaaaatttagagattttttggccataatcacatggcaaattggacaacctctacaaggtttcatatgtttgtccaatgctaggaagacctgaccttagctaaaacaactgggtcttaccctactcctgcaagtagctggatgcatgtatttcaagaagacataacctacctggtttttagaacagagtttattttcttagaatactccctcgtctcttccaacttcctcatctaaaaaacaatgaagcttcaacttcctcatctaaaaaacaaggtagttggactagatcaggtttctcaaccctggatgtatttgagttatgtggggagatttttttttaaatgtgatgcccaggtcttaacctagactaattaaatcagactctccaggcatggggttatttgtttaaagttccttcggtgatgctaatgttcagccacagctaagacccatgacaccaggtaattcctgaatgcacacctatatgaacattctgtcactttcagtttgatatcgtctgctacattcatcctctctgaacttttcctctgtcttgggaaagcagaattctaacatgaccctaaatgagttatgcccttgaagaaaacctctttgaatgaatactggctagcttctagtcaacagaccatggcaaaggtgatgaaatatcactcccatgatcatgccatgttacctacagcagactgaagtgagattttcttggctgctggcttgaaagaagcaaatcgctatgctgtgagtagatctctgttatgaactgaatgtttgtgtgcctccaacatttatatgttgaaatgtaatcatcaatgtgatagcattagcaggtggaatctttgggagacatttaggtcataactggaaccttcatgaatgagattagtgcctttataagaagaggccagagtactagcgcactctctcatgctagtgcaatgtgaggataaaactagaagttaaaagcctgcatccagaagaggacactcaccagaaccagaccaggtctcaggtctcccacttgtaaaatgggagaggtagaggcgtttccctccaattgtaaaattctatgatccttagctcttagcatggtgaaaacatcagtatgcagtatgcagttggaagttagtctaacctgagtttaaattctggctctactacttatccgtgtagatctttggccaaaatttattaatcttgctaagcttcagtttccccttctataaaactagaataataaaactcgccaatcttctagcatttgcgtgagttgattacatgagtcaatggatgtaatagtcttaataaacacaggacttaatgcatagtaatgactcaaaattggtaatggtgacggcttttgcttttgttacaagctctttacttgattcttttagagacaatttgtttatttttagcatccattatgattcttccaagaatagcattcagaaaacctgaaaggtctactaggcacattttgaaatgtggagttggaagagaattcaatcgtggtgtacaatgtcttcagaggagggcagtgtcctcttccagagccagcaggtagaggcaatctcctctaagtcctctccactattttcatgaagcaatcttcaacaagagggccaacactaagaaggccaacactaaaaggataaacatgacatgttgacaatgcattctcattagtttatatgggttaaagagcaaaaacatgaagattttgcccattctttaacttgttccttacatatttttcccttttgactattaaagctgttctttttcaggcactgttctgaactactttcagagcccagatgtagctctttagaagtcaaaagatgggaagaagcttgacagcctgaaaagtcttcaaaaattattgtgtttgaactgcatcctctggtaagaccagccaaaaccatactctttgctcaagcagagctgcaaaacataagttccaaagtttgcttttgagagcctcatactaaatgtagagaagagaactaactataaaactgagtcccatgagagactttctacttggctgagaagagcttccaagaaagatgcctaccaatcctcagaactcacatttatttggcaaggagtggactgcttttcagaagagaaataagaaattaaagtaagagatacttcctgttcatgaaaaataacagttctttaaaaaggagaaacaaagttattagtgaataatttaagaaaatactaaattatattgcaatatgaaagtgggaacataactaattcattaccagaaatttggtgtgagctaaaaacaaagagctttaaataaatctatggacaggagagccataggaaatcataagcttcaaattagagctattggaggtattcaaggagttgtcagaaatgccaagcacacctacccacaaaaggtcccttattgataccatcagaaaactaattcagtatgctttggtttctttgttgcattcttatttcttgcagacacaaaggaatgacagagaaggcagaattttttttttcaaaatctttatctaaagcatactaaactactgttagtaccatgatgtttatttgaggggcaatatgaatgaaatttgcctttgtggagtagttataatcactgcaagctttattattaaaataagaagcaaatgccccatgagagcaatgttcaaatatacaattagtccttgctcacacaaaatcgaacatgactgctggcctccagagatcttctctggttcactctgcggatgcaaagctgaaaatagagctgtctaaaagactaagaaggaagagattacatggaagaaggaaaggtgaaagcaactcagaaattgtgctcagtatggcttcttagctcctgctgtaggaagagctaagaaaaaaaaaaaagttttaggatttactgcatatactacaaatcccactgcagaggtctttccatacttggaaccaaaggcctagatccaaagaactgaatcatgcatgccgggtgcagaaagttgtgaaaaaatgtcttaggtgttcacaatatccttgtggcaattctgggaccaaatcaatacttttttctggtatttttctaggtctagtacttctccaagcaactggaaaattatgtattaaaccctagtcatgtcttgaatcaaaatggaatttaaagaacaacattctagggagaggaggaaatggagagttactaataaatcagagtaaagtttcagtcaagcaaaataagtaaactctggagatattctgtacaacattgtatctatagtcaacaataatgtattatacacttaaaatttggttaagagggtagatttcatgttaagtgttcttatcaaaataaaataatagtttttaaattaaaaaatatcattaagcattttccttcctagcctgcagaggactagagtataggaactgtggcttattcacattggatttccaccatccagtcaaatctgtgttcaacaaatgtacttggacattaattttctgcttccaaccaggtcaaataagagttgtccataattctcccataattcacaaaactgatagccaattggatgtagttttctagataaatgatactacatggaaattaaaatattttaaaatattttatgaatagtcacgtcacagattaagaagcaaaatgacaaatatacatataaaaactatttagcctcattgtaatcaaataaatagaaattaaaacattgagatagcatctttctttttatttttttttttgagacggagtctcgctgtgtcccccaggttggagtgcagtggcgcgatctcagctcactgcaaactccgcctcccgggttcacgccattctcctgcctcagcctccagagtagctgggactacaggcgcccgccaacatacccggctaattttttgtatttttagtagaaacggggtttcaccgtgttagccaagatggtctcgatctcctgaccttgtgatccgcccgtctcggcctcccaaagtgctaggattacaggcgtgagccaccacacctggccacatctttcttataaaaatggtaaaaataaaaatatcagtgatggtgaggatgatagaagatggtcatactcgtccacttctaagagtacaaagtgatccagtcttttgtggtggtggctggtggtgggggtaggcttggcaatatttactaaatgctttaaaaattcacatacccttttgattcaaaattctacttctatgaatgtatcctaggaaaatatttaagaatgtgcataagcattcggctttaagaatattcagcacagtattttttataatagtgaaaaaaaaacagaacttaaattttaaaaatcatgtcagttaaatgaatcactatctatacaatagaatgcgatttgccattgaaaattacactgaagttttttatagacataaagatatagttgcagcatatttgttatgaaaaagaaggttacagaaattgtgagtttgttttggtagatgtaaagtgtaagaggtaaaaatgtggagaggttttgatggtattcagtatttggggtcagaaaactcaggaatgcctggcttttgccctgctaagttttcctatttgttagcattcccaaggtggcttgcaccttgggtcccaagcaatccaaggaacaaatccaaatagtaaacagagtaccagtttattagttgggtcactgcctgaaatgtccataaagacagttaaaggtgaactgggagcctaagtgggacctctgccgcatcaccacagccaaaaccaaaaattctgtttagccatgcatacagagagaggagagttgggccctgccttattgatctcactgcatggaatgaggagagccaatgaaggtaaactacctgggagccaccttttaaatacagcaacctggcccagtgggaaacatgggcctatgaatgccatagaattttatcaatgaaatgagaagctttccttccctgggatggtagggtagtgcggagggagatatgctgcatacctgcggaatgaaaggcagacctggcaccataaggttcctttcctgctacattgtttcaataatcttctgctgcataacaagaagtccaaacctcagtgacttaaaacaacaatgacattatttctcacaattctgtgggtttactgtgctctaacgtgcagctctgccccctgtagtacagctgagattccacatgcatctgcattcagctaggagctcacctggtgtagagcctcctatggggcttctcattctccagggtctcactcatcattcaggacagttactgtaaattcgttatgcatggggactggctttaaagagggagagttctaagaaaacaaactctgctctaaatatgtacccaggatttgttttaatcagatatggtaaggcagacaaggaaatagctgccacaaaggaggaagttcataagcacagacctctagaaacaggaggcatggcctgatgtgctggtctaaagagggaagcactaaggtcagttaggaagcagaagtgggagaaggacgagaatgactgagaccctttgatggggttttcacgagaaggaatggaaggggcagggtaggcatgctgagtaagcttaagactagagagttttaatcatttcagagagctctgggctataggggtgcttgctagttgtctgatacctggccctggggtgatttaggatagaaggaatattggattggtgtgtgagagataaagaagatgattaggggtgtgggctctgggctacttggtttgtatatcaaaggtactctcacaggggagtcatttgctatttctacgaattagctagccctggaatggatgttccctccaggatcaagtacccaaatgccagagcatcaaatatacagaaaataagaaagtaaagtcaatacaaaccctgatatgcaagctcttgccatgcctctgcttgcataatgtttgctgggatcccattgataaaaataaatcacatgaccaaagcaagagacaaaatgggaaaggactaaacaagggcataaatatgggagatatagtctacccagggccatcaatgtaatggttactacataaatatttctgtataaaaggatatttgccaaggtcaacaaaggtcacttctagagtccagagctatttattttgttatttatcagattttcttattttcaacaaagaatatacactgcatatagaacaaagccaacattaattgacaaaacaaatattactatcttaaatcaggttctctacaagaacctaagatggggattcttatgcaggtgatttagtgcccccagaagaaaaccaaccataagagagtaagagaagcaggatagggcaggtgaagaagctgaatgagaaattcagtctcagcctgagcacaagaaactctgcagaatgagcagcaccatgagctgtctcatcttgaggaaatgggattgggcttttgtgccttatttcagtcagttatcagctgtggctactcctcgggaggagagcatacctttcagcatttcctagaaatataggtctcatggtagaggacaagtctctgtagaagggttcagctttcagccctgtcttagtccattcaggctgctataacaaaataccatagactgggtaaattttttaacaaaagaaattcattgctcacagttctgacgaccgggaagtcgaagataaacgtgccatcaggttctaggtttcttaagggcccattcctcatagacgacaccttcttgctgcatctgcacatggagtaaagggcaaacaagctccctcaggcttcttttatgaggatactactcccattcatgagggtggggccctcatgacctaatcacctcccaaaggtaccacttcttaatactactgcacttggtaattacatctcaacctataaattttgaggggacacaaacttcagaccacagcaagctcttatcgggtaatacctagagcagtgagaaggggagtgtaacactctatggggccagcagcatctactaaagctaccctcaatttttccaaagagtccatctctgtaatgtctcacatgagcacctccgacccccaccctatatactccaaatacgacctctaaacagaaaatagacagcaagtaatataagttggatgaatgaatgttcagtatgtactactcagaacttctccaactcttgaattcatatactgtggatcctcagtgacccacagatcctcagggataccatgaatttcgggtagggagtgggaatctagggagtgtcccaggacattatggataaaatagcactcttttctctttgagtagctctataaccctgatgataaggaaaggttggtaaactttcaaaaaaattctcctctggactaaaagcatgcatgagaaatttcaagggggaaggcctattttttctaatggttacaagtctaaattataaactcaagtcaataagatagacgtctaaaacttctaaaaatagtggtggataataagaatgctttctcaaccaaaaccacaaccttccctctgctgcacttacagaaagcagcagaaactaatctttctccccaagtggaaaaaatgggtaatagaattctaccagatgccttggattttgtgcactgatgatgtatttccatcaatctcatttatttttgtctgaagtcttattttcaggccaaccattccattcaaatattgaatcaggccatatctaccaagatgctatcagggagaaaaaaaagaaaatgtcttttattagcagacacacttattttctattttttaccatcaatgatgacaagtcttggctgaaggaggtatgataatggctcatggaatcttaagtaagcaatctgatagaggttcttggaaacatggagaagtctggaggtttcttaggtgaactgcagacaggacagggaagggcttcatcgaaaggactctagctttattaagtggaaagatagacaattttttttaaatgagacgaagtttctggcactgacatgatccaagtgacatggggtgagaggtcaaagttctgcctatccagctttttctcagaccctactgccttcaacaattagcctacatgactgggtcatgtagctgatttaagtaactgaggccagaaagggagaaaatgggagaggggcacaaagctatacggctagctagagagagaaaactagttcagaagtgcaatggtctttctaaattattgctcaaccattgattaaatactattttatttttttcaatccagatgacacattttagacatttttaggattttttaaaataacaaatccacagaacaaaaaaaaaaggaaaatttttagcagattatatttcttgtttgggatttggacattttgcaaccctcaatttccccatggaagatttgcatggaggcacacgtgtagaaaagtagttttctgtttctaagcttcaatttcaattctctgtcaatatcgagccccctcctcatgctttctcttctcccctttccctctttccatccatcctcctctctcctccttttctcacacttccataaagtatttgacagatcagtctatttcccttctcacaggggctcaccataggccatctggttgtgtgactaccagggaaaagcttgtgacgtctctaggtgactccacagaatagcaacagtcttttgaagatgccagctgcccttcctctttcatggaagttacaaaaagatagctccacatgctgacacttcctcccactgagaagctggctttggaagaggcactagctcagcaggggtcctctaatgttggcctgaaaactgactccaccaggcaggaggcaaggatgtgataatatttgtagtccctcccggggggctcccaccctgggtgttgccaatcttccaactggcaggcctctgcagctgccaatggacaggaagaagaaaatattctagagtccatttcacaactagaagttttaagccagttctagttacttcgcttagaagacattaggtgaaatcacatgaaattgccaatatttgactggttagcctgcaaaaatggtcaaacctaatctcatatggttcaatctaatctatcctgtatgatctgtctgaatgacaaagaagtcatggaagaaaaataaaatatttagagggcctttattcatcatagtgactgcatcagtcccatgttcaaaaatattcagttgatcactactagcttacattcatcagagtgaagagcaaagccctctagagaggactcagcctgctcatcagtagtattcattcctacttcccagcaccaaccaacacttttctcagaatctttccaatcttgtctcttacttcacctcttaaagttcagcatatgtaaaaggagtttgtcaaagggtcccaaatttcctctaattcatttaaacattcaatttaatccagtcttattaaaagcaaaggataacagaaataagaattataaccaaagtataacaaagaagtcaacattcttttccagaccctgaatatttatctaaaaccgacgtcaacaaattcaaaaggcaattttgagtttctgttcaaacagcaatacattgtttgataataaatcacttgatctttaaccaataaaaggagaggcttatggaataagccttagttcagaggattcttccaggggttgaggaaattgtcaatagtgtatttgccagggcaatacttcccaaaatccctgtgagaaaaaaaaaaaaaaaaaggcgttcccagtgtctgagaggcgggcactcatgttggatctccctcaaggcattccctaggtgattagtttcataggaaactggacttgctgaaaccatgtccttccataatagggttggactatctgaatcacgggcaagtcaggtctcaactgaccctcttgctaacactcagactgcaaggttattggagttggttaagaactgcaaacatgtctactacaggggcccagccttcttggctggacctttcttcccagtgattctacagaccatattttctatgctatacgctgcccctgacaatggaccaagatttattttccaggatatttctaattagaaccattttacatgcaatagtcccttctttcacattttttaccccttcctgtttgcacataactcttctcttacattttcctagtgaacactttcccccttgacttcttttaaccctttagaggggttgaattgggggttgatgaaagcctgttttgcatgtctccccaaagacataattcatgccccctgtgatatggatccacagggcaactagttcacctgggagtcgattgcaacgaacacctgtaggggagtagggaaatgagacaaggaagggaaggagccagcagagggttcaatatcagtcaagttaccactgggggcaactggagcaggagttgctgagtaactcagggagccagtgtaggacacatgcttcagttatcccagtgaaggggtaaaacagaaatataatttatatgtcaactcccctcagtcattgggagagagctgctgtgaagtggaggagtggtgaatccttcaaaatttttgaccacctggcaggtacgcaaagcaatctttggggcgagagaaagatgttagaaaaaaaaattgctggcattttgaaggcaaacagatgcagggtggaggaaagggtgcattaggggtactgacggtgtctgctacaaagctaaaactcaatttgaaagaacaaaagtaaaaaagggttaacggaatcagaaaagacagatagaaagatgccagtcagaaaaaaaaaaaagctctgtgatagaatctcagcttagctaatccattcctaatttccagcacagaccattcacaaattatactgaaatgttgcttgttaaaaagaaggcactaccctccacatttcatggttgaagaagaattgaacccaacttttgcacagtttccataattttccaactcacacctcttttcttcagtttagacccatctccctgccacccaacgtgctcatgccaggctcactttaactgctatgcttttctcatgctgcttagccttcctggaatcctctccacatcatggaaaacttccccatctgtaagatctacctcagactctcctctgctcagtgagttcctgccaacactccacacttcctgattgccctctcctcttcttatctggccaatggttgtggtaggcagaaaaacggcacctgtcctaatccctgaaacctgtgaacatgttaccttccttggtaaaggggattccacagatgtgattaaactgagatgagatattccttttctccaagtgagcccaatgtaatcacaagtgtctttaagaaacggaagagggaggatgaagattcagagtcaaagagagatctgaagaggctatactgctggctttgaagatggaggaagaggccacaggccaagggatacagatggcctgtagacctcaaaaaagtcacaggaacagattccctctagagcctgccaacaccagtggaacctgttttggacttctgacctccagaactgcaagataataaatttgtgttgttttaagtgactatgcttgttgtaatttgttacagcaacaagaagaaactaataaagtggtttttaaggcatgctcctcagcattctgcatatttttagagcccttctgcaacaaattcaactagagaactctatatttttcagatttacaacatggacttctatcatatttcatttgaagaaaatatttgcccttaaaaataggtgaaatcctataacatatcacatatcatagtttacgtatttaatttaatgtgccttacgtatggcacactgactaagaacatggattcagaagtctggttgccttggcttgaaccccagctctgtcacttactagctgtgtaatcttgggcagattgcttaacctctctgtgcatggcttactcatctataaaatgaagataaaataatatctacctctattgaattggatagtgtcccctcaaaattcagatccttcccagaacctaagaatgtgaccctatttagaaacatgctcattgcagatattattagagtagatgacatcattcaatatgattggtgtgctttaaagaagaagagaaacacagggagaacaccatttgtcaatggagggagaggttggagtcatcgatctacaagccaaggaataccacagactgtcagcaacaccaagctaagagagaggcgtggaacagattctcctctagagccctcagagaaagcatgcccctgccaacactttgattttggacttgtggcctccaaaactgtgagaaatttctattgttttaagccactctatttgcggtacattgttaagaacagccctaggaaactaatgctctattttacagagtttttgcaaagactacatttgttaataatacatgtgaagtccacagaccataccctgcatattattaataaaggatagttattattgtttcatttcataagtattagccttattatcattgaatttaaaaatgcaaatttcagccatttattgtgtgcctcccagcactgtttttaagcacttcatgtattctctcacccaggatgttgctcagggtgcctgagctgaaatgatcctcccaactaagcctctggagtagctggaactacaagtatgcaccaccatacccagctaatattttttaattttttatatttatagagacagtcttgctatattgctcaggctagtcttgaactcctgaccttaagcaatcctcatacctcagtcttttaagcgctgggattacagatgtgagtcaccatgcctggccctgagactgctttctgtacttccttagaattcccttctgagtgcagcctgctgcgcaaaggggcccagtgggcacatctttgttttgaagaggtgagtcctctgcattctagtcagaatctttcacagtcctgggtgttagaccgagcagcagttctcaaagtaaagtctaagaatccctgagggttactaaaatggttttagggattccacaaggtccctgtctttgccaatttaagtatctgtgtgcctgattgtttcatatatttcaaccaaaccaatatattccaacagattaaatgcaaaagcagatgtttgattccagctgtcttccagtaagctagaggttaaagaggtttacaaaatgtaaaacaatgctactcttctcagtatattttcttggtttttgaaaataaaagtgtttttaataaaaatatttatattaagatatgagtttattattttaaatatactgataataaatattttaatttttttgctttttttcctaatattaaagctatagagaactatatcacacatcaatatgagcccttgagggtactcaataatttttaaaagtgtaaaggtgttctgagaccaaaaagtttaagaaatgcgggtatagtggctttaaattttgatattttacttatttttaattgctcaggcagctggtcttcactcactatatggcttctgtacaaaattgatggtatcatccttctgcggggttgatttgagcagtaagattccagaaaattgttttacgcttttttttttttttaaacactggttggggtgagagtatataaaattgtgtgtttgtttgtgtgtatatttgtgtacaccaattctaccacttaataaacacattccaattgaaacttgaggaatgagcaagggtaaaaatagaagatgaattcaatagggatggatataagttgggacgtttacttgcaaagtcacaaagacaagtgcctaagagaaacgatgttgactacagaacccatgctccttttatacgagcaaataacagagaaatttattttgggattctctgacttctttccctcatttgttgttattttgggaggccatccaaattgtctttagctttatgtataatcccagacaccaatcaaaactctccaaatgagcatggcaaagcttgagccatggcaagattttctttcttgcttaagatggcaggtaagaatccagaaaagccagatgtagtatttgaacccaattttcctcagcaagaaggcagcttccataattctaaaaggattccatgatacctcatgctaaagtgtttacgtcttgcacccatctctgagtctttagaggataccgtctctgaggaacccaataagagagcccacctggactcagccaggccactgaagaggcagcttctgaatgctagccaaattctgaccattgtgttccagcagcttcatttcccaatggcccaagattcccttcgagaaacaaggacaagaaccaaacataagttgttttgagaagaaagctatttcgtgcagattcctaatcccctcttcatgaaaaaatggaatttatacttgtttacccatctgtgttcttgccagagaagagaagtcacaccagctctgtggaaggcattaatcccctggctaaatccttgcagatatgttttcaaacaggcctgaaatatgaaccctggttccccctgtgtattgctgcagtgacctgagaactctcctcagggagctagatactagaaggcaggctgagccagaagccatcttcatgcgcaactgcaaaactcgtatttcccaaacaagagtttttcttcagcttccctaaacctcatattaccttcctttcggcaagaggtgcccaccccccacaaattaatgggctgggtaaagaggaagattatgacaataataacaatgacaacaatgatgatgttgacagtgatataatcggtttactaaatcatgcaatattgtattttgtatgttttttttttccaatcactttactgtcctgtaacaatactccaggaagattatataattatatggttactttcagttactataagcttatatctaggacagctgagtgtattcagctaaatcagacatctaatctacttccccttttgctggcacccctatctttatggactgctctcttgatgccccccaccttttctccactcaggagagagggaagtatccctcccctgtctcacagagaaaaaccacggcccatcctactaagctaaagatctgcctaatgtctaaaagttcttttgcccttatcctagtctttttattatgtctgtgtcttatttattcactgctggatcctaggcacctaatacagtacctgtcacagaataggtcaatggatatttgttgaatcagtgatggattgaatgtccttgaccagggaagggatcctggggaatgcaggagattagcaaaaccagtctggctgcccacacttaataagccctagaaggactatcaggcctccaattcttttcagcttcatttggattatgaggctagtgtcccatcccattttacttcataccttttaatcttcagtctttggttaattttccaattctggggcatcaggaatgttaggctggacattctgttgcaataacatgctaaaaacaactcctatttgctcagcccatgctgtgtcccaggaactgtgcatgtgttacctaattttttaccaccaccctgtaaggtagggattatagtctccattttcacatgaagcaactaaatcagatagagtttaggaaaggtgttcaagaaacaaccaggaagcagcagagttgaaaagtttgaaacagtcatgtctcaactttttgtgtatcactagttttcaaagtgactatatgtggaaatataaaagaccatataaattaatgaataccttgaaatacatatttttaaccaccctttttattttgttaccgctctctatacagctgtgctgtctttcttaagtaaaacaacaccaagtaaattaataaatatatctaaacttcaatacctttgagacacaattgctgcattcatattctgcctctctgtctctgtctctctctctctctctctctctttctctctctctctccctctctctcttttagttgagaagaattagtttaaactcaattcatggcttatatattaaatttaggtattattttttacataatataacatctatgaactcaccacctaataatccaagaactatagtatcacctgtaactagtatctacctatgtgtgttccttcccaaacccgacaccctatcaaatttcaattctccacatggcacctccatcctctttcttgaagtaatcatttctttgcctttcttaattttcgctgcattctccaacaatgcaatgagacagaataaacctttctacctttatctggttagtctttgaaagaatgaatttgttgcctagtaaataactgtgatggttaatattgtcaacttgattggattgaaggatgcaaagtattgttcctgggtgtgtctgtgagggtgttgtcaaaaaggattaacatctggatcagtggagcgggagaaacacacctatcctcaatctgagtgggcacaatctaatcagcagccagaataaaaacaggcagaagaacatgaaaagactagactggcttagccacccagtctacatctttctcccatgctggatgcttcctgctctcaaacatcagacctccaagttcttcagctttggaactcagactggcttccttgttcctcggcttgcagatagcccattgtgggacctcaccttgtgatcgtgtgagtcaatactccttaactcccttttatatatttatctatcctattagttctgtcctctagagaatcctaactaatacaataaatatttccagcttttttccctgaaactatactgttctttaggatttaaaaatcaccaaacgttttaaactccagctagtctttcataaagaaaaaaatcgtaatgacctagacttgaaatcttagtcatctctgatttcacccctttcctcatattctgactctttattggtatgtatttaaaacatatgtttagaatcctgacttgaagcaacctaacttgggtctattatctaattccacctggcttcaaactattttactaagggatgttaggttaccaatttcctagctaagcccaaggctgcaaagacatagactttggggacatgaagctgcttggtttccaggatctgtaactttttgaaccataggctccctatatgtggccataagaataatttgacctctgatacacccagggcagctggtgtaaccatagcaccacacttagtaatcatgccactcatgattatacaaaaaggcaactatttagagaaccagttttgttctccccacagtgtcacagcagttaacagtttgatagacaaagagtgattgtttcatagcctatctaaatcataataagcatcctactaatattaattcttttcagaatccttgagtaatgttttcagcattataattccaactataggaaaacaaccaggatttgagtaacctttaatgattaagcattatataaaatttaattaaattcttctcgggctgttgagtgttgggctagacagagcactctcaaaggctaacacatttttaagaatatgtgtctacattaggccagtttctccaagcaaagtctgagagatttgttcagctgcaaatgattaattgagggaagtattcttaagagaaaaatgctaacagagtcaaagaaccaaattaaggaaagggacagacttgaacaagcatctcaggtaatgtcaagcactggcctgaccacccccatacccaagcaggggtgggctctagacaagaccacatattgcatctctaaggcaagggacctaggcttttatacccccaaaaagtccgtcattggctaagactcagggcttggaatagtgggtattaacttctcaagcatctctgaatgaggtggttcactcagccaagggcaatttcccagagaaagtcacaggtaaatctatcagatgcagcacttgcaacagccacagatgggtgcaccagtgggagaatgaaatctgggggaggggccaacagtgtctaccaccacatctaatactcataaaccttaaactcttacatctttagtcccagtaccccagaaactcactgcatttttcctacaaatccacaattctcccccccaaaaaaaatgaagaggaaaaaaacaacgaattcgtgacattgaacagggacataatacattgagtcacccagtaggtaagtttaaacttaactttctgaattgtaatggatatcatgtacctaccaataggatttggctagaaaggaactttacctctgtggtctttccaaaaacccacaaccccagtctaatcatgagaaaaacatcagactaatcctgactggggtcattctacaggatacctggccaacactcctcaaggctgtaaaggtaaagaaaaacaagggaagcctcagaaactgtcacagaccagtggagactggggagacacatgacaactaaatgcagtatggtaccctgaattggaccctggaacaaaataaaaaaagggagttaatggaaaaactagtaaaatccaaagaaagttagcagttcagttaatagtaatatgtaatgctgatatcttagttttgacaaatatatcatggtaaattaagatgttaaccatagtgaaactgggtgtggggtatgtggccattcttcgtcctatctttgcaactattctgtgaacctaaaattattccaaaatgaaaagttttttaaaaaatatctaattaaaaccaacaataacaaaaggcaacagagaagttgccccactcttgtcctctcattacatcagcctcagtattattttaattaagaagcataagattcacaccattttcgaagggtactttgaatcacatttattgcccttactttgacatctgactcagctgagagaaaaaagaaaagaaaaagaaggaaggaagagaggaagggagaaaggggaaagaagatgctgaccccaagaaaattatgcaaattggctgaggcagctagttgttgagatggcagccagagcaagatgaggccccacggttttggaatgctcccctaatggtgccctaatcctgtgaactctatctcagcattcacacctccccattcaggcctttatcatgtcacaactgaaccactcccacagcctcccaactagcttctctttccccctccatcctggaggcactcacaacctctaccattccaccacctatacctgacctgacctatctttcgctagtgattctcttactctaggcaactaggtaactctgcacacagcccatgatttctcaacccactgggtacattctcctcctggaatgctctccccacacatttgtttaaaagccacttagagtttcatgaaatctcccctgatcttcagagatggaagggatttctccctcctttaatcttttttagtgcttctaattatcttggtgtttgccctatctcccttactagattgtgtgctatttgaagacaagaccacacttcatcatcttcctattccttacaacttttctgtggaattaggtcgtgcattcagtaaggcatcagaaagatttattgacttgatatgtcccccaaaaattcaatttagttcagccaatatttttgaatgcctaatctatgtaggtacttagaattgttctaggtctagattagctcaattttttcaataatttttccttagccaatataataacgctttcatgcactttctcttgtgccaagccatgtgctgtacactttatatgaattatcttatttgattttcgcccaactctatagtacagattattttattacatccatttatgaggtgactaaaaataatggagattaagcatttagccaaagtcactcaaatttgagtttaattcccactactgtgatttactgtcaagttctgaatgcaatgactctgcaatgtccttagcagatcaaagtctcaatgactgtatcctagctgaaatgctagtttacttgcagaatattaatagctaaattaatagattaggtttataggagatagaccttaaattctgcctgcagtgaatgattatggaaattctttccctcaaattatttaaaaacagagccaatttctctgctcttgggaatataagttgacataaccttcccagaaagcaatttgtcaatacatagaacaacactatttttaaagtgtgttacgtttgatccagcatttctacttctcagagttagccttaaagaaccaattaacaatatatgcaaatattttgccacaaggtttttacattaacattgtttatgacaacaaaaactagtaaatatctaaatgtccaacaagaagagacacagtaactaagttatgctccatccatacaaagaaacaccaggtagccattgaatgttccgaacaggcataggcataaagaaatgatattataagttaatttttaaaagcaatttacaagcgtgtataatatcattttgttaaaagtgaagggtatacaggatcttggcatcttgaacaaagaattggacaaaatgcacaaacaaagcaagaaagggatgaagtgatttacttaaaatgaaagtacactccacagtgtgggagtgggtctaagcataggagctcaaaggccctgttacagaattttggggagtttaaatacccctagaggattccattggttacttcgggtatgccctatgtaaatggagaagatgaagtaaagttacaaagtcatttatggcatatgccctatggagaggacatttcctgttacagctgaagtgtgaatcggccttatattcccctgcctccagaccctattttcctgcctcatctcccccctgagagatgtgatccccataaatctttatgggaggcagagggactgatggttttctcttgtaactacttcatgctggcttggggcatagtccctacctattggggatcacggaactcttgccctgttatggctagtggaggcagggtagcttcttgatggccaggggtgatggcttcacctggaattggatggaacctttgttgcatgaccatctgaagcttgatagtctctaggcaggaggaaatgacttttcttttttttttgatacagagtctcactctgtcacccaggctggagtgcagtggtgcaatcttggctcactgcaaactctgcctcctgggttcaagaaattctctgcctcagcctcctgagtagctgggattacaggagcccaccaccacacccagctaatttttttgtatttttagtagagatgggggtttcaccatcttgcctaggctggtcttgaactcctgacctcaggatccacccgcctcccaaagtgctgggattataggtgtgagccaccatgcctggccgaggaaatgaatttgattaaaaaatttaatgggaacttcagggggtggatacctatgctgttatagagatttgcaggagaaaaaacaaaacctggtctgttctggaatctacgtgtttccttaaagtcttagcatgagcaactccattttggtttggtttctcatgtcctagtgcatgagctcagttcaaaacaatggcctcccataattttgttttagaaagttctccatttttggtcaggctctcacttgggtgagagtgtaaccaaaacttagggccttagcaccactctcagttatcatcattttgggtttctcgtctcagcaaatcatttataggttatggtgttctcatggctgcacatttctttcagctcctgttattccagttgaagagagaccatgtgacattctagagatggctgcatgcaagcatttaaaacctttgagagaatacagcatacaagggagactattattatgactattgggaggataatatcaagagtttggagtatgttccttacccaaggtccccataaaccaaacctcctaaaatcaaatagatcaaagaatgagccagataaagagtttactcacttgactaagcaatttcttcatcaatcccctatcactgaatttctataatcttcatctgatgtctttctccataggccacaagtgccagcagctgcacagatacttctctatttagccaattctgttataattttcacaagagaatttagagtctactgtgtaactgtatcctttacagtagaatttgctatagaacctgtcataagggatacatttctaatcattgtttcttatactttaaaccacggaaaaaggacctaacaaatgacgcccttttagaagaatgaaggcctgctggcaatgctctctttaacccataatgctgattaagaggagtgaaccaatgtattgtttttgactgattatgatgcaatgcatgtaccattaaagtttcttacctacattaggccttcatcatttatctatcaaagtataaggttatccatgtctaaggctggctccaaacttcttcacaaataaaagtataccacataagtgcacataacagaccccttttccacttctattgttcacagaggcataagcaagaaaaaatattcaaagacaagagtttcatgatagtagaagtcttaatctgtgaacttgggaaaagctgttcacatcaaggatgccatcctcttcttgggagaaattttcctgtttagttttatcttaagagccccaatgggtgcacagctccaagagcatggagggacccttctcagttgtgagacaatgaacccaaagttcaaggtcccaaagttttgttgtagtgtggatggcaaggacagtctttttctgatgtttccagaagattcaagccataaaaaactttctttaactggtgaaatacaatgtagcataataatctactgctataacatcagcccccttgcatgggaaagcttttatacaaccagaaaacatgcattggaaataataattgaatgaaatccctttataaaatgtttaaatattaaatggccaaccaggtgaccaaatgtgaagctttaattgttttcccaggaatatgggatcaagcattggttataaactattttaaacaatttcactattcgctggtttaacactaaagtattttctggatatttaattaactgtttggttttacttgagttagtagctttatacaaggaaatttggttatttctgtggcctacaataacttaacaataactataattgtgattggtggcatatacttagacattagaattttagaaatcccatacaattttggaatatatattagtattatccacaaaaatgtaatctaaataagattgaacatcattttggcaatcccatgtacctaaacacatcaaataatcctgtttacctctcttctggatgttttcaggggtcctatgatccatccagaaaccaggcattaggaaagacaattttgtaactgaagtttgattttggaattccagattaccataaattatttattttgccaaaatgatgattcagaaattttaaagaagaaaaaccttttataacctttataaaaatggaaacaaaaacattctactctttttacacacctaacatgtaaaactgtttctagtagtcttaattgcatgttacagtggtgactcaacaattttaactttaatgtaaaacctggtaagttatattctgatagggtttgactgtttacagtatagctagggtgtggacaactctgcatgtccaggccttacctagctggaaagcaggcaagttaaacaattttcaaaagccaaagcagcagtttatcaccttaaagcatttagcaaacctcatatctgaacataatttagaccacatgttaacattttgaagacaattgtattttaccaataatctttaaaaccatctttatttccgaaagattgctaaagtcacatgaagtaaaaagcattacactttctacttttctaacaaaatatttgatttaagctcttattattaataaaccaattaattaaaactttacacagcagataaacactggcttttactttatatttaaccagtttgcacagagagaaagaggccagagactgatcggtaagaaattcttacccttttgccagcatgccaggtttctgggttctctctccctaagcagccctggcaaccctgcttgactatatgtaaacaaacacactgccatgaattaagaatactcacaaatacttaacaaattttgagaaattaggcagagagagagaaatatgactcaaattctatttatgagagtatactcaatacacttaaagtatcaggaagcctaaaatccaaaaagttagttaaagataaaatgctggtgtgctccattaatccctgcaggcccaacaaaggtagcttaggaattccatataaatggaatggataatgacttgctagaaatgcataggaacacagaactgaataaaaaccttccactaggaactataaaaaataattatggttttatacatatgcatacacaagcaaagccagaggagaataaatagcaagtgaatgaaaactagaagcaaaataaataagcggaaaaccaaccctaaattttcctactcaatttaccctggaggctacagtgttacctagggccccggaaaacctagataatgaatattttattactaatacacaatatccataagttcagtaatattatcatacctcctgtgcaagtaagaaattcactttaggcacataaccaataagtactccagcactatccatgcaaaacggtaaacatagtgtgaagcaatgcaagcgtgtatgtaaaatttgactccacactaaatccagattcatgcttaactatatttaaaaaaattgtcaaacttctgatgcattttcacaatacttcttactttaatcaagactaagagctttactgtggaaatattagtcaaatgtttccagttatttatcgggttttaaagaatattttattatctaaatttttccacatctttctcccctacttgatggttccttactacattgtttcataaataacttttcaaatatgtaatttgagccaacttttagatgacttctgaattagacaaaattattctttttccactcataacaaaaccctttctggcacattttgtatacagaactacgtgttaactagaattttatccttagtaacataaagctttagtgaatccctaaaaagcaagaaatcctgaactattagatatgggcatttatacataagaaaaattctacaattttagaaacatatttcttcatattgcaatcctttcttaattggaaatgattcagatattaaatgagcatcaaaaataactttacagttttaatttacacaaaaagtttacctaaaacaactatcctatcactgtccttaattttttacttttaacaagggagatacgatacatcaacatacttaaaatgaacattggtttggtccagaaaggcaggacaatttgaggcaaggaggcttgggggctatcagatcacaggtaggaaacaaacggttgttttcttttgagtttctgattaacctttccaaaggaagcaatcagatatgcatgtatctcagtgagactttgaatagaatgggaggcaggctcaccccaagcagctcccagcttgaattaacactgacattttaaaatatctagcaaagacaaacataaaattcagacaaaacatatgctgacaattctaaaggcatttctatttttcttccatcaataattttaaagctagcttgtttagtaaagtgatactttaagtcacgtgaacttgaaaattgcttagactcatttactaatttatgagtgctcttttacttataagccaacttggtagacacaacatgtaacagtaagtgtatatacaaataaacatatctagacatgtatacacacacataaacaaagatctaatagcttgaaaccttagccatgagacagcaatagaagcttcccagttttactttgccccaatagataatccaatgaaggctgcgaaccaaaattttgggtaaagcagtctccatggcagtttcatttttaaaggccaaacctccccagactcaaaagagcactgggaccaaaccataccaaaggagggcatcacacgttaaccaggccccctgcttagaaccacagtacaaaagcccggatatatggaataccattccactttcccattagacagtaaactccagattccaaacaatgctagggccaagcagcattgcaactgtgagagaaaattctaaggagggcttaatactagacctcagaacctgtgccaagagtgtcctctttggagtggttgggttcgcaggacccacggagcgtcctcctgtggggtccagtcttagagtgccagatgtctctgaccttaggtggacaccacatgcagattttcccctccagaacatactgtgagctttataagcatagccatgaactgtaatgagaattggatgctgggtgggcctttttgttccttagccagttgagtacaatgagggaagaattttgcataagaaaagaaagtttaagtcccctgaaacacgtgtgagtttgcttggatcagggaccatgcatggaaaacataaaaagaagtccttccctcttcggggcagggcaattataaacagctactgaaagactgagaaagaaagaaaaacaaacaaacaaacgaaaaagacccaggttccttaagtgaactgggccatggtggtcaggcttctccacatgaaaaccccttagtttcactggccacagccagaaaactgcagttgcttccatgtttagccactgcccaccacgggtcccaggttggaaaggaaaagagagagaaagaggttcccctatatggagcagaaaagaaaaggagaaagaagaagaaagcccaaattttgggcttgtctcttcctcccggctggctcaccaaaatatgttaaaggtggagggtgtccaggttcttggtgtcttgaacaaagtattagacaaaacgcacaaacaaagcaaggaaaggatgaagggatttactgaaaatgaaagtacactccacagtgtgggagtgggcccaagcataggagctcaaaggccccattatggaatttctgggagtttaaatatcccctagaggattccactggttcctttaggtatgccctatttaaatggagaggatgaattaaagttacaaaagtcatttatggtgtataccctatggagaggatatttcctgttatagctgaagtgtgaataaaccttatgttccctgcctccagaccctattttcctgcctcaatttttctaaaagaaatatataaatatacaataaatactatattggcataccacttataggacatgcatataaaatatagtgtaagatcattcaccagacacctgggtggacaaacagctcagtaaatagacagctagacaataagttagagaaccgagaaggaaatatagcaaaacaataacagtgatattttctaggatgtatgcaagaattatatgtgacattaatttttaatttttttaaatctgtgttttctaaaatgaacttgttttacttgtattaaaatagttaccaaaaatttttatctctaataaattatgtctattaaatatcattagtcctagaaaatttgccatgtaaaaccacaacttggggtagccgtccttcttgcatgagtctccctagtagctggggctactctagactcctaaagcctgtgttaacacacagcttttatgtccttagtttcttctatgtcactgcttccagatcttggaggcttagtaaaacttgtaacttccttactgttatattcatttgtatatgcaagaatttttctctccaagcagcccccaggccattttgtcaatctgctaatctgtcctcagatttcatgctacttggcacaaaagtacaacatcggaacttgtaaaagtaacagtagcccagcctggagggcccatgttgtaggcaataaattttccttcctgggtctgtctttcaaagctttcactcccttaaagtacacatatttacatttccaaatgataccatgttatagaaaataccgcatgattgattgacaatagccctcatgaggaagttgttcaactcataacagacttgtagcagatataaaagatgaaaagaaaggctttcatttttgttttgtttttgaaaaatatatatgctattatgatatcattgtgcttttttctttgaactattaataggagaatgatggcattcaatttggaaacatcaagttatcctggcacttgtgaacccaaagtgtctgagacaggtctcaatcaatttagaaagtttattttgccaaggttaaggacatgcccgtgacatagcctcagtaggttctgatgacatgtgcccaaggtggtcagggtacaacttgcttttatacgttttaggaatacatgagaagtcagacactatgtgtaggaagtacattggtttggtccggaaaggtgggacaactcaaagcagaactgggtggggggcttccatgtcatgggtagataagagactaacatgcattctttggggtctttgattagcctttcactgaatacacaatttacatgtgacaggagaatacaggaatagtcacttatgctttagtctggctaggtgaatttgcgtttttacataaacactagagcagaagaagcaatcagatatgcatttgtctcagatgagcagagagatgacttccccacacctgtgaagataagctatcagtttacattaccagggtaaaattcagcagaactgtctcagggtaacgatcttgagggccccccccccaagtaatttccttgtggacaaattgtgaaggaggtatgcagctttttaaaaaaaatctttatagctatgttatttaggaataaaatgggaggcaagtttgcctgatgctgtttccagcttgacttttccctttggcttaagaggttttagggtcctgagatttcttttccttttactcattcatgaaataaaacccaaataatcatgatgtggcactaatcccatttgaattattttattaggattttttgagtcaatatttataaatgagactggtctcttcttttctttttctgctagcctattaaagatatattttttccttttttactattaaatcagtgattcttaatttcaagaaaagattgattcttatttaagtcatagaagcaaggtctgaaacagggattctgtgcaactgacttattgagggatttctccccagagaaacctgtaagacaggaatggaagcaggatgatgtaaccaaacagcttagcagcttagcctcaaaccatgtttaaatttcttttttctttccccttttctcctccccctacttcccagtcttaagataaaaccttgagacaaagtgcatgtattttacctttcatcttgaaatacagcctcagaatgagctgtgaacctccactccctttcttttcccattctattctcatttatttacctagatgcttgctaagcacacaccatactcacttatctggtcatataatacaaaaatatttccttagaagtttcaggggctaagtcctgatacagaccaacacctccaaccttgatgacaccagatgaaacaataattcaagatgagccatcagagtgggtcatgccacctgacatagcctagcccggctgcctctcctgcattccaaaccctctctttaaaaacctccgcattccctccacaaatggaacagtgaaaatttttggaaagaatacacccactcctccccttgctaacatgggtaataaaactcgctctctttttatcacacctcactcttgctatgttggcttctttttacaaatggcaagcaaccagacccttttgccagttataataggacgaggggaagaagtatgtcaagctccagttcacgttgcactctagactacccagtcccacaggtaacactaacacataaatgatatcacagaacggtcccatttcaaggcaaggaagatgggtttatgtaccctcactacagttagtcatttgatgtgggctgtcccaggagatagggtacaaactctcaagtatttctgggtgaagtagctcccagaggccataagcagttctctgaaaaggggggaagtgtaagccattagctgccaagattcacagcagcccagagacaggtactctggaccagtataggagatctaggtggggcatttccttatttttctgtgctctgcaacaatttaaatatagttagaataatctgtcatttacaagactcaaagaattttcccatagaaaagtatgaaatagacatttattgattggaaagatctttaatcatttccagctgtgtctttgataattggtctactcagatttttcatttcctcctaagtcagctttgctcatttgtattttctttagaccactatctatttcatccaagttttctaaaattgtgttataaagttacacattgtcaatcaccagaattcttttgatttgttcctttagctgggcctatcctccagttggggctgccactgtgttgtccctctctttttggcaatttctgcctcctgaattacagggagtgcctgttccctttgagagggactttttgattcttgaaaagatgaccacttgatcccacttctggaattcatttccaagtcatattctttttttcttcaccaaaaatacctactattttaggtataaacatttacatattccctttcaagcacactcactgtgttcagcctggaataaagtgagcaaagaagaaataccctcccccttaatcttggctagcagtgatgcttgcatgtcaatgtgtgacaaaatggaacaaatccactctttcagtgttcactctttcccaaggccttagttaggctggacctggggtcaaatactagaccccttgctatgcttagagcctcctaaggctttattaatggaggtgatggtctctcactgtcaacttatctaagctggaatgacatttcccataattcccttatgtggcttaaggttagggtgctctactgagatttacaagagatttggaaggtggaagtgtatccatggcaattttgttaagctctgaaggtgagtgtggggccaggtgctgatgcagctgatgcacattgtcactgacctgtgggtccacctcgctggcaaggagcggcagtgggcttacggctctttcagctccttccagatctttccttcggcttcccctaatcctagagcagatacattttcagctccgttgagaagggcatcagcgtcttctgcaggttgcccttgtctttgcgattatataaagggagggacaaacatggattccagctcatctttgcaggttttagtttgcccttggtctctgctatttcatttcctcttcccttaccaactgccattttgcagacacaaagggaccatccttgcatagactgcttattaagtttccaagattatgtggggcccaatcccttggaattcacagtttttatgattgatccctgactattacaaataatcaagctcatcaagcatgtctccttctcatcataaggtgaatttttgtctggaaacttccttacagcccctgaaaatacacttctcctgggccaactcataaatttgtcagatgctgaaacccatggtgggtccagtctaggctggagttgagatttctttgccatgtgtattgtttcaactaaaactcacaaccctttgatgcaggtattatttttccaatattatagacataaaaatcatagctcacaggttaagtggttatcttaagctgacacagttaataggacaaaagacatttgcattcaggtctctctgaatataggcaagcactatactttttttttttttttttttttttgagatggagtttttgctctgttgcccaggctggagtgcaatggtgcaaacttggctcactgcaacctccacctcctgggttcaagcaattctcctgcctcagcctcccaagtagctaggattataggcacctgctaccacacctgaataatttctgtatttttagtagagacagggtttcaccatattaaccaggctggtctcgaactcttgacctcaggtgatccacctgccttggcctcccaaagtgctaggattacaggtgtgagccaccacgcccagtcagcaggtgctataccttctatatcatgtgcagaagcagtcaagacagaacttgaaaaaagataatcaaaaggaacagtgcaaaagttcataggtcagagagatttccccccattaactcacttctttgaagttccatactcctactctgtctttcccctcagcccccaacatctccctttcagcggtgtgggcctccattatatcttaaactgcaggcaaccagagtttcggaaatctggcctaaccatttcagacacttctttgtccatgataatgctaactggagatgctcttgaccaccattcaacttcacacagcctctgattggttccttcgtccttatccatgtttttttttaagttgcaccttcctaacctgacctttcaagcatcatacagttttagaacagaatgtgacctcagagataatttcagatacaacctctttttactggtaagaaaactgaactcagagaggggaagtgaccctttcaaggtcataccttgtgattgacagtcaatataaaggggaaacccactgtgtgattattcttagcagctgagggaagtgccaaagagtatagctgtggaagtgacgtgaatttagtacattaaaagatagattaccctactaacttctgagaagaacatcaaataccttcaggcctgttacactgagcagaacattttgccattgtcatactttgtttaatccctctgcctctaatgcccacaagcagtcaatttttttccaatgtcacagccagctatgctctaacatttcagcaaatttaaaagtaattacctcaataatggattagttgctgagtttaatcattctgaaaaagtacttggcttttccatttatggaataataaaatgttgcattcctacatggcctatcatttagaagttgctaaaaatggcaggtctttgttgacatagactgacattaacagcagaaagcaaatagatggatgaagccagggtatccactatagggaaagaaggctggtgaccaacaaggagcagattctacgattatctaggtaaggggtaacagcaaacaaacaaagcaaatctgacatcctgagtttcctcaatagacagaattgaatgactaatatctaatcagtagtttcataaatcatagactcaccctctttacaccaacaagattttatctaagttctcaatttctgctaatcacagtgaaattcctcactagctctgttgagttccaccttgggcagaaattaggttttccctctatctccattctgcacaggattctcaagccccctaccctatctctagaaggtgtgcaagtatctagcataattacatttcatattatctctaggtgatatgctggcagtatatccattaactatgttcatactaatgctgtgaaacaaactgaccccaaaattataggcttagaacaacaataatgtgttcttatgaatctgtgaactggctggctctctcactcattctgcagctctctgtgggctggctgatccaggcgaggctcaacactcatcactgctccacatgtttctcatccttctccttaagactagtagcttggcatgttcttatggtgatagcagagacagaaaagctgttgcaggaagtcagggaccctgaacggagggactggctgaagccacggcagaagaacataaattgtgaagatttaatggacatttatcagttcccaaaattaatacttttacaatttttttatgcctgtctttactgcagtctctgaacataaattgtgaagatttcatggacatttatcacttccccaatcaatactcttataatttcttatgcctgtctttactttaatctcttaatcccatcatcttcgtaagctgaggatgtatgccacctcaggatcctgtgatgattgtgttaactgtacaaattgtaaaaacgtgtgtttgaacaatatgaaatcagtgcacactgaaaaagaacagaataacgtgattttcagggaacaaggaaagataatcataaggtctgactgtctgcggggttgagcagaatagagccatatttttcttcttgcagggagcctatagacagatgtgtgagcaggagaaatattgctgaattcttttcccagcaaggaatattaataattgataaccctggggaaggaatgctttcccaggggtaggtctataattggccactctgggagtatctgtcttatgcggttgagataagggacgaaatatgccctggtttcctgcagtgccctcaggcttactaggattgtgaaattccagcctggtgaattctagtctgactggttgtctgctctcgaaccctgtttcctgttaagatgtttatcaagacaatgcatgcccagtgggacatggaccctcatcagtaattctaatttcacccttgccttgtgatttgctctgccctctgccttgtgatcttttattgccctttgaagcatgtgatccttgtgacctactccctgttcgtacatcccctccccttctaaaatccctaataaaaacttgctggttttgcagctcaggtgggcatcatggaacctgctgatatgtgatgtcaaccccagcggcccagctataaaattcttctctttgtactcttcctctttatttctcagaccggccgacacttagggaaaatagaaaaaacacctacattgaaatattgggggctggttcccccgataaaaagcaaaagcaaatattcttgagacctagtcctggtctggatatcatcatttctaccttattctcttgaccaaagttagttacatggccaaaaccaatgtcaagaggcagagaagtactccttgccaacattgggtgggcactgtaaagtcacatggataaagagaggggtaaataactgggaccaataacacagtctaccacaacagggttatatgggttctatgccagaatactttctgctctgttcctagtgctttgagatggaaattcctcattctaacccccactctaatgactttttctatttcctcaccagtcttttggagtttgtttttatagtcagaggctatatgagcagatttgttacatgaatatattgcctgatgctaaggtttgagcctcagttgaacctgtcacccaaatagtgaacatagtacccaataggcagtatttcaaccctttcctcccatcacttttggattccccagtgtctattgttttcatatttatatccatgtatacccaatgtttagtacccactgataaatgagaatatgaagtatttgcttttgtctctgctttaactctcttgggataattaggcctctaactgcatccatgacatgattttgttcttttttatggctgcaaagaattccatagtatatatgtaccatattttctttagccaatccacctttgatgtgcacctaagttgatttcatatcttttctgttgtgaatattgttgcaataaacatggagtgcagctgtttattgcattttttagtagaatgatgtattttcctttgggtatatacaccaagtaatggaattgctgagttgaatggcaattctatcttcatttgtctgagaaatctccaaactcatttaccatctcaccaatgatgtttaagcattcccttttctctgcaaccttgccaacatctgtccttttttgactttttaaattatggccattctgactggtgtgagatggcatcttattgtggtttgatgtgcatctctctgatgattagagatgttgagcattttttcattttcttgggcaatggtttgtctttttttgagaagtgtctattcatttgcccactttttagtggggctgtttggttttttcttgttaatttgttccccatagattctgaatattagtctattgtcagatgcatagtttgcaaatattttctcccattctataggttgtctgtttactctgttgatagtttcttttgctgtgcagaacctctccattttaattaggtctgaattgtcaattttttgtttcattgcatttgcttttgaggacgtggtcataaactttttgcttaggccagtgtccagaagggattttcctaggtttttttctgggattttttttatagtttgaggtgtcacatttaagtatttaatccatcttaagttgatttttgtatatggtgtggggtaggggtcaagtttcattcttctacatatggttagctagttttctctgcactgtttattgaatagggtgtcttttcctcactatttgattactttgtcaaagatcagttggttgtaggtatgcagctttacttctgggttctctattctgttttgttggtctagatatctatttttaccagtatcatgctgttttggttactgtaaccttgtaggatagtttgaaattggctaatgtgatgcctctggctttgtcattttttgctaagcattgctttggctattcaggctctttttaggttccatatgaattttagaataggtttttctatttctgtgaagaatgatgttggttatttcatagaaattgcattgaatttgtagatcactttgggcagcatgaacattttaacaatattgattattctaacccataagcatggaatgcttttccatttgtttgtgtcagctatgacttctttcaacagtgttttgtagttctccttgtagatatctgtcaacttcttggttacatgtatttctagttgtgtgtgtgtgtgtttgtctattgtaaatggaattatgttcctgatttggttctcagcttgaatgttattggtgtatagaaatgctactgagttttgtatgttgactttgtatcctgaaactttactaaagtcatcaaatcttttgatggaatctttagggtttcctagatatagaatcacagcatcagtgaagagaaataatttaacttcctatttccctgtttgaatgccttttatttctttatcttgcctgattactctggctaggacttccagtactatgttgaatacaagtggtgagagtggacatccttgtcttattccagttgtgagagagaatgcctccaattgttgcccattcagcatgatattggttgtcagtttgtcatggatggctcttattttgaggtatatttccttaaatgcatagtttgttgaagacttctgtcatgaaacaatgctggactttatcaaatgctttttctgtgtctattgagatgatcatatggtttttatttttaacactgattatgtggtgaatcacattttttgatttgcatatattgaactagtcttgcattccagagataaagcccacttgatcatggtttcatctcaacatgatttttgatgtgctgctggatttggtttgctagtattttattgaagatttttgtatctatcttcatccgggatattggcctgtagttttatttttctgctgtgtctttgccagatttgggtatcagaatgatcctggttttctagaatgagttaaggaggagtccctcttccataatcttttggaatagtttaagtcagattggtaccagcttttctttgtatgtctggtagtatttggctctgaatccatctgatccagggatttttttggttagtagactttttattactgattaaatttcttaactcattattggtctgttcagggtttctgctcctttatggtacaatctttggaggttgtgtgtttccaggaatgtatctatttcctacagattttctagtttgtgtgcatggaggaattcagaatagtctctgaggcacttttgtgtttctgtgtgatcggttgtaatgttacctttgtcattttttattgtccttctttgcaccatttctctctttttctttgttaatctagctaatggtctattaatcttgtttatcctttcaaagaacaaactttttctcttgttgattctttgaatgattttttttggtctctatttcatttagttctgctctcattttagttatttcttttcttttgctagctgttggtttatttcgttcttgattttctagttcctttaggtacaatgttaagttcttaatttgaaatctatcatcttgatgtaggcatttagcactatcaactttcctcttaattctgcttttgctgcgtctcagaggttttggtaccttgtgtctctattttcatttatttcaaagaatgttttcatttttgcattaatttcattgtctacccaaaagtcattcaggaacaaattgtttagtttccatgaatttgtgtggttttgagggttcctcttggtattgatttttatttttattccactgtggtccaagaaaatgcttgctgtgatttcagttttttggaatttgttgagactttttttatgactgagcacgtggtcaatcttagagtatgatctgtgtgcagatgagaagaatgtatattctgtggttgttgggtggagaattgtgtagatatctattaggtcccattggtgaaatgttgaatttaagtccagaatttctttgtagttttctcccttgatgctctgtctaatgctgtcggtggagtatgaagtctcccattattattgtgtggctgcataagtcttctcttaagtctagtagtaattgttttataaatctgggtgctccaatgttgggtgtatatatatttaggatagttaatcttgttgaatagaaccctttatcattatgtaatgctctcttttgtcccttttttttttttactgttattgatttaaagtctgtttcatctgacacaataatattcacctatgatttttttgttttctatttacataacagatctttctccttcccttcactttgagcctaggggtttcattacatgtgaaatgggtctcttgaagacagcagaaagtttagtctttgttttaatccagtttgctactctatatcttttaagtggagcatttagacaatttatgttaatatttagattaatatttaggttattaggttaattaattaggttaattaggttaaataattaggttaatatttaggttaatattaatatgtgaggtgttctttttgacatggtgttgttatctagttgctttgtagtcttgattatgtagctgttttacagggtctgtgagatatgtacttacacgtgcttttgtggtagcaagtatcattctttcatttccatgtttagaattcccttaagcgtctcatgtagggctggtctggtggtgataaattcccttagcaattacttggctgggaaagactttatttcgctttcatttatggagtgtattagggcaggatatgaaatccttggctggaatttcttttccctaagaatgctgaaaataagtctccagtctcttctggcttgggtttctgttgagaagtctgttgtttttctgatgggattcccttgatatgtaatatagcccttttctctagctgcctttaagctttttttcttttgaattgaccttggaaagtctgattactatggaccttggggatgatcatcttgtatgtatctcagaggagttctctggatgtcttgtatctgcatgtcaacctctctagtaagattggggaaattttcctgaattatatcttcaaatatgttttccaagttgttacattctcttctctctcaggaatggcaatgagttgtaggtttggttgctttacataatctcatatttctaagaggctttctttgttgtttttaattctttaattctttatttttgtctggattgatttgaatgaccagtctttgagttctgaaattctttcttctgcttggtctagtctgttattaaggcttccaactgtattttgaaattcttccagtaaatttttcaattccagaagttctttttggtcctttcttaatatagctatgtcatgtttcaaatcttggattgtttttctggctttgctagattggatttcaactttctcttggatctcattgagtttccttgccatccatatttgggattccatatctatcatttcagacatttcaatgtggataggatccattggcagggagctaatgcaatcctctggaggtgatgaaacactctcgctttttgtatggctggagttcctgttctgattccttctcgtctgagggagccaacacttcttgttctgtttgaatttgctgtcatttggatggggctttgtatttttattcttttttcccttgagtgtatgactatggggcatgttttatatacaattggttggctttgtttctagattctttcagagggccaaagccctatatgggtttccttggttgcagataggttcatgcagtaggtttcagatattgcttgatttagcaaagtatttttgtttgatggtataattcagggtacattctagtagatagcaagtaagagtaaattaaacagataggctgaattaaacagataggctcttactcagctgcacttgccctcagtgggacagcagtgccagagaaacatgaatagggtactttatcagctcacactcacttttgatgagggtggagccactagagaattatgagaagcagcctctttcagtacatgcttaccatgctccaatgggaagagccactgctgcatctgcaacagtgcactaaggatgggaagtgggggatgagaggtgaatttctcttcaagtccggtcccagaccttgatgatgcccccttcagcagttgctgcctgccagtatttcctttgtcccaaggtgagggctttggtgggctgtgctcccccaatcccttagaaatagtccacactgaggcttaggtctccagggggtctaaaactcccctcagagacccactggtcccctgtgcttgccaaagttagagcaagttgtgaggtccatatcactctttatctttgctttttcactctttatcttcatttttagttttcattctatcctttctctccccttctcccaaagcagtcttactgaagtctctcagatggaaaaaccaacttcataagcttgcccctgaaaattcaagttgcacatatcttaagtcttcattttttattcattaggtggggaaaacagggattcatctagatttaggtccagatggattcaggctttgtatctctcttcatcttaccagctctggtcctctctgtgtgccattattctttagacagcctccttccattagtaggcaagatggccacaaagaactccaaactaacatctgccaggcccagcacttcctctcccaaggtgtgtacatcaatcctggtgacatctatgatgataggctgtttattaggcatcaaatgtgagcaagaggaagccagagtaagcccaaaggatatttgtgaggcattcctctgagactgcagaaaataacattcactttgaaaaattattcaaatattaaattaagtcatttaacagcactaaaatcttcaaattaaagaaatattaaaagtaagataaaagattaatggtgacacttgttataaagtattactcttcagctcacctttgacacaagtaaaaggagaaattgataatgaaatttaagaatcattaagtgtataatccagaaaattccaaatatcttactataagattggatcctcgagaaaacaaaaaagtacatacttgaaaaagaagtgagcttttcccctacatgtttcctttcccattcagttatgtgagttaacatgacaatcacgtttttatattctttaatatttccctatttcaaatagtaaaatcaaattaaaggtaaccataataaagacaacatagtttttgcttcttcccaaatttccacataaaaatgaacagagcaactagacaccaacactaaaaaccaagaacaatgcttacgacaaaactacactccaaggtttccctcaaatacagccaggtccaaccattggaaaggcaaataaaggaatcacaagtcaaatagctagggacatccctgatgctcaggcttccttttccactcttgaccaggaaattacaagatgaactgtaaccttctaccaggtaggaagataccaaaacccaataggtggatgtggaaatggagtcatgagccaacataatgagtctcctgctggccaaatttgggacagtttgagcttcagtaaagataagaattgcaaactcatcaaatattttaaattcatgaattaataataataataatatcaaaaattggtcctattcaaaggatgacagaaaacaaattcattgtttttgaaaactggcaattaaagggaacaaattaaggatccatttcacctttcctaggtgaactgtaccactgggtaactaattagttgatgaaggagaagtatctctttataaaacaattccgactagtaagtgcaaataaaatgatagaatatcaccattttacaacacctaagtaattaatggacctaggcatcaattcctgctaaaaagagagagaataaatgagacattatgcacctaatgataatatatatatatcatctagagtctagtcaaagggtgaagttaagtctgataaaatttcattccactgtacatttataggaaatacagaaggatgtagttgaactataccatggttatgcaatccataacatccagactgcaaaattctacaggtcaaatgacacaggtgtttcagcagttaaattgtaagagaaaaaaaaagatgaaaggtgaatctccagatttaaaaagagacttaaaaaattgtaacagaaaaaaaaaaagatgaaaggtgaatctccagatttaaaaagagacttcaaaatttttttaatgtaatgagaaaactcaaactattatgttaaggaatgaacatttgggatataaaaccattaagaaatgcaagaaagttttattcaaaagttgtcagtgtttacttttggaaagagagagggcctatgattggaaaaaggcacatagaagcttcctggggtgctggcaacattctttgttgacctgggcagtggtttcatgggtgtttgccttataataattcactgagctatagatttgtcttctgtggttgattttatctactttttaaagtaaacaaaaaggtgaaccaattactaaaacaataaaggtcagtaaatagaaatggaaagtaaaatagtaaagtcaaattaaattcaaagtcatcttttaactggaagaccaaagtcgacgatcttacagcaaaaaaaaaaaaacaaaaagaaaaagaagagacagcaaaaataataccctagagacagcaaagcattagagaggaagttgccaacaagaattcacattctaatctccaaacaaacacaaagaaagtaataatataggtactttttcaaataaattttcaatgaatttaatcaaaaagttgaagatttcccccttactgtacatgcctgtattcataaaatgggaaataaagtccactaattggaaatgtcctttttcaccagcttttctggaacagctctgttgtgggaggcctgcaatgcatttatcagccctcttacagatgcctctcaaactctgcaataagccattctcccatagtgagaatagtggctccttagtgaatcaatttaaactaagtaacaaaaatcggcaattcaatttgtccatcctgtgacccttcagggtagaaggggtttacacctcatcctttcttgaaataagttgctcttatcccaggtcagccaaaaaggctgaaatttgagttcttcccccagtgcgggttatagtagccctgttcagttttcctaacaaaacccctctaaaagcacaagatgagaagtttagagaccgtgctaattgtggtgtaattaatggagacctttctttgcccattctggtatccacacccttttccatctaattgggcagttcttcccacctgagcaaaatgtatattccctccacctttacattggtcttggccataagaatggctgggaataaattgtggggaagagtaacaatgtgccaatttcaagcctggaccttaaaagcatcatatgtttccttttggcttcctgtacttctgccattgacatgagaagagttccctcaggtggctgctgccaccttagcctgggcctctgttacatagcaatcactaactgatacacaaataatgccagtgcaatatgtgactaatttctccttctttagaattgcagctttggcatgacttgtaccacaactgaaaatcaaaagtgtgtcattttccacaacatgtatctccctattttacctattttaccctgtccctcggctctctattgcagactgaaggaaatgataatgcaacccagtcttgagcaataaaattgtgttcattttagccctcatccctggcctcaccttttattccttttctcttgtcctaattgtgcagttttataattccatctctcacatggcttgttgagtatagtacatgttattcctcacattgtcttttgcctttcttcctagacaagagttgggagtagggtgaagagagaaaaaggaagagaaagcgttttgccattcatattccagttcaaactgcattccacctgcagcccattttgtcatttctcaaccatcactcttacctgtgattcatttttgcatgttttgtcattctcaattttgaaatttcaagacactgcagaaaaacatgtcaggcaataaagaagattcacataaggaaaaagcaatcctgtgttcctcaaccagatgtctacattgcaaggcagtgaaatttccaacaatcctggagacaaacacactgacacaaaaagacatccagctgggactcctttgctgtcagatgcctatatttctaccttcattgtggaagtgtgggactcttcctcagggaaagcctctcgctacagagagctgggccatccagcatcaccacccaaaaagagagtggccctagtgacaggtgccaccttcccctagaaatttcccttctcacctttttttctggttgaattacagcctgatagctaccttggctggacttcacatacctggtgctccagagcagtgaaatctcatgtatggaacatcccatatctttgattcagggaattctttggatgatcacttactcacaaagactaaacaaaaaattgtgtgactatatcatcaatttagaacgtgccaaagtacccgtataagtcactgtctttaaatctaccatttggtgaccacagaaatgcttactgaggaaaggaaactgaacattaattgggtgcccactatttcttcagtactttgtataccttctttaatttcattctcatcacacccctgtaaaatatgtatttttattcccattctactgatgagaaagatgaaggtgcaaggagagtccgttaacttgcctgaggtcacatagctggtaaaagatgaaactgctcatggggaaaacagaacatctctccaatttcacagagttattgtaataagaagatgcatgattttatacgatatcatctggtacttaggtatgcaagaaatgttcatgtcctcctcctcatcccccacccctacttaacatgtaggactctattcattcacccactcattcattctttcactaaactcatactgaggaccttctctgccagaaactgtgtcaagcaccaggaggccctgccctcgatgatagatacagagataaaaaggatttactctccaggttacacacaatacactcagtcgcttttcaggagggcctcttgattaataagagcttaactctaaatattgacagtgtcatctgtcagatcattttcccacccaggtttcctggttactccaatgtggggatcaatcccagctttctttccttaggctgaaatgagttgtgatttcccctggggagaaggtggatgtgtatttagtagaagagtagatggtctccagtcaagttctccagtcttctgctcattatgtcatattgacatggaactgtttaattttatctcttgtctacaatagtgaatgggataaaatcaagtcagatattagttcaaatcaaggtctagttaattcctaattagcttatcatggttgctgtgtgtataaaaggcagaccctaatggcaactgcttaaacttcactttgtctcactttcagttatttagatctttctattttccactccatagcaaatcctgctaaagctcagcatgggcactggaccagcaggcagattttagctgctcaggttatgctgctgatgtcctgcaaccgcaagatacccaacccacctccagcaccaggctgtactcatgctcctctctctcccatactttgacaaggcagccctctgactcaatgctactctgccactatctcaggctcatatcaatctcctattcattcactcattcattcaattaacaagtctttatagagcattcacctgttgtcagctctgtgctaggggctaccagcaaagagaggacacatccctgagctcagggaacttttggcacagttagagaggcagataattcaacaagggcatgccaagccatgtgactggaaatatgctaaggaagataaaagtgctatgatggcatgcaatagaggagcttaacccagtttagggagagctgagttgactttctagaggaagtgacattctaatcatacacctaaaggataattcagggttaactgaacaaaatgaatatgcttggagtagaggagcatgagggaaaatggggaatagagagaatgtcccatgaaaagtccccaaagtgaaagacagatggtgctcttgagaaattttttgtaattataagttcaatatttttgaataggagagtggacaagataacttcagaaggtaaggagacttcttcaaatctccttgctccccatgagagtatttgggcttaattattagccaggatcccaacacagggcacgctagagtgacattgcttatccgtaccctacttttggaatcctggttcattccttctatccacatgcccaaggccagttcaggcagtgaagattattttcaaagatcttaattgaggtttttatcacttctctgttaatatagctgttatctctgcctctgtcttctccaaattctgtcacattgacctcactatcctcaaaaaactatgtagtctagtgggatggattagatgtacatactaggtaacccttatgaaataagatactcatgtggttcattctcagggtaattccaagatttaaaaaaaaaaaaaaacagagtgatgcaacttagatgaatttttaagtaagtcaaggtgtttcttgacttaaacactaaaactggagtgtcttaaatgcagaaaacaggatccaaagacaaaatatatagaaacacttattaaatctcccttctttacaatccacttaacctcacatgtcactgctaatccagcgcttctttttttaaacattactctcatacccctgtcccacccctgatttataaagtttatttctccaagaaaagaacttcttccccagatctagcactcatgttctctttacctctctctctttttctgtctctgtggtttagcttgtatctgtttggatgctttgaactataacagaaaatatgactaaaagtggcttaaacagtaaggatgagtatatttgtaagagagctcactagatttctaacaaaaacttttccccatatttggttcagagatacactatgtctcccagcctctcttgaagttagatgaagttgtctgtaaatttttatgttctcttcaatagaatatgagtggaagtcgtatgtcacttcctggcctagcccataaaaacctcctatgtggattttcccatgctatttctctttcccatgacttgatgcaaaagagaaggcagagctacagatgaaaaaaccctgaatccctaaatgaccatgcggaaaggaaatatcctcactgacttgaataccactgaccattacatgaacaagaagtaagcaattaccttaagttactggatttagggggtataaattttttatagacacttagtctaccctaatacattatttcactatacaaaagaaaagagataggattgagttagcacctcaattgtggattttctacttgttctgctctgctatgttctccttggtgtgttggcaaaatctcctaccatggctgcaagatatctgtagctgcaagcataataccctcacccaatatgtatggaagcaaaattagaaggaagatctatatatccatatctatgtctatatgtgtctatctatatctcttattggaaagtaaaactttctctaggacccctcagcagacttccgcatcttctcactggccaaaactgagtcttatgttctctagtcattagtaaaggaattgagagcaccatgactagataaagctaactctgatttttcccctatattagttccttctcacactgctataaagacatacctgagactaggtaatttataagaaaaatggttgaatttgtttatggttctgtggactgtacaggcttctgcttctggggaggcttcaggaaacttacaattatggtggagggtgaaggggaagcaaacacatctttacacggtgtcaggagagagacagagagaagggggacatgctacacactttcaaacaaccagctattgtgagaactctatcacgaaaacagcaagggggaattccaccaccatgatccaatcacctcccacaaggccccacctccaatactggaaattataactcaatgtgagatttgggtggaaatacagagacaaaccatattatatcctaagactggagaaatacctccttaactaagggcgctgatacctacccaattcccaaaatggattctgttagcaaagaagaaagaaggaactggtgttacatagacaatcagaaatatgacccaaacctgcttcttccaagtatccaaattctatattatgaaggcctaatgaagtagtctgtcattaagaggatcctagtaggaattataaaatgcagataggcaaaatctaagtttctttaacagaatggggtaatgggctgggaagtctaataaatttataatatctgttgtgctataaattataatgcagggcatataatactaaatggtatagacagaaacacggataaaggactacagaaaattaaaggtgaaaaagagcctacaattggaaagattgaaggggtcatttgaaccaggccttaagagatcatcattacttaatagaaatatgggaatgaagttcaagtgaaaataagaacataatcaagtgcacataaaaggaaattctgagaagagaggagaatgaagtagcagagagttcatatttcatgtgcaccaggaaggctggagagcaagcatacagacagccataagaagaaggtttctcaattgcaatatttatcttgacacttcaaccaactgctttccttcatacactcaaagctcttcctccaggagactgtgaatctgaggcacctgactttgcccagatcttctcatttacctcagcgcttcagactttaccagatggataatccttgacaacaaccaaccaaagtcacttcccatccctctcccaaacttaagagaaagtttactctatcctccattccagcctagtatctgctataattccttgaagagagcctcctgacccctctcaatttgatactataacaaaaatgatgttcactgcttataaatttactttgcattcagccccaactcattgccagtgctgtaccaatacctctagctatattattttatttcattttaattccaatatgatgatattgatattaatgtgtccattttacagataaggaaatgtaggctccaaaaagttaaatcattggctcataatcacaatgctagtatgtggtacagccaggattcaaagccagatgcatcttactctaaagtcaatgatctttccataactccgcactttactgatataatggccaagctacatttcataaaagggattttctgttattctaaccttcttcaaagttgtcagtgctgttcctatatcagaagttccagcaggcagtacatcatagaaggcttttaaagcagagaataaataagaaaaaaagagaagagtttgacacaatcttagacaaggactgtaatgatagaaggaagtgaaactcatttaaagaaactcatttaaaaattggttttaggatttcataagaatctcatggaatccagttgcaaaaagtagaactttgggaattggactattcctgagtagttagtctctccatttctctcttcctgagcccctgtggcctctaggtccaggttggcattggtcatatgcttcattcttctttttctggagaaaaacttctatgctcactcagatacctacctaggcggcagcctcactcagcctttgggtcaatctgactttcaaaatcaactccttaaaaataactgactctcatcttttttccaatgcccatgcaaagaaaatactaactcccatcttgattaaatattctcccctagcctgtttcactgctgtcccatgaattatagtccttcccttctagaacttcaggcaatacagattgtctaagaagaaggtatggtggtgggtatattaggaaagtagggaagagttagttatggtggaaattaatgcaatgtcttagactctccagaaggctaccactacagaaaatggcagagggctcagaaattaacacagaaaataagtaaaccactccaagtcataactataccaggatggtgtatattaatatttattagtcttagccactatttttaagtgcaagaatacgtcttatgcttatgaaatatattgacagtgtgttttaaaggattctaactaaggcccatggcagccaccatgtttttataaataaagctttattggaacataggtgtacccattaaagtatgatctattgctgcttttacactgtaatagcagagttaaataattgcagtagagatcctatggctcataaagcctaaaatgtttactatctgtctccttattaaaaagtttgccaatacactgttctgtataggatcactattttcaacaattaatttacaaagtcatttttaactttctgaagtaccacataaaaaaaggcttgggtttggtttttttttttttttttttaacaataatagagtctattagagttacataggccttatatagaaaatggccttttcaagcttagcattgggagataagataggtctggtctcagaaaacatagaattcaccaacatatgccagtgttcttccattcttcacagtacttgaggagatattttggaggttggaggtaaccaaagctttcaattgaaaaataatatggctaggtgctgtgactcactcctggaattccagcactttgggaggccaaggcaagcagatcacctgaggccaggagttcaagaccatcctggccaacacagtgaaaccctgcctctactaaaaatacaaaaattagctgggtgtggtggtgcaagcctgtagtctcagttactcaggaggatgaggtgagtggatcacttgaacctgggaggcggaggttgcagtgagctgagatcacaccactgcactccagcctgggtgacagagtaagactccatctcaaaagaaaagaaaagaaaaataatatattcatgggaagcgaggggtatgtgtatggttactacattcaggtaaagtgtcacttaacagattaccattttcaccccttagatacgcataaataccatatcttggacttgaaaccagaatatctgatgttgaagccctggctgctactcttacaaccatggcatgtcagagtttctcatctctcatctgcaaaatgcaggacctttaatgagatcaaatgcaatgaagaatgcaaaagggtttttataggcagctaggtgcagcacgaaatgtaatgtgtaattagggatggttagttaacattccagccaacctttgattacatttaactctaaaatttctgttgtctagggccctagacaatagcaaaatacattcttaccacaccatgtaaggtctaggtttcaggaatgagagagaacaaatatttgtgtgtactccctctgtgtaacttccttggaatacatgatttcctcaaatcctcataaccaccttgtgaaatatgaatcattatttgcatttgacagatgaagggcaaaagtttaatatgtttctccgagtcctttagggtaactaactcatcccagtttgtctgggactctcctaggttagcacggaaaaacaagtaagctgggccgggcacgctggctcatgcctgtaatcccagcactttgggaggccgaggcgggtggatcacgaggtcaggagatcgagaccatcttggctaacatggcgaaactccatctctactaaaaatacaaaaaattagccaggcttggtggcgggcgcctgtagtttcagctacttgggaggctgaggcaggagaatggcgtgaacctgggaggcggagcttgcagtgagtggagatcgtgccactgcactccaacctgggcgacagagcaagactccatctcaaaaataataataataataataataataataataataataataataataataataaaaaaataaaaacaaataaccaaacaaacaaaaacctctcagtcctggagaaaccacaagagctagtcatcctaaagggaatagcagtagacccaggcttaaaactcagtgctaagtgtctataatttgtgatcttagtagcttacttgtctacacactcaattgttctcagtgagcccattttataatgatgtctctattggatgtctatgggcagtgaccaagaacctgttcactcacacaatgggtttcttagtccttagtgagaaggatattttgctcacaaatgctttaaacacaacagaggaggggcccagccagaggtattctacctaaatattttcctttcattattattagtgcaaagcagttggattagtcctcctaccattttctgtcatctctcaagcaaaaacctaggatgatgttagaagatatctgaaacactgaatggctgtaaaacagagggttggagagcagcaaatcttgtaataaattcagttattctctggctatttctgtcccacatctatgcacttacttaccagcagctaagtaggatcatgcttttcactttattctaatggaaacatgtttctaagtaaaaagctaaaaatgattatactgtggtagaaagagacttcaacatactaaatattaatacctctggaagaagtactacctgctaggttctcacccaaacctaatatatgaagaaggagaactctgagtactacctgctaggttctcatccaaacctaatatatgaagaaggagaactctgaggactatagagaataacagattttacactacaaccatctctcccacttatatttccagcccaaatccttcctctgaatgtcagacttatatctcctgctacttagcagacatctccattttgatgtctctctaatagctatctcaaacttaacatgtccaaaatcaaattcacaggctgcccttgtacgttgtgtgtcaggggaccccccagtccacactctggcttgatgactgactagaagcactcaccggaatcagaaaagctcttatattcaggcgatggtttattatagtgaaaggatattgatgacaatcatcaaagggaaaaagtgcatgacctgctgtgttaaccctttcctgtgcaacttgattctccctgtcttccttatatatgtcaatagcaacctcatttttccagacaatgaagtcaaccttggagtgattcttgactcctctttttgtctcccttatcccacattaaatccatcagtaaattctgttagttatacccacataatttatttatattttcaaccacttctcccaaccttgatccagggtaccattctgtatcacccaggttattgcaatggcctcttacctaatttccatacttccatccttactttaccacagtctactctcaacacagcaaccagagtaaatcttttataatggaagtcaggctaggttccccctctaataaaattctccactgccatcctatttcaatggcccatgtcaatgtcccagaggcattcccccaattacacttctgaccctacctcctcctacactctaccatgatcactccttatcaagccatagtggccacttcactattcttcaaacacatgtagcacactcctgcctcagggcctttggacttgctattttgcctgcctaaaatgctcttccccaaatatctgtaatgtctattcactcgcctgtttcatgtttctgctcaaatgtcaacatattggtgaattctactctgaccattggacgtagaagaatatgtctaccataacttgacatagcccctatcctgtttattttatgctacatacttatttaactaaatatttactgtctattctttatctggtttataactagatataaacttcatgagggcaagaatatatttttgttcactactgcagcttcagtgtccagataagtgccaggcacatggtttataaatatccacggaattaatgaatgtggttcccagacaagcagcatcagcaccactggggagctggttagagatacagattcttcaactccatctcaggcctactgaatcagaaactctgggagtaaagcccagcaatctatatttaacaagtccacctggtgattttgatgcaaataaagcttgagacccactgctcttattcttacaccccttatgtacagataatagggttggaggggctaaattaatctctggggtgacacacctggattgtaaccacacatatgtctgtttcctgaggctgcccactcaaccacaatactgtgatggttgcattcgaggttatttttctctcaaagaaacgttcgtattttcctccttggaaggaggcaacctgcgcaatttcctactctcaaggcatagtaacctctactaagcagtgccagaatggggcaaagactaagatttgtcaaaagctacctccctggaggcgcagttgttttttggaattcctgtttcccctgcgagacatcctctgcactttaaatcaaaagagcaaaaaatctccacccactggttctgctaggacacttattccggcttccctcattcccagccaagcgcatccaccactgcagcctcaaaattgattgttaaaagaaacaaataaatggagctctgtggacttgaaaggccttggtgacaaagcagacccacaagccagactcagtcggccccacctgtcaacctgaaatgctaactgcagggctgggggaagaagtccctttgagactacctacaaaactgctattggaaagcaggaaagcaggaaagcatcttccctctgcagtctgtgacctccccactgctagtggttagcaatgccacatcttttaaggtgcttagtccttcttggcttcccacgtgcttcctttcctcctcactctccacgtttaccttcagtaataaacagtgctcctggtgaatcttagtaggaaaagaagcctaatcggcatagccttccctcaagattcaataaccataacaaggaagacaaataaagttaatattctaccctgttgctctcacataagccaactgcttcatttcctccttaaaattcagtctcgcttagaatgttttctgtcacaccaggcaatctcctgaggttgaaaaatggcaagaggaaattgtctgcacagacccaggaacctaatccctttatttatctaaatgctaatgcccacagcccagcagaccaggaaaggagaaggcaggtgggggaggtccgccatctgactacttccaaacctcagttagaggtggcaaagctgcctcctcttcagcactgagcattgtggctaccaactcagcatctgtttctgggagtgtatccacaggaagaacttgcaagaggaggcaagaaagcctcagcacagctaaatatccatttggggtcctggaggctcataggaaaaatccattaatccaggaacatgcatcctgcagccactaagtctcaaccaatgaagtaggcataactgccttttcaccatggtatagtttctaaaaaagcagcaacataagaaatgaaatacagaatagaatagaatgttaacataaatagtgtggcaaacactttaaatatattggttcttatgtgatgcactccaatttcccaagggttatttattcaaatatgagaggctgagaaagtataggtaaaagagcattaagcttggacgctagcagatttgcattcaaatgttgcctctaagacttactcctggctattaccttgagtaagtcaattaaagttactaggcttcagagtccaatgtacagaaggggccactgtgagcaatgtcctggctgcacgttggactcccctgggaaattcataaaacactgaggtcttctgtgatgtaacctggtcagtggaatttgttgaaaactctcccagatgattctcataagcagtagagtataagtgctactgattgtaaaacgtgaatgagttataaatgtaaaaccctgtcagctcttgataagtgtccccacaaccttttttaatgcttatcgttacttctatcagagaaagagcccagaaacagagagtagaaacactctaatcatctaatcgtgtgatgtgcagcttatttatatctaggcaaaaacactgatggtgtaactgctggccaagagtattttgaggattatctgtggatttacaacttttttaggtcatccaccacatcccatgacagacagcaggcagtgactatatttagcaataagacgtgttaataaacttcaaggtgatgttggtgatataaccataaaggatgtaagaaattattattaggcccataaggaattaaggaagtgtattttacccttgtgagcacactgaagattcatgcctctaaaattaaacattgaattagcttaaaaaataagaagtttaaatccagtcatgataactacgtatttaacctatttcccagttgatatcacccaattacaatattcttaaggctgggataactgctccctaattagagaattctaacagagcttaaagtactattcctgctctgacagctgacacatgaaattcttcattttctgttttggcctacaccaattctcaattcctttcttctcggttctctataaaattttgtattcattttgaaaaatgaaacaaacaaaaaagataacatgaacatctcagcattctggtagcctgaggtcttcctaatctcttggctctctaacacacagacaaataaaaatggcagtgataacctggaatggtaagtggactcagagtcttcaaaacccagctatgaataagctaagtgtcagagagcattagtcatacgttaatttgaaaatgcaaggtgtcgtttatactgcactttagcaatgttcaacgcatttcttatttttagtcagaggaattaatttatgcttgttaattgtaaggagatatgtgttttagttctctatgacaaaatatctgtttagaatattttgaggatgtcccagtttggtatacttcacagatcataccccggcactgtgtgtttctatatggtaatgtgcacggaagggaggatacaaaggaaactcaagtagaaatgagtccggaggattgatgggtgaaaagctaagggctttgtgggtggctccatgaaccaggataacacagaacatgtccattctgagaaccgaccatgaaataaagcaaagaaggaaaccaggcagtaaatggcaatccagccagagtccgaggaaccataaacaaattgaaacgaaggagcatgtggacaaatcctaaagggaataatggcagtaaggatgtgcacacacaagagacaaaaataaattctacccagtgcctgcacaatcaaggaatgaattacatgttttagttcccttcgttctatatgcaagtctctgaggacaacctctaatgattcctgtggacatgcgcatacatttttcccttttctgtcaatcataagctcagaaaggattgagaatggaatgcactggaattttagcagcaagcgatttatggagaacacacataccagaactaagtgggtcaggggtccaagaagataggcttagccctaaaggtgggcccacgggggtcaggtgaactgtaataaaaataatatttacattaataagtaatgtgtgactcaggagactgaggcaggagaatcacttgaacctgggagacggaggttgtggtaagctgaggtcgcaccattgcactccagactggttaacaagctcaaaactgcgactcaaaaaaaataataataataaaaataagtaatgtgtgatgaatatgcacttagtactttaaatgatttattcttatttggcattctcaataattttactagtaagtcaagattttttgagctacaaaaaacataaccctctacctaaacttacttaaccagaatttttttgttgttattgtttgacacagagtcttgctctattgcccaggccagagtacaatggtgtgatcttggctcactgcaacctctgcctcccgggttcaagtgattctctcacctcaccctactgagtagctgggattacaggcacgcaccacgacgcctggctaatttttgtattttcagtagagacggggtttcaccatgctggccaggctggtcttgaactcctggcctcaagtgatctgcccgcctcagcccctgcaaagtgctgggattacaggcatgagccactgtacccggcaaaatttatcctcttaaaaaaggaagtctagtaggtcacacttcaggattgggttgacttggtcctttaaccatgttatcaaatacctcagtttcaatctgtccccatgatgtctcatgctcaatgttggctgtatcctcaaagtatagcaaaatgactactgcagcttcaggttttcacacccagtatctagatggaaaagggactcctcagccctctcttcagggtcaaggaactgcccagcagaagacttcctcttccctctcagtggatataattgggacatgtgtccattcttaaagcaaagggtgtgaggtttactttgcctgaggtgcatggctctgtggaggaaggatataggcctgcacaaaactagaattcagttggaaaaaacaacaaaggaatggatactgggtaggcggcaaaccatggccactatgtgacaactattgttatcctctgaaagagaaaaggaagaccagggaaaattgaacacacttcccaaggtcacacagcggtcaagaggcaggaccaggatgccttcccaaaatgtctgatttcaaagcctaccccttaggcctctggccatatgcctatgttgataaaagaggagggaaatgttgaaatcaaaagatactacccaggaatatctggcagttatcttgaaagcagacattcaaggtcctagagtgctttggcattggatcccttgtgatcgggactctagccagtagctgtaacaaagggagcaaaattcaaccttctcaaatgatcaggccaaaaatgagacggagaattaggatcctagacatgcacacaggctgaggcactgcagcagggtgaagataagctcagcagataagaagaccccactacctcaggccgcatgactaactccaggccctgggaaaacagaaggtggactgaagttgtggtgagacataacccaggcaggagatgaggctcatccagcaaatcagtgagcctggagaagctagaagctgactggggaagtcaggggctgactctggttgtgaagctctagtccactttaaaactagcaaaatgggggaatccgcagtcctagaactttgcaatttccttaggagttgctaaaatgcataataggcaacaggcacccacctttcaccaccacaagcctcaaatcagaaatggactattaagtacttcaaatatctacaactggagcaatggaaacagaagtgtaaaaataatattaatgataataacaaggtcacagtgggatttttttcccagtagggaggctgacaattactcaaactctgtatcatgtctaaattaatgacataaagatttccttcaaggacgtatttgatactgaatttttagaaccatccttgaaaacacactattgtacttcaggcccctactcgtgtctgaatatgatcttttctgactgcttctcttagacatgagggccctcctctaattctgttcttgagaagggaatgcctaaattagtcaccttaatgcaacctctgaaaacgcaagggtgaagaaccagtactattctccaataattgtattcctatagaaaacatctacacatttcccctcttgggtgaaatcatttatatttaaatcaaaacaaagcaacgtatgaagcggaaagttgagcaagaggctggctcatttaggcaccagggccccagtttctctttaattatctggacagtttgcaaacacgaagagtgggtaggaggtgatgtaaactctctgtgtatcatgatttttttaaaaaaaagttttaaacgaatctttgtattattcttctgcaattttcattcactgctatcctgtccctgccattcacccagcaacaaagactttctgctctacatgctgccctcagggtaaggttgttacagcaaaaatgcattgaaaaagaaagagtagttgcacgacatgaaattccaagcacacttctgaggtccttggttaaaagaacaaaacaaaacaaaaaaaaccagttgcttttaaagaagggaatttctttgcaagaacctgcatattcagattagcaaaagaaaagcattttatggttaataatagatttgaggatgaagagctggctatccccatcccgttctgagaggattagaaagaatagctcagggagagatgtgtgtatcttggagtgggcaaggggacacagtgaggaggtgggaagtggagaggctggtagggaccttgtgaccagcagcagagttagtgtcacaaagctcctcagagttggcctggtagaggaggtcggtgggcaatactagcagttatcaggagctgagtcagtatctagagatcctccacttgccaggggaggatgtaccatactattacctctaccatgtaccagttatccttctcaggtcatcaataaacaggattcagcagcagtgatgagcctgtacattgtccagcaagagtaacatcatttgatccctcccccaatttgctcagtggtgtctgaattactccatgggtcaattgacccttgtcaatggcccagagcaaatggcagccacataagatgctcctatcctcctgaagataggaacctggatgcctagaaagttgctgatgttgaagatgggaaagactctactagggtgaatgaacaaacttgtttgagatcccctcttaagtccctccagtgatgaaaggatgttatctcttcaacattgtaggcttataactttggcctatgtaagccaagtctacaacaacagttataaacctaacatgcatcaaatctcctccaataatattgttgtaggactttctccttagttcagctaaaaccaggttcttgtcacatgaccatgaaagattaggctagcagacactttgaagggtgagaacagcagggtttactgtgtaaaaaaaaaggaaaaaaatggaaacaggtactctcagcaaagcgagagtgctgttagtaggcttcctgcctcacagattgaatcccaggttcccaccccagatcaggagaggccaggttcctccccactgcaaacagcacaagcttccatggctccactccattctcccagtgctcaggccactcagagtttctccagggaatcctttatccttggctgtcttaatataataatttccttcagctgccacaagtgctcagagatttgacctgaaagactgaaagttgttccatttcaatataagtagtaatatggggaccaaactttccaactgaatcactcagcacatcccagcctcagaaaatcccacgacctcccaagaccttgcctgccagtgagacaatgacttaacctcacaggcctcatttcctaatctgtaaagtggaggagttgggctagatggtttccacaataacggcttctatgatttccagatttctgggctggactccaacagaaatctttcactttgatttattcttgtctccaggactaaaagctgtgaagctaactggcaatcaccaaaaagatcaagaactgcagaggagaagaaagccatctgccactattaaagatacaaccaacacctggagttccagtgactcctgacatcccgatttccttggaagacctggccacctcctaactgattgatgacccctgtgagaaacaaaaaaacaagaatatgagcgagaggggaaaattctttgccaggttgtcactgcagagttaacagaagagttttcttcttggaggtagggtacgcctcaaatgtgagatgagctctttcttataattcattggtttggggctcatttatgattccttagtgactcatgcaactgatgtgaaattcctgaggtttctagaaatcagaggtcatacaagggtaccaaaggccagattaagcctgtggacatgatttatttagcccactcagggtcttaatacttttaaaataaattgccgatatttgccagagagaaaggcttagcaattctattggatctcagtagcagaggacaagaggtctccacactcctctcaggacatggggccttcattcacctcagtctccacctgctcactttaccttgcatagtcctggcctgcccctgtaggcttttgaatgtgtaaaccctgttgtgaaatcacacatatagatcaaaacccatatcctccagcctggagggttctaggaactcacaaaataatttatcgactttcctgtaaaattctatgccttttacatggataagtaacactatttcatttaagtagaacttgaagctgtttgcatgagaacagttggcagtttatgctgagattcctcacagtatttttggggggtgggtggggggaggcatgtggttagtaaaataaactccatggggaataacacaaaacttccaaagggagatgtccctgagaagactttacagtgtctcctgatctccagtgattttctcatgccctctcctcccatagctagatcctccctccaatatgtgttacatattcaagattatagccctgattgcattgtactgtaattatttgattagaaatcaatcaacttttctcacctgggagcttttctagaggactaaaacacaacacctgaaatacttagctcatgcctgacacctaataagtgctaagtagttgagtcctcaaattgtctaggagctgcttaggcagttgccacacccgtcacccaacccaggggcatttccaaggacagagccttgattcacattatgtacgtatgtgtgtgcgtgtgagtgtgagcacaccacagtcacaaactgtctgtggcctttgtccctgagatggcaaattagtaggaataaaaacaagcacagtcaggttatatgctagtgcccccagagtagctcatcttccaggtagcacattccccaattcagctctccccttctctaacacagttcagccctgtcaagcttaccaacttatgtggccaacacatcacctataaggtaaagttccagtcacttggcagacattcaagaacctttactgtctcatctcaacccacttttccaattacttgccacgtgtcccccgcttttctttttctactccctacctttgagaatctacaatgctctagggccctaaaatgctgtggcaggttccccagcagagccatatttttaacactgccatgtctttgcccctgctatgtcctctgccagtaacgcccttgctccctttcatcatctggtaccagcagaacatgtggttaatgccagcttctctggcacagtggctgagctgcagaaacaatgcctgaacagttgggcatgtgagtgcaaagaactgtatgcttggaacacaagtgtgggcctccattattgcttatgcagtgaaatgaaggggtagatgggtcatcatgccagccacaaacgtgtgagatcatatggcatcggcaggagcaatgacagccaaaagacagggctgcccatttctgaccagactccccagttatactgcttcctattattatgggtacatagtagcttcagtgatgaatatgcaaaataaactatctttagctaaatgtagacatgaacctgatacagcaggtggcaccttcttatgtgaatgttctctcagcaaacataccaccctctgtcctcatcctggaagaaacgacttgggaagtaataaattttcaagccagactgtgtattctctatctgtggtgcgagactggaaaattctgttaaatagtgaagcttgcatttttgagcttttgttatatgttaggcagtttgctaagaacattgcaaacattaactgacctcatttaaagctcacaaaacaccataaatcatgcctgttcttaaagagggtacagagatgcctgtgtgtttatgacctaaagacccttgtttggcttgggcaatgcagcatgcagtggttaagtcacatccaatagagttctaggaaaatggcttttctccattttggcctgtctaagacttttcaagagggagagagaaaagcttgataactgcagtaattttgctgcctctgattaaaaatctgaaaccaaaggctgcagatgaggcaagtaagtctaagcctggtgtattttagtatttcagcagaagaggagagttagtgggcagatatagaggtcacaggcccttccaagaggaaacggggcccattcaggacattccaactgtgatgtgggcctgatttacacttaaatatatggccttgagtccgtgtctgctgggtttccctggcagctttgcagtctataaaatgaaggcaaagaagcagaaagaaagaacattcatatgtattgtgcataccatgtgccaggtactgtgggagtgataaccactcagttcatcttgtttgatcttacaactctaccaggtggagaatgttatgtctgttttacagatgagcaaactaattcaaagagacctcctatcttcatccttctttaggactttcaaaagcttgggtcagggagtagggaactttgatctgtttctttctctcctcccgagataagctagccaaggagacagggattagggaaagagcagtcttacgtggtcctgttgtgatctggctgtaggaccagatagttcattctcatatgaatcatcataagtcatatgaatatgatacagcaaaagttatctatcacctactaagtactgtttcaggtactcgaatacaaaagcaaacaaaagagacatcaacccttgcccccgtagagctttcattctttagctcaggccatttctgtgggttcttagggactccccatcatttgaggtaggcagtacctctcctcctctacttgcttcctgccacatcagcatctgaaagggcacttccagccttttagactgtggatgcttaagaggaggagcttttcgaactcagccccagcccactcccttctacagcccgctttccacaagttcacttagccttgctcttggaagttttgtgtctttgtgccttctccaggagagtggcaccagccattctcttcacctctggtctttaccagacggaaattacatgccaaggcttctgttgtacaaattacaggtggtgtataccaaggcctttgaggagacactttgaaaccccatcacttggcttgaggtgagaggatgcactctcctcctgattcctatggagaatgcagagaagaagtctattttgtcaaaaaaaaaaaaatctcctctccaggcctcatcaacttttaccttttcatggactatgtatctgcaatgaccaatgctaaccacatgtggcttttgagtattgaaaacatgattaatccaaattgagatgtgttgtaaatttacagaccagatttcaaagacttggtgtgaaaaaaatataaaacccaaaagtaaaatatcttcttaatttttatattggctacatgttaaaataatcataatttgatatattgaatcaaataaaatatattattataactaattatgtttaaaaacactaacaataacaaaagaaccacaaattacctacatggctcacatatttctatcaggtgtcactgttgtggatgaacaatctaatatgcgaaaggaaccagtttcacagcctgtcttgcatgtacggcctgaaatctctactgagagcttgcagtattgaacatctattacattatattgttttagggctttgggggctcagacttcacagaaaattgaattgttacatcattttatatatgtgtttctctgaatagaactgcaatagttttctttagattctttataggtctatcatcagatttttttatgagcctgtcattctttctcaaaaaaattaataatttgtgtttagtatattcctaatatattgttggatctaatgcatcagagaccattaaaacctaggatacaagagaaacacagcaggttcttggtctacaaacccagtagtattcccaagagttttaagaaatgcaactaagcagttgcctgccatccatatatggcactctaggactgagactcaatttttttctcccttacatggtgtattttagtattttactattttcagatactagatatcatttctttttaattatactttgttatttttgcctctaaaaatgtaactccattaattaattaatccccaaagaaacagaaacacaagaagtaaaaagaaatatgaaaaagaaaagaaaggtagtatcatccataacccttagtcttagtgaatctggattcatttgggggatcttccttttgttttttttttgtagccttgagtaagacatttgacctctctgagcctgttttctcatctgtaaaatgtgcataactatgctatataaaaaatgtttttgagaattaagagaaataattaattggaagaattttaggcatgttatcttgtttttctaatcctatcaaccaaacataaacactggtaatatttttgtatattttcttccaagtatttttccaatgcataaaaatttgattgtagtaaacaaaatatagacataattttagtatgtttttccaaattactaatatgaagtaattttagacttacaaaaaaatgtaaaaataggagtttctgtatatcatgcatctagcttccctattgtaacatcttaagtaaccatagtaaattatcaaaactacaaattaacatttatgcaatactttaaattacaggctttatttggatttcaccaggcttttgactaatgtattttataattgataaatgtcttgtggcggatactttggtactatgtaaatatcctatttctcctcaaacttcttccattaatttttgcatccattggtgcctctttccttacctgcaccattgttaataaggcattctacttgtgattttctatttccttcattttttctgcatgttttcattggaattgctctgtaaggaagagccgccccttctccccttctcctacttttgttcatttagatattattgtatcactatggagtcatggatctggcattttattatctactcatgttaattattttgcttttcagattgtttcagctcttgcccatgggtgtttgtttactttggctcctgtgcccttttaatacatcctcatcctttttgaacacagtcttactatattcttgtctcctcccaggagcacatgtgttttgctttgttttcttctattcccttcccgcagatacagtgggttttcaccagtgccccatggcaatgatttctgttcttcctcctccaggctaagggttttgctccatagcaaagacagagagcagtgtttaagggttttgtgcctgtcctgtagtcactgctttttatcttccctaactagcactaggctggaagttttctcaggactcttctctgtgtttcctgtgagtgcctggtgtgtttcgaaaagaaaagtctgtaagagaatataaaatctcactatggctgcagccccaggagtttcatactgtcccagcagcccatatttggcctccaccaatttgtcaacaattccagctgaagtcttcttgctggagtctagtgctaagctccctgcaggggcctgcctatctccagattttaggctaatttgttgccctataactttagtcatctgacaggtttaagaaaagttgagaatttgtattcactgtctttaccattgctggaagcgttggagtgatgctctttccaactctatattctgagtagaacccaggagacccagaagggctaggagcttacattcgctcttcttggcaagttttctgcctccctgggtcatgggcccaaacctcattagcctaaccttcttgcttagtaatcatcctaaaaacatgcagaactccccaagtgctattaagcttagctttttataattacacatttggttaacctttagacctctctgttattcttcaatagctgcttcttgctattctggttgaaatccagggatcttagaatagcattacaagttcttagtgaagatgctggtaaaaacagggatttagagaaaactgctgatgcatcccagccatgccagaatagagcaaggggctggtcagagaaggagaagtcaatctaaaacacttgtgtttgatcagtattgggtgcctgctatgtgacaggtacatgccaggcaaggacacgaattagaatgacgtgagtcttgcctctactacatcacagtccaacacataaacaattttaataaactgttataaatactataccagagatatgtacaaatgttataagaaaatatacagggaagcaattatttttcttggggcattctcagacagcggagaaaagggaaagcagaccctgagataagaatctgagggcaaataatttcttttggaaataattcccaagaaataccagcgggaaagtgggcagaaggaaaggaaaagaaaggacactaataaagggcatgttaccaaggggaccaatcttgctgcagagcctgggggccagtgtacaacagacactttagagttattctgtccaaaagcaatcctactggttacggatgagaattgctgaggccagggagccagatattaagtgaattctcctgtgcttgcagtgagccttgcacaggcaaaatggactctgtgacaatagagggctccaaagcacagtcacagggactggcagttggaagtcaggttgacatgcacagaaaaaggagtcaaggggacatgggtggacttctgacagcagtagctacatcatgtgtcacttgaattgagcattgaaggatgagtggcatcaaagagagaagtaggagacatcaggcagagggaccagcaggagcagaggatgagagacaatcatgtcacaatgtggtcaagagaagatgcatagtttagagaggagagaacattcagaaagggggtaaacaagccagatgtggagggtttgataattattctgtgggcaacaggaaccatcagaaaggagcaagtggggagagatgaacaactgaagaatgagaggggagagtctggtcaagaacatgttgtgataatgtgtctttctctctacctttcttgacagtggcttgggtgagagtggtagaggtggacaagatgatccgacattggatcctggatatattttgaaggtaaaggcaacaggatttgttcaagatatgaggaatgtgggatatgagggaaagaaaaggacaagataatcaaaaagctaaaagtttgggaaactgaaagaagggagttgacatttactgaggtgggaaagactgagaggagaaggtttgagagccagaaaagcaggacaactacaggacatggaatattagagatacaaagtaaaccttgacatgaagctagtcagttgcatagaggagctttgagcacagaagagagcccaggctagctacaaatttgggagtcatcagtacatgggctttggatggtatttaaaggaggatgtgagtgtagatggaaaagagaaatcactgcagtccccgggaactccatatttagaagttctaagaacaaggaagagttggaaaatgaggtggaaaaagagtgaacaagcaggtaggaagcaaatcagaagatcatagaatcccagaatccaaatgaaagaaatgtttcaagcatgaaagagtgattcacatgaaacagtcaccagatttagcagcatggagatcactggtgactttgacaagaacagttttgttgatgtaatagagatgagaacccaagtggagtgggtttaagaaataatgggaggagagagcatagatactgtgactacagaaaactttctgaagaagttttgccataaaaggaaaatgatatggaggctggacagtgagtggaattaaaatacatttttaataatttttttaaagagggaagacatcatagcatgtttatatgtatgggaagagagggaaaactaatgatggaggacagagagaagacagttccctggagcagcatatttgaattaatgagaagagatgtatctagtagataaggaaggggttggttttaagaggaaggctggtttgaccctgggagcaggaggataggtagagtgatgggcactgatgcaagaatttaggaagatatgctagcgagaactggtgaacattctcttctggttgtttctggttgcttagtgaaagagtaagcaaggtcatcagcaaagattgggggtgggggagaaggtattacaagtttgaaaagaatgaaattaagtgataataaaaatcaaataatgaataacaggaggttatgagagtaaagggcctagagcaacatagtggtactgctaggctgcaccaagagcccatttgacattcataagaccagctagcaggttctggccaggctcagctacattggtagaagtgtggtatagggtgaaagtttgttgtaattaaggtaggagtttcccagattataaactttagcatgaatgcaaggaagtaattataatgatgaactatagaatctttgttggatagaaataaggctacaagggatgtaagggatggtggaaattgacaggatcaattgaccacaggaccaatgaggtgaaggaaatgttgaaaatggggtgtgtttaacaccattccaaaattcaatggcttaaaacaactacaattattctttctcagttagttacagttcaacctaaactgattcatttaggttgggctgggctgggcttgcctccaagctgcaaactaagccagatttgcttcacgtgtccctcattccccttagaataccagacttgtctgagtactttttttttcatggaaacagcaaacttataaggtgcaagtcccatcacacaagtacatgccaaaccactgcttgcagcatgtcctgttaatatccatcggccaaaataagtcacatagtagagaaaacaacaatgagactaagaagctataagtacaaagatccacccaagtatatgtcacatcccatcaagttggcagtctcaggaagttgcacacattatttttgcctagggtcaacccgcccttagaatgagtgttgaaaaggaaaacattccccttggaaactgggccaagcttgagaattctcaggtattttttatattacttctctgtatataacataatgacttccctgcccagtaagaaatcctagattgacagctgtgacttttctaagaataatatatgtagaacaaagggaaggaaaagcaactgggccctggaacccaaatccagaacatgacatcatagtcaggagggaatgtgtgtgtgtgtgaagagcagcagcccatgcagggatgcactgcatatcccttgaggtgccactcacaaagattactgtgcaaatggagcctctgacaaggatgcactcacagtttccctgaatatgggtggggaataaataggggttctaggaaaagtaaacataaactgcagcctattcttctttcccatgagaccacctcgtgtataaccagcatagtgcttcacaacagtagttataataatgcctgcaagtgacaccagtaggtcactttcagcttgcataaagtttttcagtccattactgtattttttccttataataaccattttagtgatgaaaaacaaagttaggggtaggaagatgggaaaacaaagcaaatagtagcagagctgggactaaatgcaggcctgtatatttccaaagcccaagcacttaccggtatgccatgatttcttcaacagcctctcttcattttaatgaaaattcaccaacaaacactgacaacttaaccaaataggccaagtaccctgggcaagctcctatctcaaggccggaaagcagtggagctcagacaagaagtagcctggacagctttcctaccttccggcttgcctactcccctctcccgggaaatgcactcagacaagcaactacatctgtaggagcaatcacatggttaacccagtgacagctgctgtaatacattcccaactcatcaaagttctaacaaacagtttgtctgcaagaattcaagaagaagcatgtatgttctttaggcaaaggacttttttataaaagcaagaaaagaaatgattcctcaagtagatcctaatgaaataagacgtctctctgtgtatatgggtttgtttttttttttttttaaagaaaaagaaggttctctctagtctaaataaaccttgatggctccccagaagttacagcagcctgttgaataaacagacagcatttacattaacatttctttagttctgtttgcatgcagtggtttttcttactaaaaataaaaaacaattccggccccatgatgcaatccttggcttcaggagcctatgcttcctttattctgtcaactggattttagagagaaattggtataagtaaaggtggacttaggtgcacctaaagtagcacttctcaaactttaacatgcataataattatctgggagggggtcttaaaatgcagattttgattctgattccataggtctggagtacagcccaaagttccgcgtttctaacaagctcacaggtgatgccatttctgctgatccgtggacctaactaggagtagcaatcatctaaaatttagactctagtggattccgcatgggtgttcttcaggataggcccttatttctggagtcttctctttctttccactttcatgcacattgttagagtctactctcaccaatgcactagcaattccaaaatcttcgtatccagtccaaaacttggactcttcacctgggtgtctctcaacttgacaggcccaaaattgtgcccatcatcctcctcaccacctcttatatttgcgctcttgtttgttattgtctaatgtccaatggaaccaccacccatataaatgttcaagccacacattcataaatcaacccaaattccttcctttacttctttttcatcacttcaaatttattaaggtatcatttatgtattacagaatgcacctatttgaagagtttatacttcagtaaattttgacagccgtatacatttatgttaccacaccacaatcaaaacatagaagatggtcatcgttccaaaagattatctcaatcccatcccatccaaggcccctaataaccactaatctattttctttcaccatagttttgccttttctagaatttcatgtaaatggactcttgtgtctggcttctttcacttagcacaatgcttttgagatttgcctgggcatgcatcagtagctcagtcatttatattgctgtatagcatttcattatataaattctcttacttagtctctgactggctgggaagtcaccttttccactggcgtggaagagaaaaaagccaacagaacttgtcccactaggattaagtgcagtgccaggttatcccacacagagaaaagaaagccgagcttatatacaaaatcaactaggttttttcaagcagaatctttgatattattaatattaagtgtatacatacatatattattaatattaggtatatataaagattattaatattaggtgtatataacacatatacacctaatataattaatattaataatattaaagattatatttgccttcgagtaaatatacgtaaacacatatgttttagggccataagaagtggttaacaagtgaagataccagataaatgtcccccacacttttctgttttacattttagcttttctctctgcattgtgaaaagagatggaggctactttagacaaaatgcccagcatatatcaggttatgaagggggtcctgaggaacttagggcttagacctagtgctatatagcagaagcatagcagactgcttcaggccctggctaaagagaaacctgaaacagaaataacttaacttgccacattccatccatggcagcctccatcacccgagaagaggcagctaccaaaccctgggctattaaaggctggatttgattatttactcttggtgtcatgacaaactcataaaagatataacacaagccccccagtcaaaccacactggttatctccaagctggctccacaggctgacttttgaatgaaggtgtttttataaggatgtggtgtacgctgagccaaaggacaaaaccattggaagatagttcatctctcagtccttgttttcagcaattgctagggctgcaaatttggagctcgataatggagtgtgccccactgtcaagttccattagatggtctgtgtggtcttgaagtctcgggctctgtgagtatagttttgtagatgataggcaagagaaactatggaaagggcaacccctctgtatcagctgttatcacaataataatcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggttgggggaggggggagggatagtattgggagatatacctaatgctagatgacacattagtggtgcagcgcaccagcatggcacatgtatacatatgtaactaacctgcacaatgtgcacatgtaccctaaaacttagagtataataaaaaaaataaaataaaataaaataaaaaataaaagaaaaaaaaaaaaaaaaaaaaaaaaaaaaaaaaaaaaaagagctcctctatgtagaagtggaaaaaatatgggaatggctaccaaaatccctttggaagactgaaaaatcctttaatctagtaatttttaatcttcagactatttcttaacgggatgtaaagatataagcaatgataatgatgttagagcctagtgttccatgcaatgggaaacaacctaaatgttatttaagacaggaaataacccaaatgtctctcaacaaggactgattaaacaaataattatatgatgatgcaatgaaatgttgctcaactattgaaacataataatgtagatcaagggttagaaacattttctgcaaagggccaatagtaaatattttagccttcatgagtaaggttatctccgttgcagctattcatctctgccattctagctcaaaagcagccagatatcatacataaatgaatagacatggctgtgttccatttgaactttatttacaaaaacaggcattggtcaggatttggcccttggaccatcatttgctgaaacctggtatagatgatgttctccttgacatataaagatgcccacattatattgattagtgaaaaaaaaatcacattaggaagcatatagtatccttaaagaataatagcaacatataagcctggaaaaagtcctaaatggcagggttgtgttttacattttttcttctttgtgcatgtattcttttccttcccaggggaaggggaatacagaagagaaaatgggttttaactttaaaaaaaaagtgattgtaccagagaaagaagttgtcctaatgtagagataacaatggcactcttattaaataaaatcttccagtattttgccactgtcaatcaactcagaagctgaaaataccacattgtcaccagccacagtaaaaagctaaattgcattcatggaacaagtccaactcaagccattttttaattcaagtatgactttttcaatttatccttccaaattcagcctgagggctccccccaatctgtgattctttcactagtccgaagtggtgtgacatttgacaagtttttgaccctgcagagtgaagccttagaattcttctctctgagccctttctgcaataaaagttcacaatttggtgactctttgtggagggacctttaactgttgacagagagtagtttctgccccaggatgcctattaaagttataatggttatcacagttaggacgttgaaactgtggtcagctgctgcctattcaggaagttgttgtgtgtcgtgggttgtttcctaaagcctgttccattgtggtcatgggacgtgcacattttctattcataacctcagctaagctcaagttgacagcagtttaaatggaaatggtgtgccagctgaacaagaactatacttttctcacttgctatctaagttggaaagagagcccactccagagagaacaaatgaaatttaatatattatggggttggacttaggagcaaagccaaagttgtttaaggtgatgttctcttaacataaaatttgactttcaaagatatagctccaactcgacatatctgaggaacaagaagtctctacaattcctgtctgggactatggagtctatggtctagacaagaaagcagcaaagagaggcatttggcagagaggcggggagataactaatgcatgagcattccatcatttccagtgagtttttgttaagggaaaattgttcattaaatggagagccagagttctggggtaggaatgacagccctaacattttcagcaggcatttttatcccccatctcctgatcccagcctcttctttgggcctcttggggacctctaatgagctctccacaaggcaagattcctattatcaaaagagaacgggctcacagctgacctttgtgaaataatttaccttttacctgctgtgttccttctttagagaacaaaccacaccacacattatgctgtgagctaaaaatggaactttctgagagtacaacagagtgtttgctttgtccagtaagaaatctgtgttggcaaagaaatcaagccagaaacattcagcagaaaaaaaaaaaaatagggggaagaggttttgtctctagtgtggtattctagtacttcctcttttcacgttttgagtttctttggcattgttgagaatctacacagacatgaaatgccataaaaggtcttgatatccagtagggttggggatgtacattccttgttataccaaaattgccagtaattgggcattgtgtgtgtatgtgactacaaagccatgcttctgttgagaacattgaaaaactatgggtgtggttcaaaaagaacaggctttaacaggcaattggaatgctagtctgaagttggctctcttattcccttagcaagaggcaggggaaatgggtcaaagtccattgggatgggtaatgaggggacaacaccagggaagactcattggcaaaggctaaagcatttgacccattaactgtcatttaccagtaactccatcaacattatacttctcttttctatctaaactgaaacgattattcaaagcttttattcagattttcattcatttaacgttcaacaaatacttcctgagtttctatagtccttgctacccaaattctggttcataaaacatcagcatgcacatcatctgggagcgtgttaaaatgcagaatctcaggcccaatcccagccctactgaatcagaatatgcattttaataagatccacaggaatttgtatacatactcaagtttcagaagcactaaattatgtgattgatattcattgtatgaataaatgagtgaatgaacaccattagttcactagaggctccccatcaggatactccggttttgctgtgtttacacaggagaattcccaccccaactcaccaacatcacccagtgccatagatcatgtaagcaggcttggtgccattttacactgggacctcagaaacacatgggtacagaattgaggtgagtgaacaggaaaagtgggacctttgtgaactgaaagagtgagggttgctgcccaaatttcatgttgaaaacttgggcttgatctgggtgagccatttgcaaggagttacagcaggctaggttttagattctagaaggtaagtttgttttggattcaaccaaatgggttggagtcaaaggccagaccaggatttgggttacaatcaggcaggtaacccctgaaagaaggttagaggacaggctaacacagggacctatgtggatgttcagggatctgtgtgacatacctgacttagcccagcaggagtaatgcaagatcttaacagttgcaagaggtgggagaagttttgtgtggctctgagttggccagcaatatactgctggctgccctaattaagatgggcccaaagtttgaaggactgagcctgtaggttagtaatcgatggtgcagactgaggagaggagtttagagaaaagctggagcatgctttcacccagaaggaggagggtggtgaagagaaataatggcatccctgcacagaaacaacatcccttttgagctgagttttgtaaaactgaaaaacagggagttaacaggtgttacagcagcaaagctggaaactgaccacagggcatttgcatattcttgcagctcgtttagtgttactattctgtccacccttactcagtgggctctgtgacaaatgaaacacaagagctatgcagatattattcattttttcccagacttcctagcctgccttgattatgcttctctgctgatatgttttgcttaagcaatggtttatctcagtacttttaagctaactgaggtgatggaagaggaaggcaggagcaattggtcaggagtcccagccaatgatcagatacaaatgctttcttgtaagactaagccaagttcataaacatctgcttttcatctaccaaaaacctagttcctcattatccttagactcatcatttcccccaacagcatcctcacagtgttgttccttcccactctcaaaccatggtgttccagggctcctccgatctgggctccagggatggacactgcattcccttggccagtgattggctcaggtttggcccatgacacaggcaattggcatatcccattataccatcttctcccagctaaagcactgagtctgttactcactttggcctattaagacttgattctggaacttccgtcaaactgataagggaatcttctgatggcctggaaagggtttcatctcagtgttcctgggaactatcgtgggaagaagggaacctacttgagagtaaggccatgatggaggagagcaaaggccaaaaatgaaagcagaaagaggcaggggacagtagaaagagagagagagagagacctgttgatatcttcttgcatttagcaatgcctcaagctcgtccttttgtggacaattatcatttcaattataaaagccaataaattcccttttacttattgaaccagttggcattctatctctcgcaactaagaattgaacaggatgctagagtatcagcagtcctctgacactgtcgcactgaaacagacatcttcagagctggacatccgcaacagaggaggcaatgctggctgggtcattttttaaatgaggaaaatgagacaaaaaaagtcagcaagtgcattccctcatctttgggaaattacagcttaataaaactcattgtttctatttatttgtttctttggtcagcacattgaacttatcatttctcatgttagtcaccacctttaatttacatttaatcatatgatactacatttaatcatatgataatacaatagaaagcactactatcttagaaaactgaggttcagagtggtttaagtcattcaccttaggtcaaacggccagtatatctctcactttgtctctgaaaggaaatgcttcagtccattgactttttttctttcagtccattgagtttaagagtcaaaatgcctgactgattcttgagccacttaattagtaatattacttgagctctcattatatatcaagagttgacatgagcagagttaccaaagcactttgtggaaagttgggtccaaatgaaaacataaaaaagcctgggttgtgagtagtctggggaggctcaggctctagtagtaaaataattatttaaatgctatgtaggcaccaggtgcggtggctcaagcctgtaatcccagcactttgggaggccgaggcgggtggatcacctgatgttaggagtttgagaccagcctggccaacatggtgaaaccccatctctactaaaaatataaaaattagccaggtgtggtgatgggtgcctgtaatcccagctactcgggaggctgaggcaggagaatcacttgaaccagggaggtggagattgcagtgagccgagattgcatgcactccagcctgggcaacaagagtgaaactctgtctccaaaaaaaaaaaaaaaaaaaaaatcctatgtaggctacatttctgcttttgaaaagaattaatagagcattttttccttacaactatttataatcgtacgcatcaatgacacgcacaaaatggccactaagagtaagaggcaaggcaataaggcccatatagaatgtttaaatcccataattttaataatcttatctctacgatataaacagggttttgcttagtgtaaatggggaaaaaaagcatgggtattggagcaatgtaaaatctaggttcttttccttgcattctgcctttttttgttttttacaactagctgttgtcttcttaatgcctctgaacctcagttttaaaaatatctacaatagtgttagttataacccttcagagtggctgttataatgaataaataaggtgccttgcacagtgcgtaccacatagtaaccattcaacacatctctccctctccaggggaaggtaagaagactgattttctggtgagaattttagaaattatcctcatgaacacatggtcccctgtaaatctagcactcctttaaattgatccaattaacctctaagtgaacagaacttctgatttaaatattaagttatttgtcaaactcttatttgtgtgtttgtttttaaaactctatatagctccataaagctttttaaatactagttaaagatgaaagcagaattttattttaaagttagcaattcatctgtattgtttctgagggaaataaaattaaaatgattgttctataaatactcctgagactgggttatgaaatctacaggagaaaactgagaaacaaagtttccatgacatttcatatctcttaaagtatgaaatacacattaaaatattaaaaatgtagaaaagaagacaagctgtaatattaaacaatataaacagtattgactcttgaagtcattgtgttatgtagacagagagagatatttttcctattagaaacagagttagacagagataatatatgaagaaatgcaccccaaattctagaatgaagaaaaagggggaaaagaaagaaagacttgagtagtgatttggaaatgtggccaacatgaatcttcatgctacctcaattatccaatgacaatggcaaccagtaggaaatggttacctcagttatccaatgacaatggtaaccagtaggaaatggttaccaatgcaaggaagattatgtcctccttgaagtgtggggtggggtgtgtatgcgtgcgtgtgtttctctgtgtgtgtgtgtgtgtgtgtgtgtgtgtgtgtgtgtgtgtgtgtatgttgtgtaggaagcgggggcaggaaggacaagcataggaagtagaagaggccaaagaattttagcggcaattctcccacttactcatatccggaacaaagaacacggccaagtgagaaagctcttcctcctcacgcatgcactttaggggcaagcagatttggaataataaccgtgactttggaataatcttcccaaactggagcacctattgtcaaatgttaatggccctactgacaagaaccaaccaggcagttgagatcaacaaacgtgggatatgacaaccttcgctgtcatgaaaaatatttccaatgaaaatagttcctaatgtgtgactgatcaaagatggtaagcatttgcgtagaattaagtcatttcttatatatttcatactaaaagttaaatgtttgtcatgagaattattttcctggaaagacaggtgataaaatcatctaaaaagttcacagtggagttaataatcataattcaaaagcattttagaaataaattagcaggtgccaagacactcattactttggttgcggttatttggaagaaaaaaaacactctcgggagaattggtgaaggacctaagagaaaagcattccatctgtcttagagaccaaatgagtgtcagccagccttttcttctatcacagacaacatggaggttccccaaatctgagatgactttgtggtgaatggaggccaggcaagaccatacctgttttaggggtctccccagttcctgtgacatctttttttggaattctgaccccaccttgatctatagtataacaatgaaatcacagagagaggcagccccactccctaaggacaggaaggaagagcccccaaaccatgtgaggaggctggggagatgttgtggactgtgactctatcctttaattatgccgcagagctctgccatcccactgagagccacacctaactgctgactgggataggaagaggaggcaggggtgtggtcactgctattgaccactatgcctactttcatctctgcttaatggtgatgctattgcaggatgcaccccagtagcaccaatcaatgaattatttcctttcacatgtgtatcatgaagaggttgccaatccacactctttgacacagatattttgggctaatactgattaggttgttcatgttctgaagatgcttcagatgcggttcctcagaagtgcacccttggatggatttgtcaggaagtattgccaggaaaaccgataagtgaagtcagatcaggacaggaaggaagcccagccagggatgcctcattaggttcagtccaacaaagggtgcctttggctcggttctgcagggaaactgtgagagcgaagagtacaactcagagctgtcctaatcaggagtgagggtgctggaggattggttcccatgcacctctttctcatgggataggggcagcctctgcaggccgttactattgccagcaggaaatgctggttccaccaacctgaggacagttcccatcaaagacaggcaaggctctgtggctcacacctgtaatcccagcactttgggaggccgaggcgggcggatcacttggggtcaggagtttgagaccagcatggccaacatggtgaaaccccgtctctactaaaaatataaaaattagccaagtgtggtggcacgcacctgtaatcccatctacttgggaggctgaggcaagagagttgcttgaacccaggaggcagaggctgcagtgaaccgagattgtgccactgcactccagcctgggcgacagagcaagacccggtctcaaaaaaaagaaaaaacaaaaacaaagacaaacagatgcaggctgttgaaaaaggagctgtaccaggaggccagtacaccaagtactgggtaagtctgctctaggctgacattgcacttgaattccttgccactattatagtgtttaattcttgtgtcaagcctatgcttaacaactttttaaagtggaatctactattttcttcatgatatagatgtgaaagctaagcattagaaaagttaagtccttggtcagaagttatacaagtagaatatcatggagctggcattcagatccaagtctatgtgtgctcagggcctaaattcttaatgatgcttgcttattatattatgtgcaaataaatttaggaaattctagcctttaagtgatttgtttcttgatccttgaacaatgtacaatataagtacctatatacttatgaaaattacaagtattttcctgagttatataaacaactttttggcacatcccaaagatggttaaaatgtctgtgacaaacagcatggctcaagagattaaaaaaacaagtgtatgtacaaaataaatttatgatattttagtctttctagtgtgatggcaaattaaacctgcattatagaagcagcatcatataaaaagtaaaatgaatataaaattatatgctcaatcttgagaagagagacagaatctttaaatttgggagacttgggagacattttcctttattcatggcttataagggttttcttttaagattgtagtttgtatttatatcaaactatactctataattcatttatttaattcctgttctctactatatgaacataattactgagaacaatcaatatgtccccatttgataaatgactaaaataagaatagcagattgcaacacaacgagttttaaggaggtgaaggatgtttactatgatgctactgaaagctcctctggcttctagagaaagaataatttccattcctgcttctcattccactgactgaggtttgtctgtttgcttggtggattagaaatgattttcaaatagcctgctggatacatctaacagaatcctgggatggggactggaaacattctggaatttatgtcctgcactctgaggtcattttcataagactaccacacaattctttcttctccagaccatcgagcagtcttccatcagagctgtttgggagggaggaaggaatcggatgcagtctctgggcagaagagccatgatcccacatgagggggacgaatgtgtgcgagcgccaaggttctgggggccacacacctaggcagccagggtacaggtggccatatgcacctgagctcaggggcaaaggaaggcagcggggaggcatctgctcaggaccctgtgtgacaccatccagagacctcccatcgaatatagggctctaggcgtttctccagcctttttatcatgtggtaatttgatattgtggcatttggtacttcatggccccaatttttcaggtctactttttttgcattctttggtattgcactctgcggcagacacaatccaaggtgaccccaatgaccttgctcttgtataatccccttcctttgagtgtagagtacacctgtaactcgcttttacccactagaatatggcaacaggatatcattcctgtgatttggttataagattctatcttagcagactagagagagagaaagagactctcctgtggaccttgaagcagccagctgccttgatgggaactgtctccggagagggccacatggcaggggactacaggtggcatctatggtatctagctgctcaggacctcagtcctacaaacacaaggaaataaaccctgtcaataatcacatgatcttggaaaatgatccccaagctcaggtgagaccccagacctagccgacactgattatagttgtgagacactgagcagaggaccatgtaagccctgctcaaacttccaacacacagaaattgtgagctaataaatgtgtgttattttaaactgttaaacttatagcaactggttgcacagcagtgaaagcctcatacagctccccacactaatgatagatttgaccgtgtgacctgctttgaccattgagaatgaagaaaacaacacaagaagtggcttgtcaaaataggagtgcatttctgcattctcttttcaactcttgctactgccacaaaaacacatctgggctaagttgctgaaaacacgtgtgagaccagggaagagaactgatttgtcccctctaggtcaatcctaaatcagctagacttcagccaacctgccaactaaccatagacacaggagaaagtctagcagagatcagtggagctctgctcagataggcagaacttccaactgacccatgaactcataagaaaaaaataaatggttgctaccttaaaccactaagtttttaggtgctttgttatacaacatgtgtagcaatagataattgctacagggacccaccaatgaaagctgaggtatgcatttgagctttcacacatatatgattgctttctggaaatttttttttaatcaaaagacttaagagcataaaacaagaaattggggaagctggtgagagaaaagagatgatcatttactgtaaattctcaataaaagagaaatcattttccaataaaattgaaaataactttttaaattattttagcattttacagggcatatttaatcatagcaaaaataaaagctgcttgcatatcttatataaatcttttatagaatcatttctttcttcttctcttgaggatctctgactttgaggtcattctagagtaggtgtgctcatgaaggaagtgttgcggaggttttagaaagatagaaatcacgtacagagaagtacttccctctgccttccacaaggcacaccattaaataactatggaacattcattccctctaataacacagctctgtgcaggaaaccttgtttgttccttgggtaggaatagtgggaggggaagaggtgtcaggggagagacccgcatgggaggggtgctagaacaacaacaaaaagatactatgttagaggctaatagggaaaaaaaagcacattgcaggtatttttgcttctgtgggcacaggcctttgtcttggatcctgggctgtccaaaaaataaaagctctgggcaacatgagattaggggtttctcttcctttcagaggacagctctgttcttttttatcctcacaaagtcaccagtgtgaacgatggaatacaggaagcactatagtttttgttttgacccactaaatgtcagtaagcaaaatgcacccaaaaatttttcaagtaatttttgtttttcagtgtggaagagtgaaataatagaatctttctacagcctgattatcaactggtttgcttgcaaacagctaaaattgcttgcaatgtttcttttctaatttaactggtacaagtatattcaaatctgcctgcacttatccatttacatctcacatatacttcttgtaaaatgtgcattgtcagacaaaatgggcctgagcccatggatgaaagatggggaacataacccctggggcagaatcacactcacttaatggcagataaaactgcttctttgaggagtctaatgtctttggaatgcctcctagggatcctgtcctacggattccaccagccagcaggttatgaagagactttggggccttttgctaccgctctgggtggtcaacttgttggtgacggtgcctggctaaaagttcaacaatagctgcatgctggggaagcatctggtcagctgtttctgggaaacccagcagcaggaatcacggaaggctcccgagctaccctttgccattgctcaccccctagtgggcagcctgctgggcgacccaggcactagggaatttcttgccttcttgctctccaacttctcaaaacataatttctatttgaagatgttccacctccatgaaagatctatccttaatctttagcaagtcaaggtttcccttctgagtacttatacttattaacctccctcaaagtaaggttaggttcatgtaaatacttcatgtgttttgtcatgacatgaagtatccctaaaccagctccatttcctccaaaattcactgcagtatgaggcaaacacacagaatatggagggcaacagttttagctaaaatttaatagccatttacaagctttatattctatttcagaatcttgactcaaatggcacttgaaatgcagagctaaatcatgggttaagaatatcattttgtaagtgaccttcacagtctgccttaaaggtgccaaggccttaaagcagttgttcctcttggtttgttatttctggcacaaacttctctctgcatgttttatgggaccagtttttcacatgtttgcaaaaacttcggctaatttttcatttgtgaactcaccatatcaattccaagtatccatctggatttgttgattgtcaaaatgacagtcagccataatcctccatacataaagacaaaattctatctttgtttaggagaaagaaaggtaagctatttccaaatgacagcatttaaacagtcacgtacttctgttatcgctaaatacagtagctggggccagtgcacatcttcacagtacaaaaggaaaggagagaaaaaggcagtttctcatgttttgaggaataacattcagttttgaattaagactacagttcatttacttttaggataaagcaatgaactgtatcttaaattttttatattattagacaattgttacatacatgcaataaagcatctagtatacctcacatagcaagtatgcagctgtgattttagggtacgtgatcttcatttttaaaaacaactattgcccatgaactcagaaaatatgtaaattggcaatatccatcagacaccccatgaaactcataaaatctttcctgtccctcttgcaaatctcaaaacaacatcacagcaggactataatcaaccacaacagtcatatttacaatatgcaatttactgtaatgacacacataagaattcctttatcacaaagctgtttccctgagaaatttgtgtcttcctatcaatatgaaaaacagcgttcaagtgtaagcatattgttagcaacacatttcaactgaaaaaataatctacccaaagctgtcagttcctacaaaaggataattaatttaatctcaaagatatcatgtaagtatatatgaaattcatttattacatttagttgttgaacatgaagaattttatatttggacaaaatttcacccaaggagtcaatgtcaatattcggaagcattaagcttcccttacgttggagcccttcatagctgtaactccagggtgccaagaagctgtttcagatagatttctttgcattgcctctccaagtgatttcagtgctcatgaaaaccatcatagaaaaagtaaaaggcaatgatgaaagttccttaaaaagaagtttttcctgccttcagacaggagctaaagtcatttctaaaggaacccagcatattgactgtgcatgattcctcaccacttcaaaaaaagagaaaaatagcaatacatacatgctataatacatcaaatcaaaaagaggaatgtgggttctatgcatattaatactgataaaattcactagccaatattacagtcttcacacatcttaaaaatgagtggtgattaattaatgatatttctggaattgtacataatcagacctgtatttgtttttggacatcaaaattcatagtatttaatgagtcatagatgatacttataggaagacctaactcttaatcaattatatcatttgagtaaatttcctaacagtgtttcttaattgtgttctgctttagaatgcctaaacattctgtaaacactgcctaatgccatacaagtgtccacaataaacaagcagcatttctctaggtttctgaaattcatccacaagcagtgggtccaagtgtccacgtcactattcccttgaagactccatttgaagactacatgcctggaggaagataaagttaacaagcaagcaaatattcctgctgcagtcacttccctgagaatgaaacattttgcttttaaaaagcaaattaaggtttcaagtacacataattcagaaagagctggtgggtcgaaacataattaacgggagcatttgtgtttcaaaagtaatctgaaaagactgattcatattctattccatgcaaatattcagttacggaaattaggtgcattcataggaatttcattgcacaacaaatcattaaaaattatacaagagaaagggaaaaaatatataaatgcaatcaagaaaagattaagaggtctatgaagttcatgtaacaactcctttgcactaatagacagtttggagaatcaaaacaaaatgatcattcttggtcatgaggggaggtgctccatatttgtgttagaaaggcttctgaaaagttaacttctctgttgggatgtgactctatgtacaaaatggtgcttttgccagagcctgactttctcttagagacatgggaaaatatagactcagtgattgtggtagtttagggagaattcaaatagagcatattcatacttttagcaaaacaatacatctatccacatagagttgataggcctgaagctgttgttaaaaaggacagcttctgcttacttaactttcactgacttctagcataataaatgcccattcctatcacctaaaagagttacatgcaatggctgggcacagtggctcacgcctctaatcccagcactttgggaggccgaggcaggcagatcacctgaggtcaggagtttgagaccagcctggccaacatggtgtaaccccatctctactaaaaacacaaaaattagctgggcatggcagcacatgcctgtaatcccagttactcgggaggctgaggcaggagaattgcttgaacctgggtggcggaggttgcagtaagttaagatctcgccattgcactcaagcctgggcaacagagtgagactctgtcttaaaaaaaaaaaaaaaaaaaaagagttagatggaaacattttgctcactttctggtcaataaggccaactatatacactttaaaacatcttcaagtaaaccatttatcttcccttaccacggtacaccttttgaatactattctttcctaaattctgtttactatatactaccatttgggaaataacttgatttcaaactctcaccccacaattagaatttgtgcccctccaggtctgtgcttcctgcatgaagaagaaatgtgcccctttcatacactgaaagataaaaagaattataagtgcaggttcaaattaacttggaacagaaataaaattttgcctgggtaaatcaatatcatagcattttgattttatgaatttcacatatggatagaattagtttgaaagctgaaactgaaattttcattactgtatttgcatctattatcttacattacagtgtatctgtaattgttaatttggcttaaagaaagatccattgacaatcttcaaaagcattagtgcatgattaaagggaatttggatataatttaagtattaaatatgctcatttaaaaatagtgtagattttcatactatacagaaagaaggttatggtctttcaaccactgtaaatacattgaactaaaatcgattcaatcatactaaaaaaattcagtgtaaataaagatgacagaactccatgaaaagtaaataaaaagtataatttcaactttcagattactaattatgtagaataaattgctctttaggtagctagaagtgtagacagatttcgcaataagggtatttcttgacattacaccagagttttaagaagctgattgaagagaaggagtttaagcccagtgagaatctagcagattttcatcataattctcccggcataaaggatgatacacagtttggcattctgatttcacttccactgagctgcctcaatgagtaaaaaagggatttaacttattttcatttcaaaatcctaaacaattcataaacaatttaggtaattgtaataaggagggatttaggatgaggaatattgcatctttttcatagattctataaactcttcaaagtgctctaaaaatactataagtttgattagcagcaaagcattagtctaatcaaaacctctctccttccgccctcatatataaacatatacacacactgtacagcaatatattctattagtctaagttaaatctgacagtttgacagttacccccagaggctgtgcaaggttacaaatactgtctacactgtatcacagttcaagaccactagcacccaagtggttaagcgagaaccaacccatccattaaaaaaaaaaaaatttaatcacgtattttgaatttctttaaatgtaaaaatggaggatacagtgaatcacccaatatattattctgagtcctgtaactgtctttatctaaaatattttttacatatggaaggctagatgtctttaaatatacttttagcaattctgagtatcaaatgtgcctttgaaaaatatgacaagttttttttaatgttaaggaaaattctgtaagagagtttttttgttgttgtttttgggttttccccccaccctccaaaagatgaattttgcagcattttctcccagcagcacactggtagctctgacatcctgtatataatgtgttctggcaatgaagccctcaagtaccgcagctgtcatatactccagcacaggacccccagaaagaagtcctgcaggccccatggcatcttggtcttttccacaccctctagcagcacccaatccttgggcatcttgcaatagcggctgaagtccagaacttgaacttcactgagaaaatcaagtccactcaaaatgcagcattttcatcttttggttgggtgattcttggtcccccatggataggaatgatacctataagattcagaagtggaaagaattctctatagttacaaatattttagttcatacattcaatttcaaaaactggggctcaggcatataagtaaataaatcacagtaaataaaaagacgattatttttgttaggatggggacatttttaaaaagctgcctttggctgaagtctggtgctaacaaggcctttctcaaattatgaactcaataggaactgataacactttgtagtagaaaaacaaatattcattcaaaatagcttgtatacttgaatacctgtgtaggttaaaataactaatttacacgcttatcagtcaattggggaaataaaacaattcaagttgattcaatgtagatttgttatcttgtatactgttatttctcaacacattttattattaaaaataaaatattaatgtaatacataagtatattcataaagattatatgctcattatctgtttattcatgactcaaatgattttatcctcacaaacaacaatgataaaattaaggcatattaagttgcatccttctggtaagcaagctaaatgcttatgtatataaaacgtaatttatcatacaaccatgcaaatgatcaaaaatagagcctgctttgggaagagctatgaggctggccaagcctttttgaccttctttaactttctttacacagctttcttccttccaactcagtcctagctccctttttcccagaagcccagaaatgagaaatacccaaccttggtcagaggtccttgctgctctttctgttcctgttaccattttcttttcctaatgcagcattttatgcctgagacattcttcctaactgtccaagcagtctcctcatgatttaaacagttccagaaatcttcctcaaagatagctaacagatagataatggctttatcctgagactttcagtctgaaaatggcacctctctattctcttccttaactaaatataaaccctataatttaaaccaaaaatgtaccttatcttgaattaatcctttagtgactggctggctagatgatgtgtgtactattcaaactgatagtcttaaattgtaaacttgaataacaccgaaattatatatgtaactttctcagcacggtgcttaattcatttaagaacaaattttgcaatgacgatgatgacaatgatgaccatgtcaatgagaacaacagagatctgggtagaccctggtgaaggagtgaaaacggtgttcctcatttccaaccacatagctaaaacagctttcctcaattgtattccatgtaaagagtgaggaaaacactgaggtcaacaaacaaggtcaacagatttctttcttatagtacatctcagagtctttaatatagtaataggtgtcaacattctccaaatataaaaaattgtacattctgagtttcccaaatatatgtggccatgaaactttatttttcagagactatctattgacatctttgataatattgcccattctatgaaacctattggggaaaaatgcagtctactaattctaaatactgattctaaatacctctacatatgctgtgacatttagcaccctccatcctttgtggaaaaaagcatgacagtaccagctaatctgatttgtacttggagttatgtgttattcacagtttgtggattagtaggtgcttctaattgaagcctgacttatttcttggaaattattttggaatactagtaaacaaagagtggctttaggcacaaacaagggttatttttacaaacaaattctggagagtttttctcccaagatatgttctatcattgctattagaagccaaaagggggtcgggtgtggtggatcatgcctgtaatcccagcactttgggaggccaaggcaggtggatcacctgaggccaggtcaagatcagcctggccaacatgaagaaaccccgtttctactaaaaatacaaaaattagccaggtgtggtggtgggcgcctataatcccagcaactcgggaggctgaggcaggagaatcgcttgaacccaggaggtggagtttgtagtgagccaagatcgcaccattgcacttcagcctggcctgagcaacataacgagattccatctcaaaaaaaaaaaaaaaaaaaaaaagaagccaaaaagggaataccatggatatatggatttttaaatgtgattcattttaatttggagcactttaagaaaatttaatgcaatacccaacttatattgcttaaacttgactgtttcatcataccttcataatagattcacaattacaaatataactgaataattttttgcctttgttataaggcatcttattatctgtttatcataataagaaaatttgcaatgtcttttaataaagccatatgtctttggaactagatcggtttaaaacctaatgaaagtagaattgaaaaagaataatgataaattccaaaataagacaaatattttttaataaagggaaaataaaagttcttgtaagagcttccttaagttccttgcacacttagtttttcttgatatttaaatgattttctgcaaaaaatatgaagacattccttgcccatgatcccaagtctctgagaaaatgcagataaaatgacaagagtcatcttttccccagtacaagccaagggcacttgaaataatgaggctcacagttaaaaacagaaacattcatactatccatgatagtatgcttatgtatgtaaaatgtaatttatcatacaaccatgcaaatgatcaaaaatagagcctgctttgggaagagctacgaggctggccaagcctttatgaccttctttaactttctttacacagctttcttccttccaactcagtcctagctccctttttcccggaagcccagaaatgagaaatatccaaacttggtcagaggtccttgctgctctttctgttcctgttaccattttcttttcctaatgcatatactcagcccttgaatagaaaatgaaaattcaaaaatctctccagggatggtgggaggagagtagttgtggagatggtaatttctattgacggtatatctttagaaaatgagaattactcattgttcctctgcagttacaaatcacaacagatctaaatttataaaggtagtattttgaaactgttatcaagtcaaaagagcaagtagttgaataattttacttgtgactcataagaaaaactccttgaaatgggagaagtagaagaaaaaggagaagaaacactggagactgaactaaccttagaaaagaatctaatttctatataatgaccttaacaggatgttcttgagccctctttctcttcccgttgttactagtcatctttggtgaagacttctggaataatttaaatagtggtcacaaaatagcttcaataattgaaaaggaaggcagtccctccaggcataaaagaccactttgagagaatatactccaaaggactatgcctcctaaaacaactgtggcccagatagagtgtgtgtgtggatacttgcaaccaatttgatgactcagctatgagtaggctccttaggtaagtcaacagacaactcttgtgtagcagacattgtaaacacccatacccctatctattccacttcaaagcacgctggcagatttctacctgctaatatataaagaaattcaataatggaatacctgcacttcttttcctgaggatttctctgacccctggagtcttctttgttcatatttacaaaaggccagaaaaaaacagggcattaacacttcctagggaaaggccttaaacaatgactgatggagattggaggataaatacctcagctctctcactctttgtgtgggatggccctggtacatattctatatcagctcttagatttccccagtgggatcaggcttcaatcacctacaatgctaatttgcttgattataaaacctttcttgaataacttcatagtaaactaattgtactcaaattgttgtgccaacactatttccaaaactaaaattataaaaattgatgcaattgataaaatagcatatactcttagaacaccaacgatagctatattggaagataacatacagctccagtaaatggaggttttttatttagggtaaacaaatggcaacatacaatagcaaagtctcttctccacaaatatatcttaaattcacaagaaatgattctttgttcagttgcactttgtccctagccttctgtgcaaatagtgggtagatttaagtgataggagtgagttttcagctcttctagaatgagacaaacaaatatttgatgtttaaaaaaccaatctagaaatgctttttccatttacttatatttatgattttttatgggaataaatttctactaagcaatcaccctttttgtttcaactgagaatacagcaactgtgtccacacaaaagatgggcacatatattctacttatagatgtatctagtctaagccaagatattttataaaagtatttaaaataaaatctgaaaaaaaatccctctggaataaaggataaagaaattagatctaacatctgatgacctcaattcatctttcacaattgaaggcaaactctagctcttacctgttagatgtaaaattgtaatagccactttcctcaaggacttcttcaatcacagtctaaaattttaaaaatcaggttagtattgaattagaagtaacaaaataaaatcattcagagacactgcaaaaacctcacctgcatctgttcatatgttattccttcctccaattcaatgctggttggtaaacctaaaaaagataaattatggaaagtctgacatttgggttcacattttcttagttattctttactggcaattatgacttcaaccacagggcaaacaggtcaatttcttaatgataaagatggaacaagcaaattccaaagcatctgccttggctttgaatattcaagtgttttgttttcctttctttaataactgacttccttgggcatgggcatcacaaaatgatatatgaagattaaggggcattgctcatagtgtccaataaagttagaggtgtgtgtgtgtatgtgttaagggcaagtgaggggtgattcccaatgcaaattacctgatgggtgttttctgattaagaaactctccctaatctacaggctaagaagaataaatatacgttagaaagaaaattgattcttacagggaggcagatacagatgtaaagagaccaaagatctgaccctttcatatagctgcctagagggaaaaaatatatttattgccagaagacttttaaaatgtttattattactattattattattatcatcatcatcttgtagagatagggtctcactatgttgcccaggttggtcttgaattcctgagctcaagtcatcctcttgcctacagccttccaacgtctgtacattataagcatgtgccaccatggctggccagatttttttttttaatttaatttaattttaagttccaggatacatgagcaggatgtgcaggtttgtaatataggtaaatgtgtgccatgatggtttgctgcacctgtcaactcagtagctaggtattaagcccagcatgcattagctatttatcctgatgctctccctcccctcacccactccaccaccccaacaggccccagtgtgtgttgttcccctctctgtgtccatgtgttctcattgttcagctcccacttataaatgaggacatttgttgtttggttttctgttcccgtgttagtttgctgaggataatggcttccagctccatccatgtccctgcaaaggacatgatctcattcctctttatagctgcatggtattccatggtgcatgtgtaccacattttctttatccagtctatcattgatgggcatttgggttgattccatgtcttcactattgtgaatagtatagcaatgaacatatgtgtgcatgtatctttataagggaatgatttatttttctttgggtatatacccagtaatgggattgctggttcaaatggtatttctggttctaggtctttgaggaatagccacactgtcttccacaatggttgaactaatttacattcccagcaacagtgtaaaagcattcctatttctccacagccttgccaacatctgttgtttcttgacatttaaataattgccattctgactggcacaagatggtttctcattgtggttttgatttgcgtttctctaatgatcaatgatgttgagctttttatcatatgtttgttggccgcataaatgtcttcatttgagtagcatctgttcatgtcctttgcctactttttaatggggttgcttttttcttgtaaatttgtttaagttccttgcagattctggatattacacctttgtcggatagatagattgcaaaaattttctctttctgtaggttgtctgtaaactctgatgatagtttcttttgctgtgcagaagctctttaattagatcccatttgtgaatttttgcttttgttataattgcttttggcattttcgtcatgaaatctttgcccaggcctatgtcctgaatggtattgtctagattttcttctagggtttttataattttgggttttacatttaagtctttaatccatcttgaattaatttttgtataaggtgtaaggaaggggcccagtttcaattttctgcatgtggctagtcagttctcccagcaccatttattaaataaggaatcctttccccattgcttgtttttgtcaggtttgtcaaagatcagatggttccagatgtatggtcctatttctgagttctctattctgttccattggtctatgtgtctgtttttgtaccagtccatgctgttttggttactaaagccttgtagtatagtttgaagtcaggtaatgtgatgcctccagctttgtcctttttgcttgggattgtcttgctggacagactttatgatggttgatcagaatttggtataccagcaccttaacacactccgatgccacccaaagccgtgttgaccagctttcactcaaaccaatcaacactgacatgtagaggcctaggccacttctctgccaattcaaatagagaagagagaatgggtttagggtcaagaagagatgtgaaaatgtgagtactggtggctcatctttaaaggcataccccacagtactggcaggctctgctgtttttgcttttgcccagccagctgtgacatgggccaagcctagtcagctctggagtggggcatccagctgccctggggggagtttgtcaactcaccctcaggtttttgagagatttttatcaaagttcttcatttcatcagagtttctatgatgcggagaagtttgacctgcagataaacttccctgtcttggaaatgattttaaaagcaaattactttaaacaactttttatcttggatttctcagagattattttaaataaaattctgcatacatagggtttagctttatcccagaagaccaaaggaaagtttgtcaattaattcatgaaataatttgttcagtcagcaacaaaagcacaacaaaagtgagcattttttccaagctaaagagatggcaagtcttcatttaactgtaaaatcttcacttctatccactcctccaagtgacatagctaccgtttataaagattcaaaaattatttaggagtactgaaacctcagagtagcttgaaagcttcctcttagaattcagatatgacaagaagagttcaattatgctgagcccctactaatagacaggcagtttttatttttactctaatcctcactataaccttgtgatgcaagtatttatccccattttacaggcaaggaaactggggttcagagaggttaaatagttgtccatagtcagctactaaatggtttagccaagatttgaatctaggcacccaggtttccagaatatgtgcctttaaatccctatgctatactgcctccctatgtgaattttatgtaaaagagaaaaaaattcaagtgtctaatgtggattctttaggtgagtttcaagggtttctctattttgaatatttaaactccttatttctgctctttatctccctacatgctttagggaatttgatttcccatcatcagataagcaaaaagaaataaaaggaaatacaactcacccacacagattctgctgtttgtttatgatattaataaatgatcaaggaagctgccacaactgggtaagataaatttcagggaatttctagattcctaccatatgtgccttccaactattgctataaataatcaaaacaagctctatttaaaaaaaaattggagataatcttttagaaatagctgttgatccaaacaatatatttcttcatgaaagccaggttacccatgttgatcactattacctgtagggtcatttggggacaggctgtttccaccggatgaacgatgtaataaatggtaatctgctgtgaaaaagttgggctcaatcggttctggagatccctgagataactgaaatagaaaaagcaaaatcacatcttagtttacactcagaaggaaatggcaggagacctctgtgtggggtttttcatttccctatgtctctgcacagaaaatttagtgttctgtggttttcaatcccttgtaaatagataaagaaataatcttctttccaaaagaatttataaattggatgcagcaaaattacagtgaaagcaagttggacaattctctggtcatatgaaaaaatatactttatggccttatgagagcaaaagaaaaatgaatataaaaatactggcatgaagctgggatatcaagatgttatttttatcaggcatgggaggaataaactccaattattcaacagaacaatatgcttagcccaaatcactatttttttttcatgtatctgctttgaataattcctttttgtttgaccaaggaaagtaagtttctttttcttttttcttttttttttttctgcaacagtgtctcactctgtcgcccaggctgcagtgcagtggcacaatctcggctcactgcaacttccacctccatgctcaagggattctcctgcctcagcctcccgagtagctgggattataggcacccaccaccatgcccagctaatttttgtattttttttttttagtagagatggggtttcaccatgttggccaggctggtctcgaactcctgacctcagctgatccacccaccttggccttccgaagtgctgggattacaggcataagccaccgcgcctggccaaataagtttcttaatacatttttcgaaattactattaattaattttaatctccaaatattaattcccagcactctgatggaaagagtaatttgccaaatgacggtatttattaaagtttcaatcatttaatgcctttctataaagctgaatttttaaagtagaattttagaccgtaaacgtttttcaacctcctttcacctttaattccaattatcacttgggctggccaaattttagtgcctaaattacttttaaaatataaattcataataataagtcagaaaaaatggcataatttgtactatgctatagtagttagcttgtattcatatactttgtttatgagttaaaatacatcattgttcaatcacttgagaaaactatttgcaatagacactacattttaataatatatgcctaccctatgacccagcaatctgactcttaaggatttatatgagagaaataagtgcatatgtcccatcaaaagacatgtataagaatattcatgccatctttttttcataataactaaaatctagaaaaaccccaattgtccgtggagaaaagaatggatagatatatatcatggtgtgttcatacaatggaattctgcaaagcaataaaaaagaacaaactatggatactcagagcaacacggttcagtgttggagaaaagaagccagaaacaaaatacatagtgtatgacttcattcttagaaattttcatcatcggtgatatggtttggctgtgtcctcacccaaatctcatcttgaattgtaactcccacaattcccatgtgtcatgggaggacctggtgagaggtaattgaatcatgggtgtgggtctttcctgtctgttctcgtgatagtgaaaaagtctcgcaggatctgatagcctcaaaaactggagtttgcctgcacaagctctctctctttttgcctgctgccacccgtgtaagatgtgacttgctccttcttgctttctgccatgattgtgaggcttccccagccacgtggaaatgtaagtccaattaaacctctttcttttgtaaatttcccagtcttgggtacgtatttatcagcagcatgaaaatagactaatacaatcagacaaaactaaccaagggtaacagaaatcaggtaatgattacattgtggcaggagatgtaatgtggccgtacaaaggggtcttctgcagagctagaaatattctatatattgatgtgggtggtggtcgtatgggtgaaaatgtgttcataaaacttcatgaggctgtatatgtacctcattgtactcactatgaatttataccttaaaatattttatattagcaattaaaaattaattttttccatcaatggactttggatattgtaaatacaaatcatttgtgggtttcctagtctccatgttgacaaacacctactaccctctaaggaaaaaaatatatgattatatccatttttatcagtgataactgataactgaggtaattggatcatgggggtggtttcccccatgctgttgtcatgatagtgtgtgagatctcacgagatctgatggttttataagtgtctggcatttcccctgcttgcactcattgtctctcctgccgcccagtgaagaagtgaagaagtgccttccaccatgattgtaagtttcctgaggcctccccagccatgtggaactgtgagtcaattaagcctttttgctttataaattaccaagtctcgggcatttcttcatgcagcctgagaatggactaatatataacccatctgtaatatgacaagattgtaagattataaatactgtaatacaggaagccctgacagtcacacacttaaaaactttctcatctgtgctgcagggtttcatggaggtagccctgagcattctgtatatctcatatcccagcttgtaggtggctacaaataagctttttaatgtcttgtgatgctgaaaatgatttcctggtattacctttcaaatgacttcagatggaatttttcatatggtttagcgtaggagtaactggctgcctgaaatctcatcctaattataaaaagcttacttaatttaattattaagtttataccttggaattctaaagatttcaaagacagaaagatatttaaagcctcaaaaaaaattacatgaattgtgacttggagaggtcaagattgctattttaagatgacaaggacaagtcatctttcagggttcatctcaaactctgaagagaggagttttcatttccagtgcttatgtcacactggtagtctcactgagcttaagaactggaaattcttagagagatcggcacacggatgaaggcaaggactaaaattcattttttgacgaatcccagatacactgactttcattctaggaacttcccagaactactttttgcagttcagtttctagatatacacattgttttagcaaactattttttgcccccagtgtatgttggacagcatggtttatgatctgagcaggatgcagaaataatctggtttctgtgagacttgcaatctgactaggacaacaggataataatgagcaaaaatagggtgatatcataaatcatgaaccatgaaatgaaatagtgatttgtaaacttacaaaaagaagggtccttcatgaagactagcttggtttttttagaggttctgtagaagaaacactggagctgatctttgaaggataaatttaggtaaatcacagcaatcaaagtggacattccaggtagggggaacttggaggtaaaggttgggcattgcatattaatggaaaaatgatgaaagggatatgacatgattccatgttatatgggcattcatgatgaaatgaggaaaacaagttccattcattaatttagtatttttaatcaattattttgtgccaagcacagatccaaacaatgaaaaaacacattaatggataaaaattatactcttggagttcgctaactacttagggagaaatatgtctgtgaaatgtccacctagatacatgtaaaattgcaactgttctaaatgcattgaaagacaggtttgtgactttaggaggtagcagatagatttgacttagtcagcaaaggcttccatgaaaaagtgacatttatgccaagagctgaaagaatgagtaagaatgagtagatggggcgagaagaacattacaggcagaggaaaaagcatgtacaagactacgaaggaagcagcatgctagataaacaaattttagaaaaggcctggtggctgacgtggagacagcaaggggcaagagtgatacaagatgagggtgaacagaagggcaggagttagacctgattttggcattttatactgagttccttgaaggattttctgtgttgtgtgtgtgtgtgtacaagtgtgacatgatctgttttgaaaggttcatcctggatgtaatacacaaaacagtttaagtggggttgggaacatcagggtgaatgcagacagactattaagaggctcctacaagtaaggggggcctggaaagctggatcccagagtttagatggtgagacagaaaacaggaatctactaaggtttttgagtatgctaataaaaaaatgcttaataactattagtctgacaagatagattggagaacaagaagatcagcaaagaagctgtgacactaatgcaagagagaagggcccagagcttagactagatggcaaccaaaggaaggaatggatatggaagactgaatattcttatttaacaatagtagtactaattgacatgtattgaatacttacaacattctagacacagtagatattctagctgattcttacaactaccctctaaggcaagtattacccccttttacaaacaaggaaatggagaaggaaagtaatttacacaagaaacagctattaagtggcagaaccagggccagaagctagggctgtcttacatcaaaggtcagaaccttagtgactacagactactcaggcattaatgacttagcgggtaaaagaaatgaagcagagcaggtgaaaaagcgtgaggtttaaagaattagctgaaggaaaacggatgctttcaaggaaactgatgtggacacaggaagggaggagaaggtggtgagtctaattcccgacatgccagatggcaaagtaaatgttcacccagcaggtggaaatatggaggacacagcagaacatctttaagcagaggccccaatggctagatgaggccatgagatggttcagtagtccaatgcaagtgctgtgtgaacccttttttttgcctcatgagcattcagcttatagttgtacctcctttttagcattcaaactctgtttgaaagaatgtgtaagagcctccttctgagttgacaataatagggccctcctgctctgaatagacacctacagttctaaagagcaaatgactgaatatactttcgaactaaactaagtaaatatattaaggagaacagactgtatcattgttactacctctccccccaaaaaacactgatttttgagcaagtattgagcaattttatcatttatttggtcaattgagaatatagtactttctaggcaaaacctaaatagaaaaaataaagaaactatacatgtaatatttattaaatttcccaaacaacatctttttcatatgataaaatagggttatcctcactgtagaacaattacacacaatatttgggaatctaatcaactgaggtagaactctgaaggaaactgagccaaacataaataaaatgaggtgccagaagtgagaaaattttcaacacatttcatcactctgcactcgccagtcttctggtcttacttccctcagattttccttatcttctttgactgaactacactattataagatacaacatattgcctaatttttttatcttttctaacatacagcttctccatatgagtttttattagctttctatgggacattttgttaacagaaatgtccagtattcctacttactattttcttatacatacacacacaaatgcacatatgcatgtggacccatacatgcatggcccatcactggctccaccacactttctaagccccagggatgtacacctcacactcatccccgtttctgccaaaagtattcctgttgctgtggtgtttacatttccagcaaggattgtgttcctaacagaaaatccctaaactaaaagaaggctgaaaaaccactgttctacactacttacaaccaggagctcatcctcccaggaacttgactcaacactgaaggtgatgtcaaggaagagtgaacggtggcttgacctggctgggaaggagagccctgctataggagcttctctacttgttcaaaacaggttgctgctgggcactgctgattcacaatgcctccatggggccctaataagggttgtgcaaacctaagtcatgattattatatgcataaagagccgttaattcaagtctgagcacctaagcaatctgcctacttggagaagagctgaaaacctggagttaggaattaaaggaagtgccagctgctaaataaagcaaacttggccttgctgatctgcattgaaacagagattaggaactaaacagaaatgtcagaaaggcccatgcctacaggaagcaatctgggtaataacacagggaaaatgttactgggttttgtctgggctttcttatcaaaagcgtgatctatagaattacagcatcagtaacataagggaactagacagaaatgcagaatattgggtccaggatacaattgcatctggataaatatttggcctattagataacctgtctttctaataaaaagtctcaagcctgttggatataccataagttcacagtgggcaggtactatattttataggtttgccactcaaagtgtgtccctggatcagcagcagcagcagccatcacctggaagatgattggaagagcacaatctccacccttccccagtcctactgaatcagaatccacacattaacaagatccccagatgattgatataaacaataaaatgtgagaaaccctgatcctaccaggccactgattctcacccttggctgcaaattagaatcacctgggagcaaaaaaaaaacaacaacaaaccttgatccaactcctagacagccaactagcccctattgtgtcttagtgcaaattagaaaaagtcactcccttcttccggaggacgcaaccccagtcagtctcttcatccaggtgctcttgaacagaaaataacctgtccaattctaactggcagctttgatgggagagctgttttcaaaatgctaatgcccagtaattgatctaggagaagcccggaatacactaaaacaaacaaacaaacaaacaaaaaacccataaatatttttattataaaaaacttcaaacatttacaaaagtaaagataacaattcaatgaattccacgtacccgtcacccagttaaaacatgttcaatcttgcttcatttaaatctcccccacttcccttcctaccttgtctcactctcaagaattggaaagcaaatcctgtacaacatatcatactatccgtaatatttcagcatggctctttaaaagagatggatttctttttaaaaaacaaaaccacaatataattatcccacctaagaggttattgattcctgaatactgtcatgcactgcttaacaacagaaatccattctgagaaacacatcattaggcaatttcatcattgtgcaaacatcatagagtgtatttacacaaaactagatagtacatcctactacacacctaggctatatgctggcaataggagcaataggagcctattgttcctatgctacaaaactatgcagcattttactgtattaaatactgtaggcaaccgcaacacaatggtatttatgtatctaaacatatttgaatacagaaaaggtacagtaaaattatgctattataatcttgtgggaccactgtcatatatccagtctatcactgaccaaaacatcattatgtggtgcatgactctctaacaaatatataatcaatgttttaattttcccaactttcttgtaaatatatatttcaaacacttttagagtttctatgtttaagtcaggaagaaataattccatatattgcaagtggttattttccctaaaatgctttaatctttacaggcaatccctctccgcttctccacactctttctctcccttttcttcccttcttctctcctcctcccctcttcctgaaatttatttattgaagaaaacaggtcacttttcctatggatttcctggctggattttgctgattatccccctgatgtcattaaacatgttctgttgtccccttatttgctgcaagtagatagctagatccagagcagggacagacaaacttttcccgtaaaggatcagatagtaaatatttttggcgttccaggccatatggtctctgtaactgctattcaactttgtctgtaaacaaaagcagccatagacagtattaagtgaacctctgcagttgcgttccaacaacactttatttacaaacacaggcatcagaaatgattggcctgagggctgtaatttgctgacttctaatctacagccttaatcagatgtagattcaagcttttagcaagaatatttcatagacagtgctgtacactcccatcaggtggcatataatgcctgattgtccttcttgtgacattaacgcccattggtgatcatatctaggtgctatcatttaaacagggactgcaaaacaggaatattctttatccctttggcacttattagcttaagtacttctacaataagaaacttttcctctcaatgattttgttaacatgcgatagaattcataaaggaaaggcagaataaaagctttcttctttcctatgtaaacaattttcaatataataagctggttacttagcatcttccaaaggtaaccaatgagggatttttttttttcttttttggtattatgaactcttgggtttaaaccttatttaatgctttcaatttattattcttattgatgttccaattatcccataaatagccagtgggagcctcttcaatttggctcttgagaacttttgatatactctcagtagtccttgacaccatacttactatgctatctgtatgtccaaatattccagtctaatcttgtacagttcctgctctagaccaaaatcacctatatccccaaggagtcatgggtggaggagctcattgctgcttgattagtttctcgactatttcaatgaaaatattaggaaatgtgtatattttttaatagatgagatttatcatgaactcatattcattcacactgatacttccaattccaatttagatgaatctctgctatcttgcttctgtttcccctttcctccatgctgaaaatcctagttcccaagggtacctatacaattacttggttgctttactcccctcgcaattctagccaagattgagcagactggattgaagactaacttaggtgaggtataaataaagagcttaatgtcttagaaaaggccttttgcactttttgaatcttctgtatccttctgggtcttaggctattagtaagtaggcacagtcatcccataatggctccttcaaactagggacacagggcccgtgggttttagaagtttcagtgagaaaggtagaaatcaagtgcatttacgggctgtcaccacttactgctcctatggccctggtatggggtgactgtgtcagtcaaaggctaattggccactcctctatggttacacagggaatgaaaaatccatttatgaacagaagttgttgctatcaaaagattataccagaaaaggggtaaaaatggaggtcacaaactcttctcatttaagtttagatgaaggcaggaaagttacatatatgaatatattttatcagtataccaataaagaatggaacaactatatattatacagaatatatattaatgtattatatatcctatctccaattattaaacattaagtacctaccacatgccaggcactgtgcaaggccctggggaatcaaagataaataagacacacccaccaactttgggggaaacagaatgtaaggtagataaaaagctatttaaaacacaataatacaggtgaaaaagtggattcacccatagagaaaggtaagattaattctggacagggaaaattaagaaaggttttttttttttgtcagagctatttttttcagtttggtggtaaagaataggaagtgttttaatatcccaagctgaggatttctttagcacccaggaggcctgcctctctgactaagaggatacacccccatgaaggtatcatccaacttcatggggagatggcgcaagcctgaagctgcctgtagaggaatggaaccacacttctgttgatcatgagccctaaagcaatatatagggcctttccctacctaaaggtccatacaagatgtcccaaagaccaccatgggcttgtagtatcagacaagagaaccatggcagtctttataggagagtataatctgcctcttaaacaagttaataataaggatgagtctattcctgagggttctctcacccatgcttcccaaacatctcctaccaccctaccaattcctgtttttattttcccagacgaggtgtatcagaaggtaaatgcccaatgagagatgctgccacaatacacaggaaggaagacaaggagtgggtgggagaatttaacaaacaaaatcttctctatcaggagaggaaagaaagtgaggaagagttgcaacaccaaaaacataagtaataaacgagaaaataaagagaagcactgatggaaaatcactcagtgggagttgaagccacctttatgtctcagacagtttgtagcagatgctttcatctcataaaactaggatttctgttaaaataagtctatgctcaaaccagattattctgaccttaataagaatataaaataagaataagagttatatgaccttaataagaataaaaaaccaagcaacatattatcttttcatgggagatttaagcttttatcttttaaaaatgtgtttattatgatacaatatataaatatcataagataaatatctgaagcctcttctactgctttgatctccttcagctttgtttcttggccctatttgccaacacaacccaggaaagaaaccttgctctctaatctctgatggagcaggctttatgttttgtttacctgcagctgtgtctttttcccccatctgtttttggtgtatgtgcagataccagtgatgtgaaacaacaaagctaaagaatgttgtttgcatttcttatcaaagagcctatcatattttctaaataatgagtaagttaatgctgaagctttgatgcattaaaggaacgtgaaaccttaaaggaaaagttcactggcagcatgactatgctacccatttaaaaatatgatgaaactttttaaaaaatatgaaattggagtgctaccaattgtctttacctaggtgggcctgaattgcttgtaccttgggcctttcaggggagcttatggccacttccagggctgtatcgaaaggtctaccaaccaggacaaagggattttccaatatcaagttttgttaaccagaggtaaacaattttctttctgcccagttgatttagtatttttgtagtttagttgctatatgtatggacagaaatgtctgctagtatctaaggtctagaagattgtagactatctaagatggaaagaaccttagaaatagttcagtcagctttcatagataataaaaaatcaatggccccagatggttaaatgacttcttcagagtgacaaatctcaattttggagcttattgaagattattctaataaaatatcagaatataattctctagaagaggctaaaatatacacatttcaaattaaatattactttttcttaggaaaacatacaaaaatactgaaaaagctatccatttgttatctaaaaataagggccacggaaatagagaaaatcagaagcaaagacatatcctcaatttagtatgtaaagcagcaataagaaactttaatagaggatagagcttaaagtacgaagtaaaggaggtataaaatgtacctcttatgatgtggttttgtcagcaaaagaattcctatatatagaataccatacctttttaatttcagatttcaaattacaagggttactctgctggctgaagagggatttcttgaatctctctataacccttcttttcaaattgtggtgcaaagctggaggaagctgcataaaataagaaaacaatcattataaacaaattgttaacactacacagctgactacaaaaagcattcgctgagggcccatgtaacaatattcactcaataggactatgtaagaatttaaattttactgcaaatagcatgactagatgctataatttttaccctgcgattcagaaggaatatattattttgctctttttcaaatggctgcttccatttatcttattgtttcttcattgattgatattatttttcatttaacaaattattcattaattgcacacatatactgaattttgtgaagaacagtcttgacacagaatggtgcacttttatcagatgtttaggtgcttataatatgcctagaactatgccaaacactgtagccttggtactataggatctgacactttggaccaggaaatacatatctgctttagtagtatatatagtcagatgcctgtcttggagtgctcctgaaaattcagctgcagagaggtcagatttaggtaccaatcattccagaagaaagagaggatagattagcatatattaagaccagactaggatgagttacatttagtaagtgagtagtagaaagtcatggtaggaccttagaaaacatggtaacaaaaaaaatggggattaaaaaaatgatttgtcatgctttgtaggttggatctctacaagaaaatcaaaagtcctggaaagcacagaaagatgaagtgacatttagaagaaggataatagaaaagaaattgggtcaggattaaaagggtctcagagtggaaataatatttggttttgtttaaattatggaaagaacttgaagggagagaaagaggaaccagtcagaaaaaagatggctaagtggaaaggaaaatgtgatagtaagagatctcaatattaaacaagaatataattcaaagctcagatcaaaagaaagaagaatgtatcagaaataattattaccccaaccctgctctattttctaggctcctttacaggcttagttagtaccatgtgactacttttggtcaataaaaatgatgtgtgtcactctgaggataagacaattcaaagtcagtgtgttttctccaccactgtcctccctactgcaaggagcttggcattaccatcctattctgactgcacagccacaagaaggaacagggccacctgagcagcccgaatggaactgagtaagaaataaacctctattgtgtcaagccaaggaatttcagggtgtaactgttcgttcagcatgacttaaccttatcttatttactcaagttttgtcagacaggaggacatataaaagataatggcagagcaaagaatagggcctacagggaggggctcacaacactgattgcacagccaaataaaaacttttcatcatcccaaatatagtagaatgtagggcccattatgaagtactgtaattatataaaacaggaaaataattcaattgaaaaatgtttttaaaaatatatctttggctgggtgcagtggcttatgcctttaatcccagcactttgggaggccgaggcaggaggatcacctgaggtaaggagttcaagactagcctgaccaacatggagaaaccccatctctactaaaaatacaaaattagccgggcatggtggtgcatgcctgtaatcccagctacttgggaggctgaggcaggacagttgcttgaaccccggaggtggaggttgtggtgagctgagataatgccattgcactccagcctgggcaatgagagcgaaactccatctcaaaaaataaaaaatgtatcttttatcctagtgtttgagtcaaaatacgttaattagcgaagaaataagactcttctggagatactgaagcacttcagtgtactctgaaatgttttgtaggttggcagcactgagtctcctctgacctcttttcaggtcaatattatagtttcttttgccttaatccagatgggatcccttcctcggctcccagcaaatagtcataattattattgtcctttcacatgaaatgaaaggaggaaatttaaaaaaatgtggaatagagaaagaaaagagaggaaggggggtgcagggagagagagagagatttctcagcattaaggagcaaatcaaagacagatgagaaggaaaatgagtataaatgatatatgtgtgtgagagagaaaagcaaaagagaaatgaatttaacttagaatagaaacagacatgaaggtgaggagcatgtgcatgtatattcctagcaggaagatgggatggagtaatgaggggaccagaaagtacctggacagagcacaggtttgataattcccttttgtaatgcaccaaaagttgccacttccccaaaccaaacaccagagggcagtgttggcccagaaccctctagctgctgcccagctgactgcaaggggctgtcaaacagaaaggcagcgagccttctctgctatgacaaacttttgaaagtgtggaacaccagtgggctcatagcttccttcaaaggggacttaacccactactggaagctatgagtatcagattattaattcaggtactctgagaattcttgcgatttatttaacttgagaagcctctagttaagttagaattgtttttactgctcctgatggtctgaattaagcctcaaaaactcatttgagtaagttaacattcagtcaacttaagctgcatatatattagaaagctattgatcttactggaataattattacaatggacagcaccccatctttgaagttttttcatacaagaatttaaaattttacacaaaatgatgactcatgcatagtttaattgcaggtgatataaacataataatatattatacgtaaggactataatactaagaatagaatattaatgtctatgattcatttgagccagacactatgactactcatttatgcgcagtctcacttttttctccacgacaaacttataaagcaagtactattttataggtgaggaagtcagagcttaaagacattatgtaacatgcaagaatactttctgagcagcgtcttctagcacagccattattctagaacagatgccaccatgactagcattactgtaggatagcactttatagtttagaaacattttcagccaggcacggtggttcatgcctgtattgccagcactttgggaggcaaaggtgggaggaccgcttgagcccaggagagttcaagaccagccttgggcaacatggcaagatccatctccaataaagaaacaaataaacaaacatttttacatactttatttcatttgaggcaagtagtctcataagctcccccatcttacaaatgaagaaagtgactcttaaaaagataattacttcctcaaagtcacacacctaaaagcttggtttttgtttgcttgtttttactatactacacaaagtaacaaaataatgaaagccgatctgcatgttttatactaggttttctcaaacttgcataatattaatattggaaaagaatatatagatttctacatatggaagaatatatggattcttttaaagaacttgctatattctctagtatctccaagaatacatcagaagactatccattgttcacaggactccatttgataaaaagtgatttaagttagttcctaattctattttttaaaaagttattttgacattactgcataagaggatatttccctaaatgctaaaacagaatgttcaaagactgttatcaaactaaatacacaaaacataacacttctcttagaatttacaaaccctgaaaatggcagtcaatttaagaaatacaactttatcctaaatatcttattctgttaaatctaggtcacccttgccattagtacaggagatccagatgagcaggtatggatggttctagtcttatccatcactactgctgaaaaaacacagaacgtttcaccaatgacagtcagtagtataattttcattggaggacaacacattgctattctgaactacatttttttccattggcaataactgtggttgtgaagacaaacaattcaaaggcgcttcaaataaatggcttgcctgttctctaggagatcgatttttttttttttttttttttttttttgagatagagtcttgctctgtcacccaggctggagtgcagtggcgccatctcatctcactgcaagctccacctcccaggttcacgccactatcctgcctcagcctcccgagtagctgggactacaggcgcccaccaccacgcccggctaattttttctatttttagtagagacggtgtttcactgtgttagccaggatggtctcgatctcctgaccttgtgatccacctgtctcagcctctcaaagttctgggattacaggcgtgagccaccgcgcccggccccaatgtttaatttttaaaagatgctatatatcctgattttcaaagcatctatttaacaaaacaatctaaatgtaagtataaagttaaatccagtgcttcactgggctgtgcaggtgtgacctaagcaataacacataaagactcatactcaaaggtaacatatgtactttagtcaccttatatgtccaaaggtagatttggggttccagcaatagaagtaaaccactgatttcatacttagcttgctggtcttacgattaccatttcagctttgataaaaacagaggtcaaatcagttagaaagcaaggtaaggattttaacatcctgccttctaaaatagttgcttttagatgattttcactgatctgtctccatggaaacgagacagaaaaggccaccaccaaccaaaagtaagaagttttccttgttaagttcatctgctggttgtcaggagatatgtggcccctcagtttagggcagctaccaagtgttaagtctgagagagtttgactagtaaataaatatgtgaaaatattgtctttttgtttgtttttccaattcattcttactttcagtcttcctttgcaattagcaaagtaactgatcttggtctttaacctatagcaaatacactagtataatatttacatgtatttttcttttttatttgaaagtcattgactttgtttagcactataagttaaagttcctcaaagaggaatcattcccgactatgtgcaatgtcataaactttagagtattctggaaatacattttaaaaatcacgatagttatatttgaacttgtagcaaggaatgccattctgccaaaaaaaatgaaatcatttgttacactggcagttcaagagcataataataagatatttataatagttttactcttgctttaaactactttgaaatccaataagaaaatggtatacattataaagttttttattacataaaaattagcaagacaggcatatgaaaactatatttaaatttcaaaggatatttctctcaattgaatagttaatagttaagagaactaaaaagctatttaaagctatttccgtaacactaaagttaagaatgctttttccatatttctatatcagtatttaaatggacatgcattaatataaccactttactcaatatagatatggcagattatattttgatgtattagtcaagcttcccccaatatttccctgtactccttcaccctcttttacgtaattagttagacaattctgtggttgcctaagagaaagcttgacagcagaaaatagaaaagtgatcagttttagactcttgcatctccaaaaggcagccatcgggaaagaaaaaagaacaccagagtttggacaaaacttgatagataagacccaggctactcagccccaggcttaaagactacccaggctaaagggaaagcaaggagaactcagaggtagggagacaccaaagaaggcggttccttgtctagtcccctaggttaagtgtgtcagtaagcagcctgtcagctccaagtccaccctttcattatccagcttgtgatactggaacatttctcccttgccatctagcaggatgctaagctctatcagaagagagccctggagggatgctgaaggaggatggatcttgtttcctggctccagtgatgctcctgcgttgccttgctgcggcagctcatagcaaacagcacatgtgggacccctagaggttggtgctaacccccagtcaaatccagtggcaccaactctgcaggtcgctccccagagaattccatggagcaacacctaactcagggtggcctcccctggtcccatggagggtgctacccagcacaataccctcaagtgctgattcccagtaagttccagggcacagtacctcactgtggagggcttgcccaggtcccccagagggacacttcgcttcaagtttctccagtatagcaccttactaatttttctgatcttttcagtaaggtcaggacttcgacctagtgtgggagtgcccaattctatatttgttcctttcttgggtgctctgcctcagccctagaggttgtgacttctttttgtgctcttcctacatcctttagatttctcttcccctccctagtagataatactcatcatagttaataattctttacattaaaccttccctgttgaaactatggtatggtttctgactagaccctcactgatacagatacaggttttaggaatgtcccagaagagcccatacagataggatttgggaactggtttgactgtgcccttggaactgagcccagtgctgagttttgtttgttcctttgcttgttgccaataggacatgggatgctagtaatccatggcatgcagttgcatcacaattaatcaggttatcctgatgaagtgccaactgaagcaggtgccttggaagcccaaatagctgctgttcttgactagtaaacagtaatgaagaacacaaggactatggcacagaatgggttcttttgaatgcattggagcacttacagaaagaaaatgacaagcttgggtcctttacagctcagctgaagtcatggtctgagacgtggaaagatcccaagatagccctaaaagaatccattgctttcttctgctacagtgctgatatggctgataatcgaaatttaatcgagcagcttactaaattacaaggtcggatgaagtcacatgttatcaaatttctcatgtgaaagttagaaaaaaaaagaattctaaaacttggaataggaacatcttgttgagactacccaagtaaaactaacaatcctaaaaccaaggtcactctgagccttcatagcaattaaaaatagcttgccactctgtgtctgagaacatgaacctttctttgcttgaaaaccctatgataacctcatctaggacaaatgtctttaaaagggatgttcatttcctcatgagatccaacacaatgagggtcaaatccataactagggtcctatttcaatatgatccaggggaattcatgtacaccatgacccagtatgaaataggaaaagaattgcaagattttgctattacatttcagcagcaacccagagaacatgtacaggagtggattctaagaagggtaggccaagaagggtaaaaactatagcactagatcaggctgaattcattgatatgggtgcacgtactacagactccagatttcacatgttagttcatgcagctggaagtagtttaactggttgtttgagtaaaacttgtacttaaccatggtctgtgtttgatgagggtaaaatgccagagcttctctggcatgtaaaggggtgatttcaaaggctcagagagacgggctcattggggtagatttaccatgtgtgacttgcacacccactccctaaccacattcagcaagaacatccagaagccattcctttcactaagacattgagaaatacattggaaaggggagcaccagcatccttgaaaagccctgtggttgctctcctttggaggccaggtatgacaccgaacgatacatgatttcaatgtatccagttgtcaggggccaactgacagcacttgaccactaatagcaaactgagagcatcttccataaagggcagcagggaggtactattatttagaatgccttagccaacagagatctttggcagtggttagttgactagggtgttcctggaaaagaaatagatggtctgcctattaaagtattccttgatcagtttaacagaaaagattatctaggtgtggtagacagaaacctgccctaagttgccattgctacagtgaagagttatagcttctcacacagtttccagatgcaagtcaattcaaagactcaaagccccttgattaagtggaaagctgggaccccttgaggaaggcccctgaaatattactacaagtgcacactatacattttcctccaaacctcccccaaggagaaccgcagccatttactagagtgactgtttactggggaaaaggaaatacacaggctttcagcaaatactagacactggttgcaaactgacatcaagattcctagagtcttatcatgttactgtggtacaccatttttaatgattttttgttttgggatgttttgggtagggatgggggttagttaaatgaaatatgagcccaatgggcccagttggtccatttaacttgtggtatttctcttcagtatctgaatatttagttggaattgccaaaactggcagctgacagcatcccccattggttctttgaatctagagcaaggcaatgtttatgttttgctcgtggatgtatcccaagtccctagaatagcatctggcacatagtaggcacctaataattatatgtcaagtgagtgaatgaatgaataaaccacataagatacacaattttagacttcaaaataacagtgactttcatgtccaaaggtcttctgcacttctttgtctaaaaaaaagattttattaaccatatataacagagccttcaagttatttctagacatatttctgtcaataattaatagccattttttagcactgattattttctcagtgctaggaatcactgagatttacaagtagaaaattttaacaattctggattttgtgtggttttggctttcactctctgaaaggtcctattttcaacctagcattctcagaattaatgtgtgggcactattttcctctttctttcttagagtaaagctgcttaagagcaaagaatcccaactccgtctccacttgcacccctacaggagggccatttatggtgaagtttggtttgtttgggcactaacagtaagagaggatgttaggaatcatagggaaaatcccatatatttgctttgttactctactgccttcccagctctgctgctaaactaaagtgtccccacatgtatgtagctggggaggataagaacaagaattcaatctaaagtcctccaaaatagttcttcagcaatattagcaccaaacttgcatttaagatgaaaaggaaataaaaagctagaacactgacctgtgtgatatagattattttgtgcagctgaattaatatctgctgaataggatcactgatctgacgcactttcctctgggacacagcaattcctgctgatgctgtgggtgataaattttgtagttagtcaagttctctttcaaaagttacattagtgaaaaaatgaagtaaaattctaacacaaattttaaagcaaagacttcaccttatcaatgagacaatatgcagagaccctgtaatacttcaacattttatgacatggaataaaaaatatcttccctttacttctcagacttctaagtaacacaatgatattatctataataacatctgaaagactgcttatcacttggatattttgctggcaattacagcaggctgccatcaggagtcagcagtgccttagatacagtagccactgaaaagccaggcttcagacatgtatagttaagaggctatcatgcttttaacttttaaattcattatgccttccataacatattttaagactaattttatcaaaactataaaatgtaatcactgaacattcttacagagcaaaaaaaaatgaaaattcttttagctagaattaaataactttcaaacctttgattattacaaattataattttcacatagatttctctccatgtctaagtagggcacatttataatttatcctgaattctcatcatacagccacaccaccttcacagttttcagactaattcagtgtcaaattacatattagttgctttcccagcgtcctctgccatagccacagtctgttcttaacctgaggactataaaactatttaaaggaatgactcttttctctagattacctacaaggccacctctgcctcttttcacccacagaaccacactggataaaacaaaaagagacttcagatatgtgatgtgcattatcttccttcctttctcttccttctctttctctttcctttcctccccttaacctagagtgtgctttccgcaataaaacttctcttgctaatttccttttaaaaaaaaaaaaaagatgaaagttccaaagaccctcttttcttcccttcacacaacattgagctactatgaagttaaacatgaatatagttattgctttaacaacagctaaacatctttaaaaacgcttctattataagcacttcctgagaaagcttgcatattttaccataaatattttgttttcaagacatttaaagagaacattcaatgcagtcatttaaaagagtcaacttgttttattataagcacatgaaaatgtatatttaagacataaaatgcaaaaaagaataaaatataaacattcaaagaaatactactttctttacagatatctttactgagttagtttagaatttagcacaagaaataatctagttctagctcatctgcagttaataccttgtttaaatgtttgaaatttaaagagtctctatcccatggacacaatgtttactccttttaatatgaattatttgattattaatatgaggtttaataaatacccttgggataaaaatgtaaagaggcaaatagaaagagttaatgtagctctaaaatagaaaacagagagctggagttgtctgctccatcttgtggagatggccaagtgtacacatgccatattttctacagtagtgcttcttggagaaataattcttaaaatgtaactgttcgtctagacccaaaacaaatactagacagtgtgtaacatgaccaagttgttattgctacagaaaaattaactttgcattctctgaaaatggagagcttgattttttaaaatcatttttatactatgtttctgatttgtagatgcaacattcatagtttatagattcatagattttaatgagttaaaatctcacaacatggcaaagagttcttagatctgtgatgacattttgaatgggatatcacataggtttgactctaccttgccacaagaatgtgcccatctgtggccctaaatacaaaaacaaagagttagctagaatgtcttccttctgaattaatcaactatgcaatttttttaactcaaaaattatttttattgagaccctttgaccactaccctcacaatcccaacacatccttgacttctggaaatacttttgattacttagttattaaaaaataaagttaaaaatatttaattacgcatgcccctataaaaacaagcaagcaaacaaacaaaaatgttagttgtacaaatgagattcaaggctcccaggagccaccacccatcacagccacctccccagaaataacctgtgatatcagaggggtgtgttgacttccactcacttctctatccatttacatacataaatgtacacttcaaaacagtgtttttcaaaccatacttgagtcctgaagccaattttaatgttatgatcagcattttgaaaaatgatatcaaatgaatcggaactagattttaaaatttcagagtacattggaagggtccactcagccaagacataaaatgcgttttctattgatagtcatttccaagcatttgaaagctactattatggaaaatctatagcagtctgtccgtcctcccttcctcctttcctctctttctctcttgcactcttcctcccttctttcctccctccttccttgccttcctttgtaaacaaatggtgacatatcacatcacataaactgttgtacaatttatttttttcacttagtctatcatggagatggtttattatcaacacatgcagttctagcccattctctgtaaccgctgaagactactatgtgtcctggatgcactgtagtttacacagccacttctgtcctagtggacacttcctttgctttcaatttctcatgataataagtgatgctgcagtgaatatacaccggcatgcctcattgtgcgtaagtacaagagttattttagggtagacacagtgaagtgaaatagctggacccaaggatacattgtaacaaatacatttttaagtggctgagtcaatttacactctgaccagaaaagaatccatttttctacacctcggtcaacaatatatattatcaaacttttccactgtgccaatctgattgcttttgtatttatctaaacgctagtgaggttgctgtacttctttggtaaatttcttgcttgtatccatagttctttgttcttattgatttgtaaatgctctttagatattctgaatactcatccttttattacattattaaaaaattgaaacagggtctcactctgtcactcaggctggagtgcagtggcatgatcacagttcactgcagcctctgcctcctgggctcaagcaatcctcctgcctcagcctcccgtgtagctgggaccacaggcatgcaccaccacacttggctaacttttatatttttagtagagacagggtttcaccacattggacaggctcgtcttgaactcctggcctcaagtgatccacccacctcgacctcccaaagtgtatttttattcttcatttaaatgttattaactgccaaacatttggcaaatgttagccataacattttgtctagctttaaaaacattctctctcagtatatcttttagattagcccactgaaaacgctacactttctgactgttcaccaaaaaaaaaaagcagcatatatttatattatcaattttatactgagaatatttgtattaaaacaattttttattaaagagacatcggtgaggctgatcacagttcatgtgcaatgtcagtcatacataatatgcccatgattcatatctatgtggtatttcctactgcaaaatatatacacaatatttggtctccttaaaatttaaataaaatcaaagtttaaaatattgggatactttgtattcttttatagtttttattaaaatagtaaatttggctagtgttttaaaacttagaaggaaactacgaaatttcttataagaggcaatttacttaaaagcgtcaaaaagtcattacataattatatttgctagcttactctgttgcaagcatgacgctaaagagctattttgtttcccctttgcagtgttaggtcagaggacttgcaagaagagcagtccttcttttttagcaagaacttgggtgagaaactgggaggtgttttacacatttagtctgctttaatccacagaggagactaaatgcataaaacacctcccagtgcctgtaaactgtctgctcctttattggtgtagattctacccccattttacagatgaggagactgagtgctgtggtctaaatgcttctgaaccaccaaaattcacaggttgaaatcctaatccccaaggcaatggcatttggaggaagtgagcttgggaggtgattaggtcctaagggcggaggcctcatgaatggaatcagtgccattataaaagaggccagagggaggtggtcacccccttctaccatgcaaggacacagctagaaggcgcctctggttactgcaaatacaaaacaatatctccttcccataatgaaatattatttctcttcttaaaaggactgctacttttaacacgatgttctatctatctctctcaacatttaattaattatttttggaaagcatgtagacataataagctggaagcattaggtctttacagctagtgctgtgcactacattctgctttagtatatcattgcataataaaatagccaagttagttgcccatccctggtgctttgacacttgacacttgacacatactatatgtccattctattgaaactataattcacaatatacactttgaagctgttaataactacaaattaaacccaaaaaagtgggttacactgtactctcccaattgatcaaaatatggtatcaatgcattatttttctgaattctctcagctaaggatcaggaacttttggacaactggagaaaaaaagggttaaggaaggaaatccatgaagaagcaaaaaatatattgttttcatgaatggggggccaaaacacacatgagcttctctatattggaccaacagtgttgtcaaactacaatacaaatttactctcacctctttactatcataacaatgaaataaagtaacgtaattgtagttcaaatctgtaagtgttcagcaatcaatccctgtgtccctggttagatgaagaatcttgaactcataaggatttcatagaaggttcacccagacaaccatggatgtaggctaaagagcaaattcaaatgttaatttgagaagaccaggaagaattagaaggtcttcgatagcacaggaaatgtattgggtgtgagggaagttgtatgtgagtgtgggttcttaggagaaggaataattccagcaaagagtgaagtcagctaagtgagggctgcaactgaagaacagcaaactgttcagtttagctggtgtgcagtacaataaaaaaagtacagtatgtatacagctggagaggtagccagggaccatacacgatggtgagaaacaataaggctgactgtatttcaggaaaggtgatctcacgggaagaggatcatacagttgaagtcagaggcctggcttgcattgcaatatggttttcagaaagtcacaacttctttgggccttagtttcttcatatgaaatggcagaatggtaaaaatgggactagaaccaagggggctgaggtcatacacgttgtggggtgaatcaatctacagtgcactgtagctgtttccacatggggagcaggagccaaggactgctgaagcttgggactgagacactgagaatatgatgttccatcagaagagagagggaagtgacagaggatatgatgcatggacaatggaaacttcccaacacagaccagtagaccattctataatcagacaaaaagtgtttggaaggagcttggcagtctaggcctagatgcccctgctaccctagcctccggcagagtttctcacagaatggcaggaagctgagtcaaagcatcagctcctttcacctctgggtgatcaggcaacaaacttcctttcatttgaaacttcaggaataagctgtttaaaggccagaggcaaggctgctttgaagtccttaactcttgaattctggctgagcctcttttaagtaatgtgtcttatattcccataatgggtaatgtcacagtatatttaactaacaatctacaccaataaaggagcagacagtttacaggcctgtagcgttagaggttaacctgcagaaattaatatactggtatgattttacacccagtcaagaacttgatcacaaaaatggtatcattttattgccctatagaagttctaccagtcttacgcttaatttagcaatcttatgtcagcccttctttcttgcctaactacataaatctctgttcttcaaatgctcttgaatcagcatttttgtcttccacctggttctatcatcaatgcattgaataaaactcagacacttgccaaagaacaactttaagaattgtgcttttgcaccccaatataaaaaataataagtagttatataaacagaaaaatttttaattgacacactatatgaaacatcccaaataaattattgaatccatactgagcagagtcaattaagaatgaacaaggttccagctatagtggagggcaggcaggtatcccagagagaagaaagaggcctcttgctttcaggagagggaactgctgtagcaaccattatagaatggtttggacacagccttagttgtatcaacatttttcttgaagaaagggaattaatagaagcttaatgactgattcaatgattaatactcccttatggtttaaatgtactctgagatccttaaaaaaactactccccagacaggagccaacacatggatagattcttagctactggtgcttacatttctacacaggaataatttgattagatgtccatatgtatgtccaaaatggtatggctcatgtgcaacagactccacatgaacctaaggtctttgatatccaggtttcttcttcttataattggcccttctgtcactgtcctcaattctcaaattggtcaatgcaacaaactaattcaaagcatatttgtaaatacttttaacatatttttaaaatccactataaattactaataatggcaatttggaatttgagggtgatgcttttcgctgttaattcaattattttacacaccatgctacaatcatcacccaagtcatgctgacctacctccctttactcctaccagagagtgggatacctttcaacccttacttcctttagcctttcctcccaggcagaaacccaaatggcatgagtgtgagttgccatttaacaggtgatatgcaatttggatttaggcttgaattggaaccaccagtaactcttgtgagatgagtatccatttgaaaacacattaccctaaaatgaccatgaaaaaaatctacatctccaagaagcatcctcctgggaccctgtacacagtcgtttggcacctcccttggcatgaagaatgaggaagcaaataatcattggtaaaggaaatttcttatctcaatctgaaatctaaaatatatatgtatatattttaatataataaaataaatttaataaaaataaaatattttaaaagtctaatacaaaaaaatcagtgattccctcactgcttctgattacttatgcagttgctctcaatacaatagcaaagataaacaagagtttatacagtgatgggtctaaatcagttactcaataaatagttttcaagggcctgatctcagaggaaatactccaaggtatttacaagtatacctcatttcattgcaccttattatattgcacttcaaagatgttgctttttttaaatttttttacaaatttaagttttgtgtcaattctgcattgagcaaggctactggcaccatttttctagtagcatgcatttacttcatgcctctgtgtcacattttggtaattcttgcaatatttcaaacattttcattattagatctgttgtgatgatctgtgatgacggatcctgcatgtcactattgtaattgttttggggcaccacaaactgcactcatataagatagtaaacttaatggatggatgttgtgtgtactctgactgttccatcaaccagccattcccccatctttcccttcttcataggccttcctattccctgagacacaacaatactgagattaagccagttaataatcctacaatggcctctaattgttcaagtggaaaaaagagtcacatgtctcttactttcaatcaaaaggcagaaatgataaagcttagtgaggaaggcatgtcaaaagccaagataccagaaagctaggcctcttgcatcaaatagttagccaagctgtgaatgcagagaaaagatttttgtggaaaattagaagtgctacaacagtgaacacatgaataataacaatgacagccttattgcttatatagagaaagatttagaagataaaagatcaaacctgccacaacattcccttaagccaaagcagaatccagaggaaggccccaaccctcttcaactctatgaagtctgagagaggtgagagagctgcagaaggaaagctagaagtagtagatgttggttcgtgcagtttaaggagagaagccatttccataacataaaagtacaaggcaaagctgtaaatgctgatatagaagttgcagcaaggtaagatcttcttatgatccagctaagataactgatgaagatggctacactaaacaatagattttcaaggtagacaaaacagccttttattgcaagtagaggccatctaggactttcatagctagggaggagaaatcaaagcctggcttcaaagtacaggctgactctcttgttaggagctaacgcaacaggtaatcttaggttgaagccaatgcttattgaccattccaaaaatactagagcccttaagaattgtactaaatctattctacctatgctctataaatagaacaacaaagcctggatgaaagcactctgtttattgaatattttaagccaactcttgagatctactgccctgaaataaagattcctatcaaaatattgatgttctttgacaaaatacttggtcacctaagagctgtgatgagaaggtacaggatattaatgttgttttcatgtatgctaacataacatccattctgcagtccaatgatcaaggagtcattttgactttcaagtcttattatttcagaaatccgtttcataaggctatagctgcaatagatagtgattcctctgatgaatctaggcaaagtctattgaaaacctcccagaaaggattcactattctagatgtcattaaaaacatgtatgcattttagctccagatcaactccaagaacaaactaggaatcctgagaggattcacagaccctctgaaggaagcagactgctcctgcaggacctaggagacaccccaaatgctccagctgcagcaagatctgcccaaggagagtctgagctctggcacacctagctctgcccccacctgatggttctttcctacccaccctggtagcggaagacaaaggacgtataatcttgggagttctaaggcctcacacaccgctagtccctctccatgctaccatagctgatggtctttggaaaacaccacctcccggaaggaggccaaccagcacaaaaacagagcattaaaccaccaaagaacccttatggagtccattgcaacccccgccccaccacctccaccagaacaggcactggcacccacggttgagagacccatagatggttcacatcacaggactctgtgcagaaaaccctcagtaccatcctggagctgggtagacttgctgggtggctagatccagaagagacacaacaatcactgaggttcagttcacaggaggccacatccataggaaaagggtaagagtactacatcaagggaacaccccatgggacaaaagaatctcaacaacagcctttagccctagatattccctctgacagagcctacccaaataagaaggaaccagaaaaccagccctggtaatatgacaaaacaaggctctgtaacaccccccaaaaatcacacttgttcaccagcaatggagccaaaccaagaagaaatccctgatttacctgaaaaagaattcaggaggttagttacttagctaatcagggaggaaccagagaaaggtgaagcccagtgcaaggaaatccaaaacacaatacaagaagtgaagggagaaatattcagggaaatagatagtttaaagtaaaaacaataaaaaattcaggtaacattggacacacttatagaaatgcaaaatgctctggaaagtctcagcaatagaattgaacaagtagagctcaaagacgaggtctttgaattaacccactcgaacaaagacaaagaaaaaggaacaagaaaatatgaacaaagcctccaagaagtctgggattatgttaaacaacccaataccaagaataattggtattcctgaggaagaagagaattctaaaagcttggaaaacatatttgggggaataattgaggaacaattcctagccttgctagagacctagacatgaaaatacaagaagcacaaagaacacctgggaaattcattgcaaaaagatcatcacctaggcacattgtcatctgttatccaaagttaagatgaaggaaagaatcttaagagctgtgaggcagaagcaccaggtaacctataaaggaaaacctatcagattaatagcagatttctcagcagaaaccctacaagctagaagggattggagccctatcttcagcctcctcaaactaaacaattatcagccaagaactttgtatccaacaaaactaagcatcatatatgaaggaaagatacaatctttttcagacaaacaaatgctaagagaattcaccactaccaagccaccactacaggaactgctaaaaggagctctaaatcttgaaacaaatcctggaaacacatcaaaacagcacctacttaaagcatatatcaaaccctctaaaacaaaaatacaagttaaaaagcaaaaccaaaaaacaaaaaaaaaacaaaagtacacaggaaacaaatagcacaatgaatgcaacagcacctcacatttcaatactaacattgaatgtaaatggcctaaatgctctgcttaaaacatacagaaccacagaatggatcagaactcaccaaccatctgctgtcttcaggagattcacctaacacataaggactcacaaaagtttaaagtaaaggggtggaaaaaggcatttcatgcaaatggacaccaaaagtgagcaaggtagctattcttatatcagacaaaaaaaactttaaagcaacagcagttaaaagaaacaaagagggacattataaaatggtaaaaggccttgtccaacaggaaaatatcacaatcctaaatatatatgcacctaaaactggagcttccaaatttataaaacactaatagacctaagaaatgagaatggccaggcgcggtggctcatgcctgtaatcccagcactttgggaggccaagtgggcagatcatgaggtcaggagatcgagactatcctggctaacatggtgaaaccccatctctactaaaaatacaaaaaattagccgggcatggtagcgggcgcctatagtctcagctactcgggaggctgaggcagaagaatggcgtgaacctgggaggcgaagcttgcagtgagccaagatcgtgccactgcactccagcctgggcgacagagcgagactccatctcaaaaaaaaaaaaaaaaagaaatgagacagacagtagcggggacttcagtactccactgacacaattagacaggttatcaagacagaaagtcaacagagaaacaatggatttaactaaataccttgaaacaaatggacttaacagatatatacagaacatttcatccaacaaccgcaaaacatacattctattcaacagtgcatggaactttctccaagatagaccatatgataggccataaaatgagcctcaataaatgtttaaaaattgaaattatatcaagcactctcttagaccacagtggactaaaagtggaaatcaactgcaaaaggaaccttcaaaaccatgcaaatacatggaaattaaataacctgctcctgaatgagcaatgggtcagaaacacaatcaagatggaaatttaaaaattctttgaattgaatgacaataatgacacaacctatcaaaaggtctgggatacagcaaaagcattgctaagaggaatgttcatagccctaaacaactacatcgaaaagactgaaagagcacaaactgacattctaaggtcacacctcaaggaactatagaaacaagaacaaaccaaactcaaacccagcagaagaaaggaaataaccaagatcaaagcagaattaaatgaaattgaaacaaaaaatatacaaaagatacatgaaacaaaaagctaattctttgaaaatataaataaaattgatagaccattatcaagattaatcaagaaaagagagaaaatccaaataacctcactaagaaacaaaacaggagatattacaactgacactatggaaatacaaaacatcattcaggtaactatgaacacctttaagaatataaactagaaaacctagaagagatggataaattcctagaaaaatacaacctcctagcttaaatcaggaagaattagttaccctgaacagacctataacaagcagtgagactgaaatggtaacttaaaaattaccaacaaaaaaaggtccaggaccagagggattcacagcagaattctaccacacattcaaagaattggtaccaatccttctgacactattccataagatagagaaagagggaaccctccctaattcattctatgacgccagcatcgccctaataccaaaaccaggataggacataatcaaaaaagaaaactatagactgaaatccttgatgaatatagatggtaaaatccttaacaaaatactagctaacaaaatccaacaatatatcaaaaagacagtccacgataatcaagtggatttcataccagggatacagggatggtttaaaatacacaagtcaataaatgtgatataccacataaacagaattaaaaactaaaatcaaatgatcatcacaatatatgcagaaaaagcattcaacaaaatccagcatccctttatgattaaaactctcagcaaaattggcatacaagggacatacctcaatgtaataaaagccatctatgataaacccatagaaaacataatactgagtggggaaaagttgaaagcattctctctgagaactggaacaagacaaggatgcccactctcaccactactcttcaacatagtactggaagtcctagccagagcagtcaggcaagagaaggaaataaagggcatccaaatcagtaaagaagaagtcaaactgtcaccgtttgctgtcaatatgatcatttaccttgaaaaccctaaagactcctccagaaagctcctagaactgataaaagcattcagcaaattttctagatacaagattaatgtacacaaatcagcagctcttctatacaccaacagcaaccaagtggagaatccaatcaagaactcaattcttttcacaatagctgcaaaaagtacaaatactggctgggcgtggtggctcacacctgtaatcccagcagtttgggaggccaaggtgggcagatcacgaggtcaagagatcgagaccatcctggccaacatggtgaaaccctgtctctactaaaaatacaaaaatcagctgggtgtggtagcacacacctgtagtcccagctattagggaggctgaggcaagagaatcacttgaacccgggaggcggaggttgcagtgagccaaaattgcgccactgcacaccagcctggcaacagagtgagactccatctcaaaaaaataaataaaataaaataaaataaaataaaataaaataaaataaaataaaataaaatacttaggaatatacctaaccaagaagttgaaagacctctacaaggaaaactacaaaacactgctggaagaaatcatagatgacacaaacaaatggaaacacatcccatgctcagggatgagtagaatcaatattgtgaaaatgaccatacttccaaaaacagtctacaaattcaatgcaatccccatcaaaataccaccatcattctcacagaattagaaaaaacaattctaaaattcatatgcaaccaaaaaggagtctgcatagccaaatcaagactaagcaaaaagaacaaatctggaggcatcatactacctgatttcaaactatactataaggccatagtcaccaaaacagcatggtactggtataaaaataggcacatagaccaatggaacagaatagagaacccagaagtaaacccaaatacttaccaaccaatcttcaacaaagcaaacaaaaacataaagtggggaaaggacacccttttcaacaaatggtgctgggataattggctagccacaagtaggaaaagaaactggaccctcatctgtcaccccatacaaaaatcagctcaagatggattaaggacttaaacctaagacctggaactataaaaattctagaagatcctagatcttctagaattctagaaaaatccttctagagattggcttaggcaaggatttaatgaccaagaaactaaaagcaaatgcaataaaaacaaagataaatagcagggacctaattaaactatagagcttttgcatggcaaaaggaacagtcagcagagtaaacagacaacccacagagtgggagaaaatcttcacaatctataaatgtgacaaaggactaatatctagaatctacaacaaactcaaaaaaatcagtaagtaaaaaacaaacaatcctatcaaaaagtgggccaaagatatgaatagacaattctcaaaagaagatactcaaatgaccaacgaacatacgaaaaaatgttcagcatcactaatgagcagggaaatgcaaatcaaaaccaaaatgcgataccaccttactcctgcaagaatgaccataatcaaaaaatcagaaaacagtagatattggcatggatgcagtgatcagggaacacttcttcactgctggtgggaatgtaactagtacaatcactatggaaaatagtgtggagattccttaaagaactaaaagttctttaagccagcaatcccactactgggtatctacccagaggaaaagatatcataatacaaaaaagatacttgcccatgcatgtttgtagccacacaattcacaattgcataattgtggaaccaacccaaatgcccatcaatcaaggagtgcataaagaaactgatatatatatatatatatatatatatatatatatatatatatatatatatgatgaaatactactcagccataaaaaaggaatgaattaacagcatttgcagtgacctggatgagactggagactattattctaagtgaagtaactcaggaatggaaaaccaaacattgtatcttctcactgatatgtgggagctaagctataaggatgcaaaggcatgataatgataaaatggactttggggacttggggggaagagtgggaaaggggtgaggaatagaagactacaaatatggtgcagtgtatactgctcaggtaatgggtgcaccaaaatctcacaaatcaccactaaagaattgtaccccaataacttatggaaagaaatttaaaaaatttaaaaaattatgatgaatggtcaaaatatcaacagtaacaggagtttggaagaagttggttccaactctcatggatgactttgagggtttaaaacttcagtagaagaagtaattgcaaatgtagtagaaatagcaagagaactaaaattagaagtagactgaagatgtgactgaattgctgcagtctcatccaaaagcttgaatggatgagcagttgcttcttagggatgagcaacaaaagtggtttcttgtgatggaatctactcctggtaaagatgctatgaacattgttgaaatggcaacaaataatttagaatagtctataaatttagttcataaagcagcagtaggtttcaggggactgactccagtttttgtaagaagttctactgtgagtaagatgctatcaaacagcatcgcacgctacagagaaacttttgtgaaagactgaattgattgagcaaacttcattgttatcttattttacaaaattgctacaaccaccccaatctttagcaaccaccagcctgatcaatctgcagccacctacatggaggcaagaccctccaccagcaaaatgattatgtcttgttaaaagtctcagatgatctttagcactttttagcaacaaggcatttttaattatagtatatatatttttagacataatattattgtgcacttaatagacttagtatagtgtaaacataacctttatgtgcattggaaaaccaaaaaattcaggtgacatgtttaattgtgatatttgctttattgctgttggccgggacggaacctgcaatatctgtgagatacacctatatctatcaaagttgcaatgaaggtgcttacaatctggttggaaaacatagttaatacttcacaaatcccaacaatgtatataattatatgccaaattatatagtatagactagtatcatagaagttttgactaaaacctgtgagcaaatttttatatgattaaaaatgctatgcaacataataaaagaaggtatgtacttaaaatcactttggcaattgtgaagatgagttttaagtactttatgttaataattaacttgaaagtaaactactaaaagttgttcgtataaggacaactagaatgttagctatgctttctagaatatttgagcaaaaaataaaaaacattgacaatttgatttagatttgcctttactaacaaaatggaaacataaaaatagattcatagtcatccaataggaaaacataattaaggacccagaaatcataaagtgacaatttctattcaaaatgcagtgcataagaacccatacatcggttcagcgcctgggtgtcaggtgctgtctaaataaaaacctgagcaagggaggggaaaatgtcagtgttaatccagtcaaattaggccagatttttagttgacattatatttgcacttgaaaatttaggtttgacttacacacccaaaaatttacatttgacccacactaatagaatccataacattatagtatgtacttgaaaagaacacgtttcctgtgttatatttttgtgtgatttaattttcacaaatatatatcatttcccttgtcttgaaaggaaacgattatttcttttttatacaagacagacctgagacctttttccccaattccaaatacttggtaatatccagttgtttgattaactgatttgactttacagaccacagaatcaatctatttttaaagaactggggacacctacacagcctaatttcattagtaggtatatcaggtatgaaatagtccagtaggaaacgtattccttttacagttttctttctgttgtttatatcaaggattaagtttcagtatcgtgcaagtatgttttcatcatttctcaaatattaggtaatgttcctttacagcaaagacaacagacctcagcataagcagaaaacaatatctacctggaatttaatgttgtctttcttagatttgtatttacttttacaatggttatctacttatggcaagtgatactatactggttctcatttacagaaataataacaactttcctctaaaaatgaatttaaattgagttagtcgatgtaaagaaaaatatcaggaaaattatagtacatatagttctcagacataggcaaatttgtaccatggtaattcactagtgactaaagctgggaaaacagagctaaaataattaacatgttaaaatgtttcttcattcagttattcatattaattactggtaatattttcatttgtataatatatgaattcctaagttttctattggcagggaattgcaatctattatttaattgaaataatttgtagaaaataaattattgatacaatttagtaataaaagatagaacaaggggatttttaatacaagtaatgtaaaatagtttcattgttatttgttctagaagagtttggaggtactgctgttattaccatgacatgaacctagaagttcagcttttaggagtaccatacaggcaagatcatattacaatataggcacttggcactctaaaataatggttccaaccctgtattctgccataatacatgggaaataatgttcacatactagatatattcctggggaaatgctctgattttggcaaaattctcccctttctgctttttccggaacatttaggcaatacagggctgtaaatgttggttatgcataagttccaacatgttcctttctatccaagaaagcgagaccaaatgttaagtaaatgaaaatacactaatataatcagcttattttttttaaaaaaataaatcattcacaaatttaagtgctttacctatttttcataacaaatgcttaaggtataactcgctactgacaggaccaacaacgtctcatgacaccttggtccaaacgtactactttattgttggactaccagattaatgtcacttctctatactttagttaagacagagataccaaggtaatgactggattacagcatggtttgcagatgtggtgacctaagtgaatggcactggcaccagctgtttataatttgataaagcaaccaatcatccaaattgacttgcaacacttaaaaggtatgagttttatagttaatggaaaaaaccttcatatgaaggttgagaaaaataaagttctcattttctgacatgaaagtagagtaactctcaggtggtaacccaaatgttccctgtgaattaatgtgttgtacaatattagcaaaacctaaccactctttttatgtacaaaatctagcactcactgataacaaaatggccaggagtggtggctcacatctgtaatcccagcaatttgggaggccgaggtgggcagatcacttgaggtcaggagttagagaccagcctggccaatatggagaaaccccatctctactaaaaatacaaaaattagccaggcatggtagtggacgcctgtaatcccagctactcggtaggctgaggcaggagaattgcctgaacccaggaggaggaggcttcagtgagctgagatcataccactgcactcaagccttggcaacacagggagactctgtctcaaaaaaataaaaaatgcttttgtgtattctgatacaagttttaacaatatatgaatcagcagattttaaagaattagatgatatagcaaactgtagggataagaaagaaatgtatgtaaactctgccataatgtaaatagtttgtttaaaggtccagagatctgatcagtgccaccgacataaaatcaagtcttgcactgaactaagtcaacatactgtttaggaaaaagaatttctaatatggattacaacagaactgtcaattgcttacatatatatgtgtgttccattcttgctgttggaacatcaattaataacaatcatcttaatttcataattatattttgaacttaccttttcaaaataacaggagcagagcatggtcaacatgatagtttcaggcatcttaataaaaccatcatttttggcatctatgctgacattgtaatggcctcaaactgtcaataactcatccaaagcaaatttaataaatgtggagacatgggctaacattacagtcagtttgcctatattcactataaacattagctctacaaaagaatgtgaatcaaggaagctgaagtgaaaatagcattaaacaataatcccaaattaaccaatagtaaagtagaactctatgctcaagagttgtatgctcacacatatgataaaagcataatcatcaaacttttttctgaattgtctaggtttagctaataatttaaatgttactgatggactttggtcctctttcacaaaaattagaaacattaacacattcttcccaaacctctattagaaacttttatgtttaaggatctataatttttcaattattagggaaacaatgtgatatgtcattttaatcgtgggcggatcacctgaggtcaagagttcaaggccagcctggccaccatggtgaaaccccatctaaattaaaaatacaaaaattagccaggaatggtggcaggcacctgtaatcccagctactcaggaggctgaggcaggagaatcacttgaacctgggaggtgaaggttgcagtgagccgagatcgtgccactgcactccagcctgggtgacaaagtgagattctgtctcaaaaaaaaaaagaaaagaaaagaaacataaataagtaaaagataattatttgtgtaagggtagaggagatagaaaaaaatatgacttactttcttcattctacatgtatcatgtaggtgtagagtttacagaaatacctatgtaaaacatggttactattttttgtttgtaggtatgtacttgaagcatcaataggtcaactggttaacattcccgccacggcagaaatgcaaattttggaaaaaacagcccataatatttcaaccaacagtgaacacagaaggcattttgttaccatcaaatcgccaaactaataatggtgaacaaacaaggcagaattctccgctctttgtattaaaattaccacccaagcatcgttcagacatctcaggcccaactataattctgcatttgcccattgtgtgcttaacatcaatgtgatctagtaagtactaccatgatctttgagatttcgaagaatcacagcaggaaggctatgggactgccaccctgtcactaactcagcctctatttccttaatgtgggccctgagcatgtggggtggcactttcagaagcaggtcaagaggcagcaaagctgaagaaataaaagggggaaagatatgaaactgtaacataaattacattgaattttagagagttgtgtttgattttattgctaccaacactaagttacctggtcttggtcttgatcctgttcctccagtgaagtccctgaaaatagaattacaggccattagaatgacctgttcaacttggatttgacaaactaagagcctacatcttgctatggtctacattataaagattaatagagattattttccctcaagatgctctcaagagtttaattaagagggaaataaatatattgcaataaacagtacaattgacattctactgacaaatgacagaatcgtcccaccacagtttttaggctctaagtatgactaagagcctaaattttaggatcctgaataattttctagttacacttaaactcaaaatatgattttgcactaaaaggatataagatttaaaatgttatatatagtattttctatgatttgtccctgctctattaaaaaaacaaaaaaaaccttatacctcctcctataaaatgttttttgcattgaaaataattatctttcctaaagttgccagtgttattaacatcccttgtttgccttgccccaaaattctaggttatttgatcattttacgagttggtctcagtgtcttctactctgtggaggtggccttagaccccaccagggatatctgtaaatcaccttcagccttgttttttccactgtaccctagaaccaatttttctttttttttttgagacgagtctagctctgtcacccaggctggagtgcagtgacgcgatctcagctcactgaaacctccacctcccaggttcacgccattctcctgcctcagcctcccgagtagctgggactacaggtgcccgccaccacgcccagctaattttcttgtatttttagtagagacagtgtttcaccatgttagccaggatggtctcgatctcctgacgtcatgatccacctgcctcagcctcctaaagtgctgggattacaggtgtgagccaccacgcccggcctagaaccaagtttttaatagttttctggaatgaaataagaaacatctgtgccctgacaagttgtaagaatcattcttaaacttaatgaaatccaacaaaaatatatcatacatgtactaggtataaggcacatgataggttatttgttaagtaggaataaatataggaattcaaatacaagtaaacatggctgataattctcttgtcccaaccttttcgttttaatcatagaatttttgatacatgcatgcaacacctacctaagttattaagcgtaacaaaattggcactcatttacctaccacccaacttaagcactagaataataccaaaatctttgcatccacctatgagtttcttccctgttcctttccattccctcttgatcctcaccaggctaacactctcttgatctcataatatattttgttccattctgagctcaagtttccagagccttgaaaagtaaatggaacctgccagcctttaacagtttatatactttccctaacctgagataaggagcatgtttaaaaaaagaaatgaagctgatcctgccctcagaaagtttgaaaagaggcatgatgacagcagtgcccatgtgtaggcaggacagccccagggctgagctgaggagcagagcatctgttccagttccttgtatgcctgcacaaatgccataccccagcaaatgctttccgaataactttgccccttacccttctagatgaagctagtactgtctaatggaaaccgattgtaagcatcaaacataattttaagttttctggtagccacattttcaaaaagtaaaaagaataaagtgaaataattctattttatttaatcaaaaatatccaaaatattatttcaacatatacaaattgaaatcttattattttacatcttaattaatattaaacaaaattaaaaattcagtccctcagttgcactggccacatttaagctgctcaagagtcacatgtgcccagtggcctccatacttaacaatgtggtccaggcccttccttaagtgttggtcattgtcttcatacatttattacattcatgccatgtagctgctaaacctgcaatacctcctgaatcccactctcttaaaaagtgaataaaaatgcaacttgtggcaaacttgtatccatcaggttatacatgttcttgaaaagctgataatcactcacatgatgagtttgcaagatgactattccagatgtcctgaagaatctaacgtttcaaacatttttacatattaacaaatgttatgcataatgtgtgctagtgggatatgtgacatagaacaccctgacaatgctgagttgctgccgcttttgctattcctttatataattttaaattcctctttaataaactttagggaatcttcaaaaagaacaattacacattcattcattcattcaagaaatatttattaaatgcccacgatgtgtagccaccatgctagacactggagatgggatggtgaaaataaatagtttccacagtcttagaatttacaagattgcatagagatagcagaaaataaaatgtcaatttctctggaaattatatcactaaccgcaagaaaatatagtcatctgaaatttcaaaatagaacagactcattgtcaccagaagtgacagcttttaactatgcaattgttgggttcacagatggacaaatggttgaaattatgcagagcctgggggaagtctgcctctagattgaaccacattgaatgtttatgcccaatagagcattacggctacagagggtggtgttcccatcgtatcacaagctggaaaatataccaaagtggtttcacacagagaacattccagaaatagtttctggtgaagaggcttaacatattactgtttgtgttctctgaaaattttgaaatgggcattgaccaacagcacttcaggccaatggaagaatttcagaaaaatagaaggctgaaagaattctaaaaggccatcccttccagctctcttcagacctagtgtgacctcatctggaattaataaggcaaaagagaaactgaagtgctgaaaatgagtgttagcctacaatttccaccccaaaacactaacagataaagtgaataatctaggaattagcatcgtaattttttaaatagacttttcgctgaattaagtcaagagcacggtgaattatttggataataattttgccagcagagtcctggccaagaagaagatgaagccctagaatatcatctctcataagaattccttgaaatatgtatctgaacaaagaaaacattttcaaatacattataagtgtattccatcatttaattcaattgtgaaaagtatcaatgctatttgatattgataaaaataattaaaccttatgaaatgagaggtttggcttacaatagtaaggtaatgccttccgaaactactgcagccacaccatgtgagctaatgagcattttatagctgaagctctctttcaggcagtgacattcataaatatgtcctgtgtgaataagcaacattatgtagctttgagctctcctatttatctataatgttaatagagttggtatcatgacaacaaagtagtataatgctcctgtggctatcccctcctactccaataacagctagaaacaaatgagcaataaaccaggaaagtatagaactattacagaaaagaaacaaagtggtcttactatgtgtttttttgtttgtttgtttgtttgtttgttttaaggctgttggagtgagacattagcagatgggccaggttgattctagcaaggagtaatcatgcagtatttattcaaccaaagtaaaaccagatacagattatgaaaaagatggagggagaagagctataagtaaaaataagcaagacttccgcttttaagaggcaagatccacaggtcctgaaaatacacgaggtctttccagtcacaaatatgaagctgaattgtcacaaacatccacaatcatcttcacatataaagacttagaaaggcctggcacggtggcttatgcctgcaatcctaccactttgggaggcccaggggggtggatcacctgaagtcaagagttcgagaccagcctggtcaacatggtgaaaccccatctctactaaaaatacaaaaattagctgggtgtggtggcaggagcctataatcccagctactagggaggctggggcaggagaaccgctggaacccagcaggccgaggttgcagtgagctgagatggcaccactgcactccagcctgggtgaaagagcaaaattctgtctcaaaaaaaaaaagatttagacttaggagcacactgccaaatacaattatgcatacactgatgaatcaaaaaagttgtgaaccacaggcatctctgataccacaaacatccagtgtctcaaaccagcctgccaactataccctgttgccttggtgacagaaggcaagcagacgtggagaaatctggttgccggagcaacaggatcctttaaaaaaaaaaaaatgtgccttaagctgtggctatggcaaaggctgtcagtaggcaagatttcagtccttggtaatgagataaagaatttacactgagataacagtcacagtcattcatctattaattaacaagtatctgtaggttggtacctatgtgcaatacactgtgccctggagaatgcaaagatgaattaggcatagtttggcgcaggcctggcacacagtaataaatatccatcaattaaacaaatgaatgaaggttcttaagatggtcgtaaaacaatgactaaattttactaggacctgagaatatgtgacaaagaggctgaagccccagtgagcattatcaagttccactatacagagtattttatttataagttgaaataacatgctatgacttgctggattagaatcctcaatgtgtatatactaggtcagcctatgaaactcgcataaaaactggtaaaagtcaagcccattcttaatgccttcctagcaaatagtaatagatataaaagatttcatatcaagtttgaaaatgattaaagttggaaatttcaaagaaattggggcttattcctctcttgatcttgccattaactatattccttaaaaaaagttttatcaactgatgatggcttggattccgaggtgccttccagttctaatattattctccagccttgagacttcaaaacttttctgagcaggcaggggctatccctcctagttccatttgctcatgttgtatccatttgtctggctcatttgcccaaaagcatatcctaagttattagggagttacgttagtttttccgcaagcaattggtttaaatctggctcctgatatctgatatctgaccaaagttatgagtttatgcttaagctttctcttggtactattaatatttagccagggccacgtctgacttctatattttggaggctgtggtcagaacaggtatgtacttccctgtgacttctctcattgggcctttttaaagagtcagtaagggtccccaagtgggagagctgcctagggtctccttgaaattgttataccattttatacatggcacagaataggaaaaaaaaaaaagaaaaagaaaaccctctacaggcttgattttcaatttatttttattctattatgtagctttgctatcttcttttatattcaaacttcttatttagcttctaaatattttgcaggatgggttcacatttcacattaataaacaaagaaacccaggaaaatcctaaacaaattagactgcaaataactttagctctatttaacgttctttaaagaattataaatacattttgggattgtctccttttaattcagagaagccccagggattacctgggagggagtcaaaagttattaattttctctcctcttatttggcataaatcaaaggctgtcttttatcatttattttcttctgaagtcggcccttgtcttcccattttgctgtgagctccctgaaggaagacagcttgtcttaaacaaacctgtgttccctggtggcatgtcacgctgtattaccacatttcatggcacaattttacaaatgttgctttaggtcaggtcctgttcaccttggaacatactttccaaaacatcaacttcaatgtatgggccactttccatatccatctgttgacttggtcataaccccaagttaaagcttgttctatacccctgtttcaatgatcttcagattaaaccttgcctttctgctgattctagcttatccaatttgttataaagtatttagttaatgactagctttttaaaagccatctcaagctctaaaagatatagaccatatggggtttttgtttggttttgaaggggtggacatcaaccggatttgtgcaaataagacaattttccatggatcctttaaaaaaatagtagaattatttttgacagggccaagatacctacattcatctgattggaaattgtcattttaacataaaactcacttaattgggagtacatcatatatcataatttacttttgaactaaaatacttgctttgttagcaatagaaagtcagtaagtgaggaatgaggaatgttgggtactagcaagccctaaagatcctttggaatatcttctaactcagatctccagtccccacaaacacccactgtggttctctttggcattttggagtacttttctttcccctgccctccccattacttctgaccatgactcctctgcactttggcccactaaagaacgtcatgaggtcttacagggttttatcgaatatctttctgatagatcatacaccctgttgataagttttccttgggtttttattcccagaaacactggaaaaaaagttaggaaattaaaaggctccaccctaactcctcctgatcttcatttgaagataaatgtatcagtgatgcatctttgactaaacaagaaaaggatttgtctatagaaaccttcgtttgtcacctaactgaatcccccaggaatttgctgagcaggttcttctgaacttcatttatgttatgtgattcccagcaccctcaaacccagaggtagatccaggtggttccattgaggctgcccagcactaacacctgctcccttcagcaagcacccctgatggactagtcaaggatctcagctctcctcaaggcagtaaacaggaacctgatcccagccaggccaatctggctctctctctctcaggattttgaatcctaagaaaggtgacatgagaatggaataaacaagctgggagttcatttatcccagagttcctgtgcccttataagcctcccaaaaatgtctcctttatagacttcagggactgaactggctcctatgccttcccaagcttgatcctccagagtctaaattacacaagccccacaatgacgtctaaagaaccccctgtcacataagttagctaaagtcaggctcctttgcttgtatccaaaaagccctgcctgctatagcacatcgcagccttagccttttgttacacagatgctgccacctcctgagtgggggtcatcccacagctctgaagagccctgcctggcatcaccacttatatgtggcccaacctcaacaggtgccccagcctcagagcagtctggcagtccttccaccattctctgcccagttctcatctcaacattggctgctcctagctgaatatactccacaaatctagacagtcctctcagctgtctagaatattggcctagaatatcaactaatacatagaaactggctgggcacagtggcgaatgcctgtaatcccagcactttgggaggctaaggtgggtggatctccagaggtcaggagttcgataccagcctggccaacatggtgaaacccaacctctcctaaaaatacaaaaattagccaggtatggtggcaggtgcctgtaatctcagctactcgggaggcggaggcaggagaatcacttgaacctggaaggcagaggttgcagtgatcacgccactgcactccagcctgggtgacagagcaagattctatctcaacaataataataataatatacagaaaccataaagtatatttcttccttaatctgcctttccctatttcactagcttaattttatcttcacctccctttctccagacacaaagaaggcgttgccactcatcttttccaggcccactcctctggctctggtctatgatgcaactgtatactgtcagttatctcttttcctctctcatttctcctctccattggtctcttctccttcctctgtcccaaatgccctgagttcatcctgattctaggaggtccttttccatcaaacattccccaccagctcattctcccagctcatttctcaacttcttaaatgcctcctatctctgcctctggaacattgtaatcaaggttctgctccctctaatctcacccagtgccagtgaaggtcaggagaacttgcagaaggctcaatctaatagttttgtttcagtccctactctaagaaacaactgtcactgacacagctagctgtcccaaaataacaattttgctttgcctttaaaagacagtctctcaaacatatttcaccatcccttgcaactagctgtggtcatatgaggaagttctggccaatggtatgtgaacagaagtgatgagcataacatctcggtcatatccttaaaaggaagaggggtgtctctacttcccctttcttcttcttgctggcttggaggtaggatgcggtctcataagtcatattggtcaaaaagatgaaacctataccctggggatatggaagaacaagatataagaccagggctccagatgacctcatggagcacagctgccctaccccgccggcccacccttgagctcagagaggctaactgatttgctcaaggtcacaaagctagaaaaaggcagagctagactaagacccaggtccaagatcagtacctgtttcagtatgctacttggtgaactataaacagttctgggcaagtaagctctaactcctatttccgcaggcacatggaaacttctggctatcaggtttcaattcagctgagttattactcagctctgcaaaatcaaaaaatatttctaggagttcaatttgcacctaccttgtttgggattgtctttctcctcctgaagcactaaaacttctctttaaaatgtctgagacgagaaaatagaaataactttacattatttcctctgcaaatcttttattttttatgttttaataaaacaatactgaacaacaaatactggtgaagatgcagagaaaagggaactcatacactgttggtgggactgtaaattagtgtagccattatggaaaacagtataaaggttctcggccgggtgtggtggctcacacctgtaatcccagcactttgtgaggccgaggtagatgaatcatgaggtcaagagagcgagaccttcctggccaacatgaaaccccgtccctactaaaaagtacaaaaattagctgggtgtggtggagcatgcctgtagtcccagctactcgggaggctaaggcaggagaatcgcttgaacccaggaggcggaggttgcagtgagctaagatcgtgccactgcactccagcctggtgacagagcgagaccccgtctcaaaaaaaaaaaaaaaaaaaaaaaaaacttaaaatacataaataaataaagtttctcttcaaaaaactaaaaatagaacttctatatgatccagcaatcccactactggtatatatccaaaagaagggaagttagtatatcaaaaagatatctctactctcgtgtttattgcagcactactcacaaccaccaggatatgaaatcagactaagtatccctcagcagatgaatggataaagaaaatgtttaaatatttaaaaatagctagaaggggagatttgaaatgtttccaacacaaataaatgataaatgtttgaggtgatcaatatctgaattacccatacaatgtataatttaatgactacacattctatgcatatatcaaaatatcacaagtatccataaataggtacaaatatattatatatcagaaaaaattttaaataagttttttataaaattcaaaataataaagaatatatatattccatgaatggctttgtctataaacactctcatattgttctaaagtcaaacttatctctgtaaatggtaggtaggaaatattctaggctttgcaagccatactatgtctgtcacagctgaattctgctgccattgtagcatgaaagcagtcaaacaacattcaagaaacaaacatggctttattcatggtaaaccacaataacaacaacaaaaaacaatactgaatttcggttacctgagcaattgtacatactgtaaaaattgtctttgattatgaaagcatgaactaaaatatgttacaaattgttatttatttgtcaggtttgtttaagggctttttctctaaagcaaatgtgctaaacaaacaaaaacaaccctgttattaatatctaacaaaacacaataaaatgtcatgcaataaaatgtcataaccatccttgccaagttaccatatgcaaatttaagggtcaagcatctctttcctacctccccactaaccctcccaccattgctgccaggtatatagaacactgaacttatctcaaaacagtcagtaataaacttcttctggaatttgttatacatgtttatatgcataaatattttttcccatatgagcttcatgttttcccaatcacaaattaatacacctagaaggcagggatctacggagaaaataggacagaatattgaaaactggggttgtcccagaaaatatggaacatctaatcatcatttcgatggaccaattaagtttggaaaggacaaagaatgtagctaaatccttagggttctactttgatccttagagaagctattttaaatgttcttttatgagattttcatagtatagtcactgaggagagagaattattttcacttaatttatttcagaatatttctatctatggtttttaatattttatcaacttactcttttttaaaaaaattgtttcccttcattttctattttaacttctctttaagtttcaggtttgttccatgtattttattctatctctctttataatctttaaactttatctaaatataccttttccttttctttcccatatcccagtatgactattttctttactgttttaaattaagagtcaagattaacattatggacggaatttatatgtcatatttttaataactctaaaaaaatttcttttattttattgttttaaatgtaacacatccctttagatttatataaataaaattgcacaaaaattagtctataccaggaccaatttcttctacaggctttgaattcatctaaccaacaggctcataaaaggtcatgtccattactcctgtggttatttggctgtctccaagttagatatcttgactctctagttagaacctgcaattgctggtagaaatagtaaaactattcatttgacagctgagaaaatataaaaccactgtgctggctaacctttgggctctgtcagagagacagacacatctgtcctaattagcactgcacctgaaaaacaaaccactgggttatgtatatggtgatatttgcttgactcaagtatgatttccaaaccactgtcttccggaatcccacaaacagcaaattgataacagaaagcttactgaatgtagattctttcagagggcttgaactggagctgctggagttatccgaaatgtccaattcatcatctacctctgaatatgtatctgcacattaataaaaacaataaaaaagcaaatgagtcttgaaacaggaaggagtccagaatacattcatgttgacacactgccactagcagtacctacgttgacacactgccactagcagtacctttctcagcattttccaggttgaagttatcatctgacaggatttcgtcacaggccctgtcttcgtctttaccataggaggcctggaagccttcagggggcaggtctgcgctttctgaaagttcacttttcaggctggctgctccactgctgctgctactcaaacttgccttctcaaaggtctcctggaaagagaaattcagtttttcatagcctctttctctatccttccttctataggacctaaatcttgttagaacatatattaactgcttcaaatatcaatataaatgtttgatgcagaagacgcatcagtagttccacctatacacctgttacagaatctattcagtccataaatacaaaaagatgcaggtctataagctacattggatcaaaaaggatggaagtggcaagagtgttcagtagaaaaggcccatataacccagtagcggggggaaatatgtacttctagaaatagactatattaatttaggagaaatttctctcccttaagttttttcaaaaacatttgctatcaaatcctctcagtaccacagcaaataagtaaggcttattctcttcaaaactccaggaaaattagtagcagacaaagccaggccatggagagtgagaggcaaggttttccaaaaaaaggagctacagagaacagaacttacaaaccacttgggactctacactactgcctggcttgaacactctctgcagaactagccacagggtcctcctgaatcctccaaaacggatggatgcatttccattatgatagcactacaaagtcatcaatctggttgtgtaattccatatttccctaaataatagtattagaaactgcaaaaattatgtctcaagggtcaataaaaattaattaattaatgccactgatgctggaagttttcatttttctaagagaaagaccgtgcggaaggaatgactatgaatcagtaaaaaagtaccacttgtttctttacccaagcaactcctaagatgttcattgtatgggactattcgcagcaagcgtgaagagcctttttaggccgtggggctaaacagtgctggcaaagtaaagctacagatcaggtagacaaaaagacaaagaaaggctgtgatggaggaaaggataacaggcagagagtgtgagaagaaagaaaaaggtgcatttattgaaggggaaagaattccctctatgaattgtgtccaagatgatttagtcacaaattacctagcacttcttgactaaaaaggctccaatgatgctcatttcagagacagccttatttatttcagatttatgtgttttttatttttttcctacagtaaaatgacacagctccaaggcacaggtttctaaaaactccataataatagaatttgcagatgaagaaaacctaagatcttagggataactagaatcagaaataaacctctaaaagctttcatatatttatgttctataggtaagatgaaaagatttttaaaatacaaaaaacatttgtgcattgcaaactgtctgatcaattgctgtttatttcttttccctgagattcttttcagtgattcttcaaagtttcaccaagctccttgttttgttgaagttaatttgcaggtgaagaagtattttaactttgattttccataattagtacatccaatgttcaaaggctgttttatgactctgagttgttaatttctgcttctgaggtccaccctggttggctaacttacaacctgagacaggaaatgctttggccgctctctggcaaaagatatatgctactcagaaatttttccaatgcctaaggctagtatcgggcttctaagtccagcctcagctctgccacactcaacccctgataccaaatccaggagctctttctaaggctcaaaactttattgcaaaaccaactcaacttcttccatgcctacctcttttcttcgtcccaaaccacaaaacccttcttcctctaactatcctcaactgaagtcattagaaatttacacagaagtaaaaacccaattcaaggccttttccttcttatgaccttttttattctaagtaaatcatcttctaccctatcctgaagaccacagctggcatctgcaaccttttcaggactttacacccaagatgtgtcaacattaccaaggttgaaaaaagatgaaggagaatttttgaattgagaaaactttttattctgtcgatgcaattaagatgctggaattcaaatatccctaaaactagtaaaactttaacaaaggctttgtgtctcttaagaacaggcatggataaaacatcagaggaaaacatttttctttgaacaaatgaagagtcaggagaagctggagtccccgctgaaaaaggcaattcgagacttaaggacgctggacttgcaatcaaaacccaagaaccaattgggtcataaatcaatagtcacttgtaactgccaaaatttcatccacgggtaattgactgtttgcataaattctgataaaggggaatttacaatctgagagagatgctttttcagactctgtatgcataaaaatatgataatatagatggatagtttgggtttaaaatttgtatttctaggccaggcatggtggctcactcctgcaattccagcactttgggaggctgaggcaggtggatcacgaggtcaggagatcaagatcatcctggctaacacagtgaaaccctgtctctactaaaaaatacaaaaaaattagccgggcatggtggtgggcgcctgtagtcccagctactcgggaggctgaaggaggagaatggcatgatcccaggaggcggagcttgcagtgagccgagattgtgccactgcactccagcctgggtgacagagcaagactcttgtctcaaaaaaaaaaatatatatatatttctataacaatcccttgcagcagtttttgcttcaaaaaaaaattgatataatttttgaccttgccataaaccatatgccacacattttccctactgtgatttctggagtttttcactgtgagtatttgagtatccaactctttataaaattgttccttgaagaactgggggcactttagtccattttaaatcctttagtgctttgcacaatgccttacacatagcaaaggctcaataaatagttgagccattaagttgtcctcagaagacacatccagcaagtacattaacctattaaagggatttaggcaagaaaaaaggcaaagtttttggagacagaatttggctgctataatctttttcactttctaattactaagatttttcaaggagtaggagagggagttaactagtttttttggcatctgcatgcatctatcctaggaatggatagacacattccggatatcaatacggcggcaaggagaatacaacgcaaatcacacaataaaattatcactgatatggaaatcagcaccattatagaagatgcttcctgtcaccacgctagtattggcacaattatgtttagctcggttttgcgcattataatgtaatatttttatgtgtgcagcagatcataatacattttcagttgaatagcaattctaacagtaacagactgacattacccaaattaactgctacagtaggaaaattaagggcatctattttattaaaatcagtgcaatttttaaaattgccagaaagttttaggagagaaagaaaatcaagaaataaatataaagcataacaacagctatatcctatagatgctttactttagaactctaaaaaatgcactatttctttgtgttctgaaatattcatattctattaggtatatttttacccagtttcttccatctgttttgttaataaactgtacccttaaatatctcaatttagtgctaccaggtgctagaaattcatccagctgaggtgatcttttatcagtggcaccgcattctatgcttttcatggatgattgcacaaagaaaattcaaactaggagacaggccattgactgcatactattgtaaataaacttagtccctacattttaaggtatatttttaaaaatcagccagtgtggtcagatgattaaggaaccttgtggactagaccatagctgagtgaactgctcactgtagtggtgagataggaaccttttctccaggcctccctatggaagacttggctttgccacatcagagaggtgggctgatggaataagcctggagcctggtcccaccccctacccagtggtagatggaaatctttaatctttgatcctgaaagttagtttttgtttgttttttagaaataggttctcactatgttgcccaggctgttcttgaacctccgggtttaagggatcatcctgcctcggtcttctgagtagctggaaatacagaggcacaccactgtgtccagctttcccaaaatggtttggatggtaacatcgtctattttcatcagggaatcttgaagaatttcccttctcccattctctacatacagttaagagagcaatagttaaatctaaaccagaaaaactggtgttttggggccctaaaaataactaatttatatggattatataataaagaaaatattctctttaggttggatcttatttattttgaacttattaaatatttacacaaagctaaaaattttactgtcatgacatagttattatctcattattatactatcttaattagaacgtcttaaaagcactattacatattaatgagctgtgattaaattaaataaattagggaataaattggtcattacaattcaatctaaaactccagtatcaaatttattatggttaaaaatgtttcactgttatcccataactaacctagtactgtatcagaaatgagtggattttctatcacttttaactcaaatacaggttttctagaaggaataatactaacaaagaggagaaggaaaacaatgtcataatctgaaattatcatttgttaagaatacagaagatctggtccatcacaacaatactgaccaccatgtttttccaagacagcagactaacatgccaatagaactaaatgtatataccaatatatttaaaagcatttcaaatgaggccaggatcaggtaattctatttaacatttaaaagaaacaatgggggctgggcgtggtggttcacacctgtaatcctagcacttcaggaggctgaggcagacagatcacctgaggtcaggagtttgagaccagtctggccaacaaggtgaaacctggtctctactaaaaatacaaaaattagccagacatggtggcaggcacctgtaatcccaggtactcgcaaggctgaagcacgagaattgcttaaacctgggaggcggaggttgcagtgagctgagatcatactactgcactccagcctgggcaacagagcaagactctgtctcaagaaaaaaaagaaaaaaagaaagaaacaatgggccaggcatggtggctcatgcctttaatcccagcactttgggaggccaaaagtggaccgatcatttgaggtcaggagtttgagaccagcctggccaaatagtgaaaccccatctctactaaaaatataaaaattagacaggcatggtggtgcgtgcctataatctcagctattgaggaggcgaaggcaggagaatcacttgaacatgggaggtggaggttgcagtgagccaagatcacaccactgcactccatcctgggtgacagagtgagactgtatctcaaaaaagaaagacaagggaagggaaggggaggggaggggaggggaagggaggggaagggaagggaagggaaggaacaatgtacagagaacaatcaagtgggcaagttttaagaaattttttgtttctcaaaaaaacaatgtcattgaaatttaccaatgcttaaggaattaaagagtatggaattagaaatgagtggttatcaacaggaatgaaacaccaaattagaacctcattgactgtttcatttttaacacagagttacataaggaaaggtctagttcttgttaaactgcacattttgcacatgttgtcaaaattccaaactgattaattgccagtagagaaagaattaaaagtcaagaaaaagagtcaccattgtcttttgcttggcccactgcaatctcttcttaaccaatttccctgatttcattcttggctctcagtggtttattcctactcagcggccacctatatcattttaaagcctagtggtgccaccttggcttgctcagaactcatattactcaagtgcatgccagggactatggcacctgcatgtccaactgtctctccctgcttcaccgcacgctggacacacaggcctccttgctgttccccgagcttggcaggctcactcctacctcaggatctttggtcatgctactccttctgctaccaatgttgtgccttcagatatttgcagaggttatccctttaatgtacagttgacccttgaacaacatgggagtgaggggcaccaatactccatgcagtcaaaaatctatgtataacttttaactttctaaaaacttatctactaatagcctactgcttactagaagcttaccaataacataaacaattaatacatacttgatatgtcatatggtaaatatagtttatcttccttgtgattttcttaataacattttctttcctctagcttgttattaagaaaatcacaaagaagagaaactatatttactattcattaagtggaagtggatcatcataaaggtcttcatctttgtcatcttcacattgggtaggctgaagacgaggaagaggaagaggaggggttggttttgctgcctcaggagtggcaaaggcagaagaaaattcatgtataagtggattcatgcagttcaaacccacattgtttaaaggtcaactgtattcaggtctctgcccaaatgtcatgtaattataaagcccttcactgacatccctatttaaaatagcctgtctccctgtgtctacaatcactttctattaccttgccttcttttatttttgttcatagcacttaaatatagttttatttatctattatttgtcttctctcactatgaaggagggagtctgtggctgtttggttcactactgtatcaggagaatactagaataggtcccaggaaagaataaatgcttactaaattttgttgaataagtaaaataaaagactgattttttaaaatgttgccaagattctccatgttaaaacaaggggtaaaaataaaaattgtaggtatgattttttgaagaaattagacaaacttattctaaaattaataaggaaatacaacagacctagaacacccaaatcaaatttgacaaagaacaacaaagttggaggacttacagggcttgttttgagacttattaaaaagctacaatatcaaaagatacagagtttcggtgagatgggaggataagttcaagagatctattgcacagcatgatgattatacttaataacaatatactgtattcttgaaaaatactgagattggattttaagtgttctcaccacaaaaattatactgtgtggtaatgcatatgttatgtggtaaagcatatgtgtggtaatgcatatgttaattaactccgttaagccattccacaatgtatatatattcaaaacatcatgttgtatacaatatatataattttttgccaattaaaattaaaacattttttaaaagctacaaaaatcaaaacggtgtggtattggtctaagaagagacatataatccatggaacagaatagagttcagaaatagacctgcaagaaaggggaacccttgcagactgttggtgggaatgtaaattagtacagccactataatgaatagtatggagtttcctttaaaaactaaaaatggaaataccatatgatccagcaatcccattgctaggtatttatacacaagaaaagaaataagtatgttgaagagatatctgcatgctcatttttattatagcactattcacaatggccaagatttggaatcaacctaagtacccatcaaaagatgaattgataaagaaatgggaaaattttcagtcataaaaaagaatgaactcttgtcattttcaacaacatgggtggaactgaaagacattatgttaagtgaaataagccaggcacagaaagagaaatacaaaatgttcctacttatacgtgggagctaaaaagtatcgaattcatggagataaagagtggaataatggttaccagaggctgggaagaggagaggagaggggggataaaaaaggaacggttgggtacaaaaatacagtaagataaaaggaataagatttagtgtttggtagcaaaatagggtggctatagctaacaataatttattgtatatttaaaataactaaatgaatgcaattggaatgtttctaacacaaacaaatgataaatgttggaggtggctgataccccaattaccctgatttgatcattaaacattttattcttgtatcaaaatttcacatgtacaccataaatatgtacaattattatgtactcaaaataattaaaactttaaaatttaaaatttaaaaatatttataaacaaaaaagaaaaaagtaagtagatctacatatatattgtcaggcaattttcaataaagatgcttagcaaaatccatgggaaaagactagacatttaaagaagtgatgctggaaaaactggatacccaaatgaccaaaaaaaaaaaccaaaaagtcaatctcctcattattctatacacaaaattaaatcaaaagggatcataggtctaaaacatttacaaaaatataaagaatcttatttttgcaaccttagggtaggcaacaatttcattacaaagaggcaaaaaacactgaccaccacaaacaattacatgaataagtcttcatcaaaattaaaattttctgtttatccaaaaaatgtcattaatttaaaaaaacaggcaagccatagactatacaaaatgtttgcaatacatatgtttgacaataggctcattatctggcatatataaagaactcctacaaatcaacaaaaacagacaagtaatccaataaaatcacaggcgaaagatttgaacagatatttaacacatacacatacacaaagatatataaatagctaaaatcaaacataaatgtgctcaacctcattgatcatcaggaaaatgcaaactaaaaccagaaagaagtatcattacacctcaaaggctaaaatcggaaagactgacaataccaaatagtggcaaggatgtggaacgtctagaactctcatatactgcttctgaaagtgttaaacagtacaattttgaagaactatttggtgctttctttaacagttaaacatacaactacctataaccctgaaactctatttctaggtctttatctaagagaaaaaagttataaacatttttgtatgggtctttttgtaaataggttttcaacagtgttaagaaattccaaatctggagaaaacgtaagtgttcatcaacaggacagataaacaaattacggtgtagtcatataatttaacactgcctagcaatatgaacaaattactaatacacaccacgtgggtgaatctcatagatattttgtcatggaaaaaaagccagccactaaagagaacatgtgtttgatttaaatgaagtcaaacaacaggcaaagtaatttatagtgacagaaatcaccagtctacgtcctggggcagagaattgtatagaaagaggcttaagggaacattctgaggtgagataaatgttctaactcttgtttggggtggaggttacacatgtgccaaaagccactgaactaggcacctaaagatgtgtacattttactacatgtaaattatatgtcaataaaaaagagagaattgtagtgtggatgtgagaattgtgtctgtatttgtgaggaagcctataaggcattgctttattttcatataacataatgagcatagaacatttccaaaacaagtcatggtttttcctgatatttctcttcctacatcattacttgtagcattttcacagccttgggagaaattcagtcaacaattaaccagacaataaaagcaaagatgttcacaaaaatattgtcctttaaaaatacatcattttctacatggcttaatttaatctcctagcagaggattgcagacacatgactttagtggtgtgctcagcaattgtaaatgacatatggtataataaaaataaagcaacccagataaataaatagcacattttttaatttgcattaaaaaaatgagaatctagatgcttacatatctgttcaattcttatatgctcaactttaaagacatctgagaatttatgaaaaatatcagtatctgtcaatgtctgctaaaaatcatagattagaaaactacaataagaattttataacaaagaagtgaagttatgaacagtttgtgaatttaaaaaataatatttgctaataattgctctaccagcctgctcctccaaagtagatggaatttaagatgacacttatgtatgccatattttgactctggcaatatcaaattatcataggaatctttttttagattcaccaaaagcttagagaaaatttttaggactcactacatgagcatttacttattgtcataagcatgaaacaatttaccaagatcagatattttttttggaaaatagtttgggtaggaatgtggaagatggctaagggagggagatgatccctgataatctggatggaactgatttaatcaggtggcaggtctccaaagtggagctgaggcatctctgagatgaggaagagattcagcctgtggaaaacagcttcagcccatgaccaagatttccagcctgttcctcctgccaaccatccctatggattttgcacttgcctcgtcagtccccacaatcatgtaagccagttccttgcaataaatatctgaatatgtatctactgctcgttctgtttctcacattttgtgcaggactgtcaatgtatatgacatatcagcatccctggctgctaacagtgataaacaacaattataccaccccacccccagtacacacattccttaatggcccctagtggacagtgcagaggtgatatactgactgaatcacttggtagaagtaaggaaaaaactagagacaagaaagttggatcttgcaatgatataatgcaagatactgagaatgagaactgaaaggataagatggatttgccagacatttcaaagacagaattagtagagcttgctaacaaaatgaatacaggatttcagagagagtgaattgaagatgtcaaggttacaattaaggtgatatgaggagacagaacatggctgatcaagggaggagaatccattcactgtggacttgccgagcataagtacctgttagacatgcaggtgaatgttcggttcaaaatataggtctggcacacagagagactgagatcagacaggcagctttggtgatctccagcaaatgggtgtggaaattatgttgcgaaacacatcccaacatattttgccttcgcagaaaattttgtgcacttctccagagctcttttcttctactgttaagaccagtttatgaggctgagatttatagacccaggagaagacaggggaaaagaatacctggagaaaaagaaggatataatagatgcaagggtagcttctggcagaaaggtgcgaactggaaatttcttctggagctcaaaataagagcctgccagaaggaagagaaaatgaaagagcaagtgcaagcctccttgtttttccttctcacatccactccagcagatgcgaaccttgggattagagttgggctgttgatggagatacacggagagtttgagggggaaactggggcacagacagaaaagaccgggagctttgaagaagcttcatgatcatcataacactatatacataaggcccatgagagcagaggccttgtctattttgctaactgtggtatactttgtacacatagtgcctgacacctattaggcactcagtaaatacttgttgaatgaataattgaattgtaggcacctgggacagaagaatagaaaaggatgaagaaggcactggagctgatggggctgagatagggtcccctagtgccagtgagttccccatgggctgtgtgtggtgtggatgggaatccaaagcccccatgtgtcttgtgccaatgtagaagacagctctggggctggcaggtgagttcacttggccatcactgcactgaggaccacagagtaggctgcttaaactaagaatgccaagaaagtcacaatcaagactcagaggatcaaaaatagtaaccccaaggggagagttggggcatcatgggtaattctttgggtttaagccatgatgataaaagaggccatgagttacagatgccataaacatttaataaggacagaggtcagcatccaaaaatcacagggttcatgtcatctaagttcagcaggggccaatagaagaagtccagagcccctgcccctctctcatcgacatggggatgcttaagctttctcctgtactctgttgccatcttcggaagaggacacggagaagagaacccttgggatggcaaagaaacttttagaccaaaagagaacgacataattgatcctgactactactaccattttctgctaccagcacaaacaggggttcaaaacaaaatgatatataattatagaaaataaagtttccatcttgcacaccaatttttacccaaattcatatgaaatgaaataccatgggactagatggaaaccaagggaagcgtaagagaggcagaacctttaaagttaaaaggccagggatggaagagaaaatgaggaagagtattcaaagagagaagacagaaaccaggacagaggagtgtaatggaaaacactggggggtaaaaaacattaaaaagcgggtatgtacaataagaaataattagcccatagtgaggcagagcttgcagtgagctgagattgtgccactgcactccagcctgggcgacagagtgagactccatctcaaaaaaaaaaaaaaagaaagaattagttcatagtctgtcaatttgcttgttaggtattttggagaaattcaacgttttagtccacgttacccacaggatttaattcaaacagcttaatgaggtattcacaaacatccatcatctagctccagcctacttccccaggcttttcaaactacacatataaaaatatgcattgtcaatcagcagacccaatttttggtcctggggctgtccctaactagctggatgaacttggacaagtcttttaacttctcctgatttccctttccttgtgcaattaaaacataaaacaattccatttctaagtttgattcttagtattaagtgagctgagctggagtttctgcacttaacgttattcttttccatccaggagtgacttccttatttagttatcaagaccctatctttgtttggctctgagatcctccctaggcctcattaattcatttccctcatctcatttatttacccaaaatgttcggaatcattagaaagttcctcctgcatatgcacatctatcttgtctttccaagtagattatcagttacttcatgaatggggtcattgtttataattttttataagcttcactataccaagcataatgccttacattcagaagacatccaacaaatccctgttccttcattattaattatataccacaggcattttcaatctttctctctttctgttatagatgtgaaagcagttctccaaactgaacaaacttattaaactagtaaaaagaaatcatcattcagcctttaaataggggtggtgaagataaacttcctgtcaaatatcactggaaaagtagttgtgattcctgcaagtctcacactgacagcatgcttctctcattaattctcttcagtctccctggaacactcaattctgctccatttgtacacatagaaatatgcttttttcacccatttaaatgttagcctaaagctgtctctataaaatcccaataattctaatggaattgaagttttccattgattctccaggttttgtcaggctgaatttctttaatacacactattgtatttgttggaaaagatataagcagtagactcttcagaaatgtctttaattgatttttctgccagggatataagatcgaaagggtaatgattctctgtgttcactacactgtgaacagtgccaaaacatggataacgattttcactattatgatgccacaataccctctacatgacaatattctaattattacacatttaagttaaaattttatttccttttactctacatgattcttatcattctcaactctatactctccttatgatctcttattttaagttataagaatcagaaaacattcttcaaaaggaaaggtttggttcactttcatagtgggtaaaccacagtacatagagtgaactttttagtgaagacttctctgttcttctaaaatatatattagtacttacgtttactaggccactataaaaattgccataattaagaatagactaaaatatgaaagtaaatagaatacttccccatgaaatagaaacctttaatgtttcttatcaattgtttgcttacccactaatttgcaaaatttcagtaattcacagtggatccccttattgatattgggaattcataaagttctactgaacccactaatttctctttcccttgactataatttatcactggattgtgtaactgcattattgataataactgctctgggagaactttccagtatatctgaaatgagataatcataatactgcttaagaaaaaaagagtcataaaattttacacctataatttttcttcagcaatggtgtagatgtaagtttttaaaaataataattggtccccactgagaaaaatgccaattaactgcatactgtcttttgatgaaatgcaatcttccttcttgcttctttaataaagctgcattttttccttttagttaacatttggttaaccttgaaatgaaaatgtatcagtagacttaaaatagtgcgaaaggagaaagtactgtatgactatttaaagcaggaatataaactttgctttgaagtaaagcatttctctatggtccataaaaacctgaatgctcaatgagggcactgaggctggctagcagcaggtgctaatatatatgcattaactgtatgcctgacataaggatttaatgtagagactacttggacaagtcagcactagattaacaagttccatcaacaaactattcttctaacaaaagctatgctcatttatatgactgatgctatcttacaatttatgccacttttaaagtcatacaatatattcaaacacattaactcatttatcctagtactctctgaggtagataatatcctctaccccttaatttacggatgagtatacaacctctggaacattaaaatccctcccttggtttcagagctttccctttattttacctggcgatagcctgaaatctatatttctaaagctaaaatgactctccaaacacatatggaaatactgatagaggaaattatatggtatctgggatttacttcaaaataatctggggaaggaaggaagtaggtgggaatagagatgatacaggattagcccttaatagctaactgttgaagctgggatgggtacaggaagtaatctttgcatttataaacgtttgaagttttccataataaagaattttttaagctgagaagtgtaaataaatagataagtaatggtccttctcaaggtgttttgctaaagataacagactttctgctgttagattgtaaactaatgccactcagccccaaatcagccacatgaatctaatatgaaatgactctttcacatacaactggaaataagctaagtaactctgcagtgcagaacttaataatagaaggccccaaatacctaagatatatagaaatagctaaatctcttgcattttagtctactaggaatactctatttagaatgcaacatgacatacatagaatgatgcattgttgcctagttattatgaagtcaggtagtaaaataaaaagcaaagtgagctctaactccccttctgagatttaactgtgttcagtaagggctataactccaagttatatgctcctttacataaacatataacttaaataatcatcatggaatgttctgcaaaattacatctaggctcagcatttaaggcaatgaagatgaaagagtttccttcccaaatgaaaactagattcagtcttcaacttctggattccaaataccttaagacaaacccactaaacagtagtactttccttcttttcagaaagcagttcactggaaacactgttattcaagaaatcagaactgcctctttgagaccaacttcatacataattttaccagctgagatggagcaggtccttaggatcctgggaaggaatttaatgaccaggtaccctaagaaagagttttatgatccaattgccttgggcccacccccagaacaggaaaaaaaaaaaaaggatgaaagtccccttaccaggtcgccactgggtggaggcccaaagcatgagcaaacaacagaacactgattgtgattgcaacaaagacacagaagaaagaaaataagagacagcaacaagagcatcactggcaccattgcttgcacatgtggatatttgtagctttggcatctcttttccaagcaatgttcagaaatatacttaaatatcaaaacaatctaaaggttcttggcaagaaaaataagacatattctgatttgaagcatggcaacattattaataccacaaatggcaatgaaagagattgcaaagtacaatacgaaaaattttaaaggcaaatgttatttccttctctgaattaactcacatattcatacatattcccaaaagttgcagtcagattgctgaagaaattaaatataagcattcactgctaattttacagtctgtaacttaaacttcgctaagagaactttgtgatacctcgatttttgcaaaaataaaataaattatggattcattcttaggaaggtcagttatatttattttaatttgtatataagatacagaaatggatataaatatgtaactatactactgcaatattgcatgtaactatttttctaacttttgatgaatgttccttaaaacaagcatgaacaacttcagacagcccattagagtgcatcatgaaccgattgaaatatttgcacttacgtgagatagaacagccagctcatggtgacatgtgacggtgttccggttggcttccataaaatacctttgtgtgcgtcttcgttcccgttctagcttcttttccaaggacaactgggatgtagataagttgtctaaatatttcatcatgacatctgatatcatcgaactgacttctacaatatctggacgagcttccgcatcaggagtgaggcacctaagataacatgagataattataacactctggtcaatgttgggagcaggccacagagtgtaaagggtcaaggttaaactccactgtgtgtccactatggtattttcacctaagataacctgggataagatggatatcaagcacagctttgagtccaagacttctcaaaaggcatttggaaagctaaggaaggaaaaggagtcagcgttattctctttgcacttgggctggaaggtaagggttccaggctgagcatgaagatgctcttcgggtctcaggatgggcagatgggaccatcttctcctgcatgggttggctgctttctgaaatcactgccaactcactggcaggtggaaaaaaaaaaaaaaaaagcccagtgtctaaacctttcattagtgtggatattctaaattcttagactgcagatgtttaagctgcttcaaggtaatattagcagctgaactatcagctgaacttttttaaaaataaaaaaaaagcaacgtaaactagttttataaattatatagctacatattatggtacatgggaatggaaatgaccttcgttctcctagcatatagtcatctccttgcccaaggttactctcctggtcctgtatttgccatcactggaaaaggcaccacaaagaagatgcagtttagcatcataactcagcatgcaggctctggatcattttgctggggtttaaaacctcatttaccatttattagtcagatcctgggcaagttacatagcttctaagactcagatagcccacctgtaaaatgggataattatagtacctacctcattaaactggtatggtgtttgaacgaggtaatctctgtgaagtgcacatgcattgtaaaatttcaataaattgaaaagaaaatccacacttttatgtatcctccatcccttcctacatttaacaaacaccaagtcctgtgacttctactttctaaatatttcttgaatccacatccttcccctgtaatcccacagctatttggctattacaacgtcacttacttggactactgaaagagtctcctaaataacacactcatttcttgcctacctctggtctgtactgtaaactgctaaccagaatactattcctaaatctgactatattatttctctactcaaaattcttcaatagttctcatggtccaataggataaaattaaaattcccagaatgctatacaaggtctctcttgaactggcccttaacttcctccactctttcccctcctccagcaacacatccaatgcggctacctgcacttccccaaatagcacctgtctctcctatacccccatttctttgcttattttattccatatgcttgattttttttttttttttttttttttttgcccatggtatcttatctttcccagccatcatctcagccatcatctcttatatacttgccaaaatcccactatttttccaggctccattaggaatacttttggactgccttcagacagatatcctgagccccttttgtacattctttttgcaccatttgcacttaagtacttaaaactattgtaattattttactataatggtctgtttcaccactagactggaaacttctagagaagagggacatgtgtcctcttcactatgatctcccagcatatacaatggaatctgagtcctgataggtattcagcaaatgaacgaatgaatcaatgaataaatccacaaacaaactcagcgtaacatctaaaaagtttacctacccataacccaaaatatttggccatagacttttggattcccaggaacatttcctaccagaagttccaggatagtctcgttgctctgaaatgactccctgcttaggcatttcagagaaattcttttttttttttttttttgagacggagtctcgctctgtcgcccagtctggagtgcagtggcgcagtctcggctaactgcaagctccgcctcccgggttcaggccattctcctgcctcagcctctcctagcagctgggactacaggcgcccgccaccacgcccggctaatttttttgtatttttagtagagacggggtttcatcgtggtctcaatctcctgaccttgtgatccacccacctcggcctcccaaagtgctgggattacaagggtgagtcaccgcgcccggcctcagagaaattcttaacagcaactgaatcagagtcataatacatgctaaagattgtctaccaatgattctgtaaacaaataagcataaaatctggtcctaaaaaaattgaggatattctcacctcatccactttgtccccactccactctgaaaggccagatggaaagaattagaaggataccttattcaattacattcatgtcatgttttaagatacaaagaattgaaaggggtgaaaaatataaagatccatttgtccttggagctagctgaaagtattaactttgttagtcctcatgactgcttctgaagcaaagcaccaggcagcttatgcaaccaggcacagagaaagaaaaataaggcaatgattttaatagaatattttatgcataaaaggaaatgttcttcctttttaaaaagtaaacagacaatattctcttaatagtacactagtaggtaaaaatagtaatcctagtaccgagcagaacaaaaaaatatatttattttcttccccaaactcctcagggttgctaagttattctcccaatttgaaggcctgctaggaaagacaagtttcaataacaaatgtgcttgtataccacatgagcaaacaggaaaaaggaaagatgctgcacattagaaatgcaaactgtgtgagctctacttgacaaggatgtgaaaaataatgagaagatagtaaaatagaggaaagaagatatatatgattagaaacaatataatttttaggaatgattataataaacatttctgtcaagagctgtcttctatttcaaaggctctatcaaattactaaagattggctgtgagcctgatcttttgctgagtcataaatgatcattaagaatacttgcctttatgtgtcccttgcattgttgctttaagaaaatacaaaatttgagtttgttccctaattctttcagaactcaattttttaatactgaaaatccaaagcaaattaaatatgcaattgcatataattcatgattgatttcagttttaagtcaaattttctaaagataaaactttatttggaatgtaaacccagacaatgaggagtcttaactttaaatgaaaataaatttattacagaatgcaccctgcaatcttaatttattatcagatataaagttgaattgtcagttctaacttattgtggcatcttagtattttgaaccaaaagcaacctcaaattgagaagctctttccctcagcaaagccttcacagatactggtctgcgaaatgctgcttactatttgagagttaatgaatgttccaggtctcagattacacgtccttttttcagagaaacttttcgccaattcccagagtaagacaggtccttctgtaatctctcattgccccctttaccatttttcatcacatttatcacaatttgctttataaacttcattctgtacataatacaatatcattattaatactaataatacctaattttatagagtgcctaccacttgctgggtactgcgttaagtgggtcagaagcactatcttatttaagctttaaaacaagcccatgaagttaagggaggagaccaccctcatattgtcttatgcccgatttctgcctccaaagaaagaagtaaaaactaaaaggtagaaatggaatccacaggcaaatagcccagcactgtgccctggacctgttagttaaaaatcaacccctgacctaactgcttgtgttatctataaatttcagacattgcatggaaaagcatcatgaaaatccctgtcctgttctgctctgttctgattaccagtggatgcagcccccagtcaagtaccccctgcctgctcaattgatcacgatcctttcacacagacccccttagagttgtaagcccttaaaagggacaggaactgctcactcagggagctcagtttttggagacgtgagtctgccggtgctcccagctgaataaagccctttccttctacaactcagcatctgaggggttcttgcctgtggctcgtcctgctacaaagtaattactactgctacccacacatcatagatgagaaaattgggcctcagggaaattaaattgagtggaagagggggcattagaatctagttgactccagaacttggtgacgctctaaacctttacactccaatgttgctatctgactcccctactagtatgttaaccccaagagtcctgggtagccatagccagggtctattagtttcagaagagatttacagtctatttgcccagattcacaaaatcaaagcaacgtctctgaaccttgttatttgcgctacctttccctcgccctttgtggcactcaaatacctattaaaaggagaaattaaatgagcaaatatggtacttttgtcttgacacctctgacgactctgtcaatttttaatgtactttccaaaaaacaacagacaacaggaacaaatcacagagatgagcagtttaaatatatttggattcattagcaacaaggcatgatccagtgtttgtggaatcaaatgatttaaagacaggttcgtctcatttcccataatactaaccatgatgattgccaaaattgctcaagtatttaccattctgcaagccctatcctaagtgatttgcatatgttactttgtgtaatcatcacatcagcctaatgagactggtactattatgattctcattctactagatcagaaaacagggacgcagaaataatggtcaaatcactctttttttttatttttatttaaaaaaatttttttgagatggagttttgctcttttcacccaggctagagtgcaacggctcaatctcagctcattgcaacctccacttcccagattcaggtgattctcctgcctcagcctcccgagtagctggaattacaggcgcacaccaccaggcctggctaatttttgtatttttaatagagatggggtttcaccatgttggccaggctggtctcaaacacctgacctcaggtgatctgcctgcctcagcctcccaaagtgctggtatcacaggtgtgagccaccgcacctggcctcaaatcacttcttagagtttgcaactgtttacatgacttagccccaggtaggcctgtcttcagagcctgaggccttaagactgtagatttcggcttcactgttgttatatagaaatgctagtgatttttgcacattggttttgtatcctgcaacttcgctgaagttgtttataagcttaaggagtttttgagccaatactattgggttttctagatacaggataatgtcatctgcaaacagggatagtttgacttcttctcttcctatatggatgccctttctttcccttgcctgactgctctgaccagtactttctttctttttttttttttattatacttcaagttttagggtacatgtgcacaacgtgcaggttagttacatacgtatacatgtgccatattggtgtgctgcacccattaactcgtcaatactatgttgaagtattgtcttgtgctgattttcaagagaaatgcttccagctcttgcccattcagtataacatcggctgtgggtcaagccaagagccagatcaggcatgcaatcccatttacaattgccaaaaaaagaataaaatacctaggaatacagctaaccagtaaaagagctttacagagagaactagaaaacactgctcaaagaaatcagagatgacacaaacaaatggaaaaataccccatgctcacagatagaaagaatcaataccattaaaatgacaatactgcccaaagcaacttgtagattcaatgctattcttatcaaactaccagtgacattcttcacaccactaaaaaaaggattttaaatttacatggaaccaaaagagcaactgaatagccaagacaatcctaagcaaaaaaaaaaaaaaacaaagcttgagtcatcatgctacctgacttcaaactatactacagggctacagtaaccaaaacagcatggtattgatacaaaaacagacacatagaccaatggaacagaaaagagaacccagaaataaggctgcacacgtacaaccaccatctgatcttcaacaaacctgacaaaaacaagcaatgggggaaagattccctatgtaacaaatggtgctgggataactggctagccagttgcagaaaactgaaaatgaactcctttacaaaaatctgaactgaaccccatatacaaaaatcaactcaagacagattaaagacttaaatgtgaaacccaaaactataaaaaccctggaagacaacctaggcaataccattcagaacataggcacaggcaaagatttcatgacaaagataccaaaagcaaaaattgacaagttgggggccaggtgcggtgactcacgactgtaatcccagcactttgggaggccgaggcgtgtagatcatgaggtcaggagatagagaccatcctggctaacaccgtgaaacccgtctctactaaaaatacaaaaagaaattagccaggtgtggtggcacaggcctacagtcccagctactcaggaggctgaggcaggagaatcgcttgaacctgggaggtggaggttgcagtgagccgagatcacaccactgcactccagcctgggcgacagagcaagactccatctcaaaaaaaaaaaaaaacaaaaaaagacaaaattgacaagtgggatttaattaaactaaagagcttctgcacagcaaaggatactatcaacagagtaaacagacaatctacagaacagaagaaaatttttgcaaactatgcacctgacaaaggtctaatatgcagtttctataaggaacttaagcaaatttacaagagaaaaacaaccccattaaaaagtgggcaaagaacatgaacagacacttcacaaaagaaggcatacatgtagccaacaagcatgaaataaagctcaacattactgatcattacataaatgcaaatcaaaatcacaatgagataccatcttataccagtcagaatggctattattaaaaagtcaaaaaataacagatgctggaaaggttcagcgaaaaaggaacacttatgcactgttggtgggagtgtaaattagttctaccattgtggaaaacaatgtgtagtgattccccaaagacataaaaacagaactaccattcaacccagcaatcccattactggctctatacctaaaggaatacgaatcattctatcataaaaacacatgcacacatatgttcattgcagcactattcacaatagcaaagacatggaatcaacataaatgcccataaattctaggctggataaagaaaatatggtatatacacaccatggaatactatgtagccataaaaagcaacaacatcatgtcttttgtaggaacatggctggagctggaggccattatccttagcaaactaatgcaggaacagaaaaccaaatactacatgttttcacttgtaagtgggagctaaatgatgagaacacctggatccataaaggggaacagcagacactgggagttattggatggtggagggcaggaggaaggagagcatcaggaaaaatagctattgggcactaggcttaatagctgggtgatgaaacaatctatacaacaaacccccatgacacaagtttaccttgtataacaaacctgcacatgtacctctgaacttaaaaattttaaaaaaatcaattaaaaaaataagactgtagattagtattgtgccaaagaaagaaaggtttagatatcatcctacaaaaacaggtgaggagtaatattagcacaaacaatgggctagaaggataaatcaaagggaaaggggtacagccacaataatacatctattatagttcatcagagatggggctaagtgctagtatagataccaacccaagttttaaaagactcagaaggcagatgaaaaaagattctatctggggtgactctagaatttctacaatccaaaatactcagtttgatgggatggagaaatcccatcaacttaagtacccaacttaagtactcaagatgcaacttaagtacccaagatggtacagaaatagcaatcagccagatacacgagtcatttattcatacaagcaatatttattaagggtctactctgtgccagccactgctttgggcaataaaagctacaaattaactgactaagtccctgctcttgagtttccattttggtggggaagagacagacgataaacaaaactcatgtatgcacatgtataatatgtcagggatgatgagtgctgtgagctttttaaagcaggcaaggaggttagagagtactgtgaggtagtggggccatcagggtggggaacattttagcagagacccagaggaagtgagggcctgtgtcacacatatatctgaggaaagagagttctaggaaaccatgaaagcaagggcaaaagtctagaaggagggtgcatgccaggactagtgggaagcaccatgtggctggagcagagaaaacagaaggggaagtgggagggagcatgggtgacaggccagcagggattggccaaaactttggaagtacaactaaataatgactttcattaaactcctgctatagtgatagctggagctcctgattctctatgaaaaattatgataaatcacattatcagtttaaaaatggaaattaaaaagtacctgcaactttatcatctaacatggctttttgtttcatgtgttcttgtctggcctttttccaattttttgcatatttttatgaggtttgtcatggttacaaacagctttacatcatatttgtcttacccacatatcataatgtgttttacaggttgttacaaacccttccaaataatcgttctagtggttgcataataagtgaacgctctacttcctcttggacacttaagtagcatccaaatagtcactgttactgatgatgcacaaacatctttctagatttggattatgtagggactctttctcttcatgaccttttatccataaatagtgatttattatagaaatgaggtatttcttgattgtccctacatgtctgaagccgcaagactaattacctgctgatggtgtctgttactttttcagagtagataccttctgggactggttcatataccgcctccactatctgcaaaacaaacagactagagtgatggaagtaaaggggccacggatgtctttgaatagttaatacttgaccataacctgagagttactaattaagcaggataacttcacacataaattttagtcagaaatcccgaccaaataaaacatttgcatcaattaaacagctcttgaactggaattatattatccaagctgagttaaaaattaaccttagattcataataaaatggtgtatgggataatataaggtgctggattgtgagtagtccagactgcaattaaaaataaaagaccagctgggcgcagtggctcacgtctataatcccagcagtttgggaggccaaggtgggtggattacctgaggtcaggagttcaagaccagcctggccaacatggtgaaacctaaaaaaaaaaataaaaaattcgggcatggtggcacatacctgtaatcccagctactcaggaggctgaggcaggagaattgcttgagcccaggaggcggaggttgcagtgagccaagatcatgtcactgcacgccagcctggctgacagagtgagactctgtctcaaaaataaataaattaaataaataaataatagaagaccaaacgtctttttaaaaataattttgtattataaataaagacaattatagagggaaataagccattacatgagatatatatttagaagaaagcggaaaaaataaactggatcatgcagttaataaaaacaattcttgcttttaatgggcagttatatacaaatcacaaagatctgtttaataagaaaaagaattgcatttttagctacacgagacccttctgtctcccagcgttgcttacttttgtagccaaggacagcatgttagtgctgtagaaggggggactcaaagtcgccatctgataaaggatgcagcctactgcccagacatcagccttctccccatacggctcactcttcagtacctcggggctgaagtaaaataaggacattaatacatgctaaggaagggagaatccgctcagaaagatccaattttcaagctttattggagttattttttaagtatctgaaatgtttaacttaatcactatttcaggaaaggatatcaaaaagtctgtttgaaatttcccagccttagatgaaccaggaagcatatcaattccagcttaagcactaaataccagtaactcatataagtatcacctagtatgcatccaagggtgtttatttccagaaagagcaagcccactgtggtagatggagttgctggccccagttctttgctgctctgggagcttctgtacatcccatccttgtggtagcctcttctgggcagtgctcatcatccattcctgcttttggctttgactgtgttttcttcctttgaccaccaatggaatgtggaagtgacaataacctgattagagcctcagtctgaacaggtactgagggcttccatttatccttctaggagcttcggtccactaccagaggaagaatgtgtaacaggtagcttccacccttgcagcctgggcccagcataagacacacagaaccagtctgcccccagacaacccatataccaacagggtgcaggagaactagcctagcaggctcacatacctgtgactctgaagttgaatgccactgagactttgtggtgactaatgataaggtgttaatttggaaaaaaactgactgatagagcctttccctttgctattcagctctagcatataaagtagggggaagaccatatttaaatatgttgcgggaaatgacaatatctaccatgttcactgcttctgaaattgccacacaatttaaacaacatttaaataatttgcaacggttcatgaatctattttttaatttaattagatttaatttttgtgaaggcgagtgtagttcccttgaacattttgtactaatagaagcttcctctaacatatatgtacactaaaaaacagagtactaaaagtactcaacacacacacaccctaaattaagtagcttgctaattcagttccataataagtacttgggtctggcctcagtactctaatggagtaaagattaatatagttagctttgacaatggctaaggtataaagaaatttataaattggcatcaaaacaatcaagacaggtatacatcagtattgacttaaaaataatcaacaaattactgttcttgagaggaagaagaattcctagtttaagatttatagtatgtatttgcaaagaaaagtatgatttctaggtctatcagttaagcattttcatatttagtgtttttcagttcaataatacggaaatgggggaattggggctgagacttccgcagggctctgcggttctaaatgtacaaaaagtattccctgccatccctttatcaactgctcatgttaaaaaaaaaatgctttaacaagaagaaaacatgctcaacacagaaaatgtctttggctccccacagacaaatttctcatattctcatctactgagatctcagaagatttgcttcatatttccaaaagatcacaaagcacaagctgtgagtgttccacccatatcccctcaaatcccttttgcatttcctatctttggtgtgctttcactccccacagccagcacctgcacttgtttggaggacagctttccattttctcctcaaaagataaattttctttttttttttttttttttgttgttgttttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccctgtgatctcattgttcagttcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatgatgccgcaataaacacacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggctagtgatgatgagcattttttcatgtgtttttaggctgcataaatgtcttcttttgagaagtgtctgttcatgtccttcgcccactttttgatggggttgaaggacctcttcaaggagaactacaaaccactgctcaaggaaataaaagaggatacaaacaaatggataaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatgtggaaaggattccctatttaataaatggtgctgggaaaactggatagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaagataaattttcaatgtctcttttataagggcactaatcccattggtgagggcagagccctcatgacctaatcacctaccacaggccacattttctaataccatcacgttgcagattaggatttcagtataagaattttagagagacacaagcattcagtttgtagcagactttcctcttgaaacactgctatgtttttcactcagccagtaaacatgactaagcactagtgactagtagaagtactagtcactcttctacctgcttggaatctgttctcatggggctcactttctagtaagggacaggaggcagagaagatataaaataaaacacaagaaaataacttaaaagtaaatgatgttgtattttaataagtgaaaaatgctataggaaaataaactcgactagaataaaggaggtctggagaggaggtaaggtggcaagttgcaatattagaaaaaatggttccttcctccctctcagataccatataatgacccttcagtggcttcctccttcattcactcattcatcttctcttcatactttactctctccttggataatttcattcacatccaagtcttccattgaaaccatatgctggtaactcgcagacctaatttccattcttcaagcccctcaagtgcgcacagagatgaaggctctgttacaaaccactgacgaaaatagggttaaagcagtggactctaaacaatttgcctattttataaattagagtggagaactcatcccaagtcaacaatgtttattttcttgaatttcaagcactgtttctgaggtgtacaaaacaaccctgcaggacaaaggcctgagcatctgcaacaggaagatagctccctgggagatatcttaaagccctgggcctgtgactgtctttgcccccacatgacttcctgggaaacatttctatttatttttctacttccacttctgctgccatttgcacttcaaacctagtcacttcaagcaatccttttaaatatgtgtgtgtgctatgggagctttttcttaatctgcaagactccagggtgactactctgcatcccagggaacctttctgatgtcaagagctaatgtttccaggacatctgctggcttcagatttgcccctaattcctggtgtgtccagcattaccacattagcagttaaatttatcctctaaatgctagttctttcctcaaaagataagatgataatatttgacaactaagggtttataagaactagcttattttcaccactaatgagctgaaagaaatactagggcacaggtatgagaaattgaagaagaaattaaaaccttaagagaaattgaaaaactatcattgaagaagtaactcattgacaatataatgatatagcatcttggaaacaatgacatttagagatgtcataaaagaaaatgttcccttaataagtgttagaaaatattaataaaagaatctcaaggagtttgggacacagtgagggctaaattgtttgaagactattacgaagtctattttagaaataaataaaaatagacttactactgtaagtctatcttattgaagttatttatccaataatatttgcttcactaggtaaagagagaaaagggatttctgcatcccactgcaatgtgttaattctgagtctattaaaaagtacatttagttctcaggtattggctatcacaccttcatctcccgggagtaccttaaatacaaaggagaaagagaactaacttatcactgttactgaaaaaagaacataaaccttctgtctgaaggtttaagatccactatttgtgcactcaaggaggcaaaactctatctaaactcatgaggataaaattctgacctgaggtgacataattaagtctgtgtgccagtaagtaccatttatttagactgaaaatcaaatgatgctctaattataattcattgtacagcatgtagcaatataggatgaataaaatgtgtgtgtgtgtatttttgtgtgtatgcatgtattgtggatgtctgtgtgtttgtatgtgtatgtgaatgtttgtgtgcatgtccatggatatttatggttgctgaaggttggtaaaccgttgccgagaaatggctcaaaaaaccatcactatggtacgataggagttaatgagaactaatgagggtgcggaaacttggaaaaaccatggggatataaatctcggtgcattttctggaaaaagtgagcaacataatattcagatatatggtgagataagcatagcttagcagagaagacactaggcagaatcatgaatgtagagagatccatccatgccttgatcttcttctatgaggtcctacttattataagcacttaatagcattgataaaatataacctcgtcccacaagggccataaaaattaaagagcaccctgatcggccttatggcattctccactatggaggagtaaagggattgagccagaaaagagactggaagcctggacaagcccactaatgtggtgatcagggaaatgagaagatgaaagccacaggacttcagaattgattggatgtggggaagagaaaaagagaagggaaagatgatcccctccttctctaggatcccaagtatttggttctggtgactaaatgggtataagagtcattaacacagatacagggggagcagatgtgcaggaagaaatgacatcaatttggaatatattaattcatgtatgtctgcaagatccacaattggggatattcaatgggcaacatcattccagatgtgaagagtctctcaaaaccttatcctcagagcatgtgctgtctataagcctggcatcacggaaatgttctcagctcacagatgactactgccgttacgcagttagttaaaaagatttgatacctaaacagctctaacttttctgaacacaaacctcttacagagagacaagagaattagatgacacattcaagagctgtggaataatatactatgccactaaaagaaattggcacacctttaacacaaatttgagagcctgcctgcttttggacggcatccagcattgacagctttatccactaaaaaataggacagccagttaaatttgaattacttttaaaaatgcaatagttgaaaaatatgctaaaaaatacagtaaacgggacataaactaaaatgttcattggtgtttattcaaaattcaaatttcattggccaccctgtatttcatctggcaatcctaaattgcagtattattcatgtacccttctttgttagtgtttaagtcatctttattctagaaaggcacaaaaagagctatttaaacactatctatggttttctgcacttactttacaaaaatagcaaagcaggatgtttatattgggcatttgggacacttctctaaatgctttctatttctctcatgttgcatgaagctatgcattaacatgccttaaccaccaatgaaatcaatgatttaaaagctctttaaaatataagcagcagcttaaagtacaaaacacatttgaagatatgaaatgttaaattcaggcctagtttttataaacatttttaccaaatgtctctgtaaatgttaagttaaataataaacaaactggagtagaagccatcagaatagcctccttagtcccacagcaaaggtgggccacgactggtttctagatgccaaaccctcttattaggtcacctagctcctgtggattgtgtttagggacatgcatgtgaacaaaaccagaatatctcacccccaaaaaacacttctttggcatatttccatatagctattcaaaggaactgcaaaccacagaaatcttcttgaaaatctgtcttttgtggagaatatttgcatctgtagagaaaatctacattcatgaaataaacagctagggtttctctgagcccacccccaccccactcctatccgaatccaggaaagattaactcacatgaatgagagggagagtatgacacctttgaaagtctgataagagacattttaccacaggccaccatctattttttctgagaactgctacctgtgaaatttcatgtgtcttagtctgttttccgtttctgttccttataacagaatacctgaaactagacaatttataaagaaaaggaacttgtttcttacaattctggaggctgaaaatccaaggatgaggggctgcatctggtgagggccctcttgctggtgcagactttctgcagagtcccgaggcaccatgaggcatcacacggcaaaggggctgagggtgctcacttggatctccctctagtcccattctcataataactcatgaattccttaatccatgaatggatcctcatgatgcactagatcataagggctcttctctcatgatctagcgatctcttaaaggtcccatctcctaatactgccacatggggaattaagtttcaacctaagttttggatggaacaaactttcaaaccatagcactctgtataacgagaccaccttcactagccaggccttttcttgtccctccctcccataacctgtcttgcacaatccaagcccctattccttctgcgacttctggatggtataaaacttcagtcatctggcctttcctgagttttcatatttcatattgttcttatgtacacatgtgcaagtaataatttctatacctttctcctatcaatctgtctattatgcatttgttttatagactcaaattatcaaaccttcagaagggtgaggaaggaggaagttatcttcacccctacacatgattcagacctctaaataacattttatgaaccagagtgacaagacactccacctggaagagttgtcaatgtcctttttatgaaagagtggtagataactgctacaactaaaaccaatccattatttgatagattaatgcaatacttcttcaagttagggaaacattttatatctaatatacataaatttcataacagtaaaaagcagaagagactgacactgcattatgcaaaccaggacctgtgattaccagtgtagctgttgatctgcctttaattagtttcttgtttttactgcaaaatgatgagtcaaatcagactcaattttcatttctccactaggatcagtggacattgacagaatgacacaattgatttcagatcatttcatgcgacattccaatttatgtagaatctgttcatgagataataaatgtgcaagtgccatgaaaaatactaagtactatacaaatgcaaagtggcattattattacatagagagatctgtcacatttcatagggactgtgacaataagtgagctagaaaaaaacaggcagcagaataaatatggtagtgaagaacggactgtcatattcctgaattctgaggagttctgagtggacaaccaaatagttgaccctcagtctattaaagtcaaagtcagatagaccaagaacctttactattataggtaaaaatgttggtagtggtgacaggggtgtcagttgtcctttccattaggtccagtttggtaaaagcatgtatgatctcaaaacacgagtggcagcctactctcaccctgtcccacccatgttagcctccctcctgatctttgcccctagttcatggaaacccatatctggcatgtttactcgttcatctccaagcaatactatgtgccaggagcacgtagtagaatacaggagcaaacaaacacacacaaaatacctggcctcatgaagtttacattccagtaaaggagacaactaatatactaattaattgattgattgattgattgaaaatttattagatgccatgaagaaaacagactattttttaaaataacatttctcatgaattgacttttaaactgttctgtggccttaataggctgtttgactttggaggtgaggttgggtagatattaatttcctcacatctgtaagacagagagataatttgtaatatctattcctgttccaaatgctatgtctatcgattaaagactaaaaatacctttgtgacagatatgcacagttttaagataaagattacatttgtttttcagtgtggtttaatcgctgaggacagagtcaacaatattttccaaattaaaatttgttctatcaaaacaaattcatgaacatgtaaataatttttgattattgctttggtacagtattaaaatctgtgttttaagatttttaagcaaaataaggtatttttattttaacagatagctaacgcatatttcaaagtgacttttaagaattatagatgtcttaacctgaatcatcaccatatttgctcaaaaaatgctgcacaaactagatcctaaatctgtaatcttatgtggctgaagaacaaaagaaatgtattcctctttcatctgtgaagcagaagttccctcactgaatatgcgaaaaccaatggccatggccttcgacagcttcctcacaaccaatttcactctgtctccctattcccatttgctgagcagatacaaagacatctgtcaacagaaaacacagatttgatgacatttgaggaccaaggaatgtcctttacccaaaatatcttctctgaggccaatgtgtgagttctcacaattagtgatttattcttctatgttatatagtagttatttccgggaagtagataaggagaaaatgaggaagaggggtgaaaacatggggaacccagggcttgagtatgtttgacagtgactgttggttggtggtggactaaaagataatagcttgataagatactgaggccagggccacacagggagtaactttatcgtaatttccctcaaactagagtgtgagacggaggcaggagaatagagtgtggaggcagggaacataaggccaattcatgctgacttcctagaactaaattaaatggaaacactttagctatgacaggaaatatcctctccatttacattgggcataccccaagtaaatgactgtaactttacttcatcctcttcatttacataggggatacaccaagtaaccaatggaaacctctagagggtatttaaaccccagaaaatcctgtaacagggctcttgagcccctatgctcaacccactcccacctgtgaagcatactttcattttaaataaatctctgtttttgttgcttcattctttccttgctttgtgcgttctgtccaattctttgttcaagatgccaagaacctggactccctccactggtaacaagataaaagacagagtagggggaataaagaaagaaggggtttcagagagaggaactttaagtcacattttattaaaactgatctttgctgtctgtacctctgacatgacaacaagccgttttccttggtattttgctttgttgacattctggtttgccataattggtcatcgtttctactaacgtgaccaaaaattaaggtttgaaaaaatgagcaattgtccaatatatgactcctaggttttataaaccaaaactaaaattttaagcccctcgaccgaatccatggacccatcctgtaggccaagggaattccaaagaaacctgaaaaactagttcaggccgtgataggtaagggtgctcaaacatgcctcattataatctcctctttttggaattcaggcacagctgatcagcattaacattacaacagaggtcttaggactgatctttgtaggaataagataccaaattccaacctgactctggtgtagcatcacacgacagatagcaggccctgaaaaaaatcaaagtattttaccccaaaatatattcctttgacatatttttaaaggccctgcaaagctgtctcttgtgggggaaatgcattttgcagagaatctccttccctttccaggtctttttctgatcctgaagagattaactgagagtctagaaccttttaaaggtaggaatagaaagcatttgccatctattgcctctaagggcagccacctatgcaacttcatctacatgataagaaccttggtctccacaatcccatatcttaacccagacacttgtttccactgattccaggtcttagataatatcagttttaactaatcatcaatcagaaaatctatgaatcccacccacgccacttgcttcaagttgtcctacctttctggaccaaatcaatgtataccttacgtatgttgattgatgtcttaggtctccctaaaacatgtaaaaccaagctgtaacccaaccacccctaggcatatgttatcaggacctcctgaggcagtgtgacgggtcacggtcctcacatgtggctcagaacaaatctcttcaagtattttacggagcttggcttttttcatcaataatttctaggtaaaagttaaaaagtgagagtccatatttactcccattttacctgcactaaatcgctagtttccctcctcctgtaagcaagaagctgaatggcctacctcagcttccctttacttattcaagtcactcaaatgcaatgcaggcagcttttactttctttcttttttttgtttttcctatttttgtttaatttatttaagaccacctcctcaccatttccagagagaaaatacaaaacaagaaacagacttggtttcgaatacataaccaggtgctggagtttaaagcattactgataacattgttacagaagaatggcagcttacttcacggcacttcagtattcctgaggaataaacataatttctcttgtcctcccactgggatgttctcaggtgaagtcactgctcctgctctttgacatattttccgtgtagaagatatggagcctggaaatcatgtgacagttggagtaagccattcctaatcccatgccagaacggaaggctaatggccacattcttcttttaaagaaggtgagaagacaattcctaatccaaaaccagtgcctatcttcacgaccacatccgccaggcaccggtcccacttccggccaagctccaactccgacctgttccccaccggcgcctccagctttcctcttggccggcttcccgctccaacccctgcaagtctcgcgagctattttctttaaaagcattacccttgaaaacttccatagtttcggctcttaacaccatcaaaattagtcttaatctctgaacacataaagataatcctttcttctctctttctgcacaatatagattttcaaaacagagggaaataaagcactttatttagttccagatttattgtgttccatttaggaatgaactactatctgggtaacccatgggatgccaactctatatggagagaataaactattttagcaatggacctggtgtggctgaatgaaatgacacttcaaaattgtaggactgtggaaaacaagatatttgctttgtgccttaacttcctttcttatacaatatgaaaatgacctgttcagtgtgttataagaattgccaaatgcaatacatttttaaaatataaggcatagaatatctttatatttactcagatgagttttgactcttctttccttggatgttggcagtttaaatgagagaaaggcaaaaggtaaacaaagctgaaataaggattgtactttattttgtttatcacatttaaagagtgtatgaatccgttcttgcactactacaaagaaatacctgagactaggtaatttagaaagaagagaggtttaattggctcacggttctgcaggctgtacaggaaccatgatggcatttgcttcttgggaggcatcaggaagcttccaatgatagcagaaggcaaaggaggagccagcacgttttatgtggccagagcaggagcaggagagcgaaggtagaggtgctgcacactttaaacaaccagatcacacgaaaactcaccatcatgagaacagcaccaagggagaaattcgcccccataatacaatcacctcccaccaggctccacctctaacatacgggattaaaattcaacatgaaatttaggtggggacaaagatccaaaccatatcagaaagtataccttgattgtaccaacactaaagtttcactgattttaaattgacatacacattaatttaaaatttttctctactgtctcaaatttatgaaaagtataaactaaccagctttgtgaatggggtcattgagaaagaaaagaaacagaaagaaaagaacccctgcccaagagaagggtccttaatagtcaaagaaaagacaaataattctagacagtatcattacaaattcaatacagtaaatatagttggataaatatatattgagtactgcagtctaaaaacaaaacacattatcttcaaggaattcataaaacttacataaacttttctatatatcaggtgtggcaaattctttggtgatctattgagaaaacacttttactagtatatatgcccttgtatagtccctccatacattatttctggttttggccatgtgactggctttagccaatggaacattagcaattgtgatgcatgcctgtacatgcaggctatattttcagaactctacctcttggaacattccctctcagattccaaccacgatactgaaaaaaccaaagcccagtctagccatttaaagagaacacatggaagtaaaccaagaacccagccaatatccccaggtaagctcccagccaaaagccagtaccaatatcctccttaaaagagattcctcccattccagttaagttgccctagttaatgcctcacggagcagagataagctgttattaataagccctgttcaaactgcagaatttgagcaaataaattattattattgtattaaaccaataagttggggataaatgctatgcaatgattatctgaatcatcagagtatgaacaatttatcaatttattctaaactataattgtacaagctgtattctgacatagtaaagccaaataaaatataagctttgaataaagagaaaaaaccaaaaactttgaaataaaaaacattttataaattacttatgagtgataaagataaaaaaattttactgacaggcttcttagaaaataaggacaatgaaaatgatgactaacctctgatttttttatcttgcccaaattcctatctaaggcatctggtgagtcatggcctcagatgggttttatttaaccctacatatcatgatttactttccaacccaactctagcataacattacaaaacaaagaagaaaatcctgtattcgtccactctcgcattgctataaagaaatccctgagactgggtaatttataaagaaaaaagttttaagtggcgcacaggctatagaagaggcatgactgtggaggccttagggaactttgactcatggcagaaggtaaagtgggagcaggcatcttcgcatggccagagcaggaggaagagagagagtagggaggtgtcacacacttttaaacaatgagatcttgtgagaactctatcacaaaaacagcaccaccaaagtgggacatccgcccccatgacccaatcacctcctaccaggccccacctcaaacactgggaattacaatccaacatgagatttgggtggggacacaaatccaaatcatgtcacttcccaactcattctgtgaggtcagtattaacctgctacaaaacccaggcaagtaaaatcacaagaaagaaaacagaccaatatcccttataaatatagacacaaaaatattcaataaaatactagtaaactgaacccagcaacatataaaaagaattacagtagtacccccttatccagggaaaatatgttctaagacccccagtggatgcctgaaaccaaagatagtaccaaaccctatacaaacttttttccctagatatacatatctatgataaagtttaattaataaattagatacagtaagagattaacaataactaataacaaaatagaagaattataacaatattctagcatcactactttgatgctttggggctattactaagtaaaataagggttacttgaagagaagcactgagataccatgacagttgacctgatcactgagatagctaagtgactactgtgtagatagagcatgcagtgtggatacactggaaaaagagcagattcacatcccaggtgagaaggagcaggacagtgcaagatttcaccacactgcgcagaatggtacgcaatttaaaacttacaaattgtttatttctgaaatcttccatttactattttcaaactgcagttgactgaaactgtggaaagtgaaatcatggataagaagggactactgtgggctgggcgcagtggctcacgcctgtaatcccagcactttgggagaccaaggcgggcggatcacaaggtcaggagtttgagactagcctcactaacacagtgaaaccctgcctctactaaaaatacaaaaattagccgggcttggtggcgcatgcctttaatcccagctgctcaggaggctgaggcaggagaatcccttgaacctgggaagcggaggttgcagtgagccgagatcacgccactgcactccagcctgggcaacgtatcaagtctccatctcaaaaaaaaaaaaaaaaaaagacgggactactgtgtataccatgaccaagtgggatttgtctcagaaaagcaaggacggcttaaaatacgaaaatcaatccaggtaaaacatcatattaacagaatgaagtctaaaaaaaaaaaaaaaaaaaggatcatcttagtaaatgcagacaagagcatttgacgaagtccaactgtctttcgtgataaaagcactcagctaggaacagaaagaaacatcctcagcccaatgaaagacatctgcacaattctcaggtaacattgtgcttcacggtaaagaccaacagcttccactcagacgggtaaataacatgaatcttgaaaaacacacatatacatacaaccacctatgttctccctcaacacaagaagggtaagagattttccacactctccaccttttcttagtgcgtatgccttagaaaatttataattgttcattctttctctgcctctttaaaatgaactctgtaagtctttccaaaacttaaataagcctcttgtcagtgttataacccaggaaccttttccttaaaggcgtagccaccatctctttgaaatgaagccaatgaggaagaccatgcacctaccaggggagtttccatgggagggtgcagcctaactcagcaggcacctgggtccaaactacaaacctacctcctgtcataaagatataatagatttgtttttcttttggattaaggcaattagtaaacacagatgcctaccccaattatcagatgaatttaggatgaactgtgtgtgacaaatggtgagtcaagtcctcttgcttgaagactagttatcatttatcttgagaacatgtatgacaagggttacatctgcttagctgtatgagatttctttctgtcttttctatctctttagtggattgcctatgttgaaaatgacatctggtttcatgtttattcaaaaatccaaactgttttcttttctacttttgggttgagcttgtctgggttggcaagagattttgttttttaatttatattcccctaacacttcttcagatcaggaataagacaaggaagtctgctcttaccacttcattcaacattgcactggaatttctagttgagtcacttagtcagaaagggaaataaaaggtctccagatgggaaggaaagaagtaagacaatttctatttgcaggtgctatgatattttgtgtagaaaattgcaagaaattcacaaaaaaattacagctaatatatgagttcagtaagtttatagtacacaaaatcaatatgcaaaaataaattatatttctatactctagcaatgaacaatccaagatgaaattaagaaaacaatttatttacaatagcttcaaaaaaacccaaaacttagggataaatttaacaaagaaagtacatgacttgtacactaaaaagagcataacatcattgaaaaaagttttttaaaaaagacctaaataaatggaaagacattttgtgttcagaaattagaagacttgccattgtttaaatggctgcattagtttcctcttgttgctgtgcaaatcaccacaaattcagtggtttagaacacacatcttatagtcctgaattgctctaaattggttcttgctggactaaaatcaaggttttggtagggctgcatttctttctgaaggttctgggagagaatctatttccttgcctttttccagcttctagagactgcccacattccttggcttatggctcactttcatcttcaaagtcagcaatggccagtcaagtctttctcacagcatgtcactctggcacttaatcttctgcctccctttttcatgtttaaagacatttgtcattacactgggtccagtagcctcaaatccatctgctaccttaattccccttcaccatgtaacataacatatccatagggtctagggattatactagaatgtagacatcttgcgggggtggggggatcatttttctgcctatcacaattggcaaattgatctacagattcaacacaattggcttttttttttcttgcagaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaacttatggaagaaaatataggtgtaagtctttgtgattttggattacacaatggtttcctagaatgactcttaagcacaagcaaccaaatcaataagttggatttcatcaaaattgaaaacttttgtgcctcaaaggacattatcaagacaatgagaagagaacacatagaagaacacacttacaaatcatatatctgatacatatctgctttccaaaataagtaaaaacttttataactcaataataaaaacacaagtaacccagtttaaaaatgggcaaaaacaaagttgttaaacttcatgagttacagaaaaatgcaatgaaaaaccatagtgagataccatgtcatacccactagtgtggctatgatccaaaagacagattaaataataactattggcaaacatgtaggagattggaaccttcacatattcctggtagaaatggaaaatggtgcagtcactttggaagacaatttggcagtttctcaaaaagttaaacatagaattaccatattgaggagtatggctgcaggccaaaatcctatgtattatctttcaggcaggaccctagacagttacaaggctttgcccggcagacctcattgggggaaactgccatctccacatcagacttggtacacagctagtatgttacagcttctggagggatttgcagccaagaactcactgcctggtccctccacccccactagccctgctcataggcttctctgctttcctagctcaggcacttccattcagaggcttcagttcaggcccttttcaggagtcccagttgagacctccttagggagggcttggctgaggcagtgctttcagctactagtgatacttctccatgttgaatgaatagttacatacatcgtaaaagtataaaaacatactttttccagatagtggaaaacttccagatagtggttacctctgggtaggaaggggaagtaggatgaagaggagccttcaattgactccgtaacattatttcttcaaaaaacttttcctggccaggcgcagcggcaaatgcctgtaatcccagcaatttgggaggctggggcaggtggatcacctgaggtcaagagttcaagaccagcctgaccaatatggtgaaaccccgtctctactaaaaatacaaaaattagccaggcatggtggccggtgcctgtagtcccagctactctggaggctgagacgggagaattacttgaacctgagaggcagaggtggcagtgagccgagatcatgccactgcactccagcctgggcgacagcgagactccgtctcaaaaaaacaaaacaaaacaaaacaaaaaccttttcttaagaatatataataaagccataatgtagtaaaacctagtatgcataaatgggtatttgttacacatatgaaatatttcataatacaaaagaatgaaaaacatcgaaataattcttagccccaggtggtgaaattatatgtgattgtgattttagttttttcttgatatgtatatacattttttcaaactcttccaaccaacatgaatttcttttataatgataataaataatacatgtgtttcacaaagaggtattactacccataactttacttaagcagagagctataaaaatatattttggttaaactgtaatatatggcttaaaaattgaaccagtattaaaatctcattttcatgtaaaaaaaaactctacaaatattttaatagttcagctgagaaatgcttttatttttcaaacacaaaccaaaatttaaaagctgaaatttacacatgtccaaattgtaagagctagtcaggaactgaaatgcaaataattacatctttaataattattcctattaagtttttttttggcaacatgaccttaaatagcccaggattatctgaatgtggtcattcaagctattactataaattactcagtgtagaggtataattaataattaatagaactttttagagctaggacatctaattcaacagtttccaatgattttctagaaccctttcttcatattaaataatgtgcagaagctcaacatgtagaagaagccataacaaaggtgctgtgtttgaagctgggagctgcattctgagcccttgcttgctccctttctcacatctttatcctcttcctccatcaacggctctttcctgtctggaaacaaggatcgtcaagtctcctgatttctaaccacacctcctgttctcatatttcatcatagcacagttttcctctattggctgttgccacagttctacctaccattgcttgtcatgatccccctgtaccccagcccttaccactcccctgaaacctctctggataaccattgtccatctgcacatccaagggatactcttccatcctttacatggacgcatatgaaatcaccatataaaaacaattctcaatacctggctgctctgtaatactactgagcttagaaaagcattgcgttcctccttgggaactttctcacatcgtgtctgacactactttcttctagttttttttcttttgaacttcctgtctgcctactccttgtaagtcaccccaaccttcctgtctctgtgtttgcctcttaagcattgtggctcctcaaggttttattcatcacttgtctatttcacagcaagtttcacacagatgctgatgaccctatgtctccttaccagccagaaacactcccctgaggctccagaaacatatttgggttgcttattggacataacagtcttaccatctcaaaagcaattcaaactcaacatactcaaaactaaattaatcacttccttttctctgcaaattctatccatgtcttctctaatcatcaggaagttttgtgggttggattgtgtcccctgaaaagatatgttgaagtcctaactcacagtacctgtgaatgtgatcttgtttggaaagaggatctttgcagaggtaatcaagttaagatgaggtcatactgcataagggtgggccctaatccaatatgactactgtactgagaaaacagacacacaggcatagacacacagagaatgccaggtgaggcagagacaagagtgatgtctcttgtcaagtatttcccttcccagatctgtcctgtcccaactgcctccccggcttttggtagcctgttcaatggacagtcccatttcttaacactttcagctgtctggcttcttagggtgagggctggcttccagcatgagttccctcatggcagtctggtgagagctgtagcagcttctgtacccaggcccctgccaactgctctacaagaggtgctggctgcatactcccgcccccacaacacttccagtggggttgagtaaccaaaagaatctggaggttaaataaggcctatgggcaaactttcatcaatgagagacaggaaatgaattattcttccttccctcccacaatcgactcttctaatgcacagaagtcccataagatctgtccagagacatctcccatgaccaagtaaatgctgcttcttaataaagctgtgacaagctcagtaacagtacattgtatttgctgtccttccttcccttctttgtttcttgtttttttccttactctcactaccctgggattactacctctcctctccaataaaaagctcacatgtaagctccgttttctatggaacccgggctaagatagcaagttgcttaaacatcattttttctcttctaaaaatagagataatgatggctcttctcataggaccaccaaaagtattatattagacaatatctgaaaagcacagtaacttgaaatagttagtgctcacaaaatgtcacttgttactattaattataactacatgaagatccagagctatttttgcattcttctcccactgtgttagtccaggttctctagaaggacagagataatggaatcgatatgtatataaaggggagtttattaagtgttaacttacacaattgcaaggtcccacaataggcagtctgcaggctgaggagcaaggagagtcagtcggagttccaaaactaaagaacttggagtccagtgttcaagggcaggaagcatccagcatgggagaaagatgaaggctgggaggttaggccagtctctctttccacacttttctgcctgcttatattctggccatgctggcagctgattagatggtgcccaccaagattaagggtgggtctacctttcccagcccactgactcaaatgttaatctcctttggcaacatcctcacagacacaaccaggatcaatactttgtatccttcaatccaatcaagttgacactcagtattaaccatcacacccactttgttacaggaagaagaaactggagaatgtgcacataatgtcccctcttttctttaatccttattgtgctacattaaaaaccattaccactgtaccttgtgctatagaagcattaaagttcatttacacaggaaaacacttattaaaggctgttaggaagcttacaaagtccctggagtacccagcagtcaggcttgaaggccatacggggagggacaaagctttagccaacattgtattgggtcaggcacaacttgtaccactgacagtggaaagtagacccaatcctgccatcttccaacaccaccctttcccctggcccaaactggactctagccaatacatactttctcccatttctcacttgcaaatccaagtcttgctgacgtaatctgattgatggagtctaagtcacatggttgtgtttcagctgcaaggaggctaagattacacatttttctgttgacttgcttaaggaaaagatattcataaggtaggaagtcccccccagatataggaaatgagttcataagattaactgaccagccagaaaatatgacaaatgtacactgtatgtctacttgaagaaatgtcccaaaccaaataaaatacggttacaatatttttttttttgagacggagtctcgctctgttgcccaggctggagtgcagtggcatgatcttggctcactgcaagctctgcctcctgggttcacatcattctcctgcctcagcctccggagtagctaggactacaggcgcccgccactacgcccggctattttttttttttcttttttttgtatttttagtagagacagggtttcaccgtgttagccaggatggtctagatctcctgaccttgtgacctgcctgcctcggcctcccaaagtgctaggattacaggcgtgagccaccgtgcctggccacagtttttaaaaaaaagaaagaaagaaagaaagactgaaagagaaagaggaaggtgggaataatctacttattgagggaattctggcaaagtatattccatgtctaggtagtccatagtgcactagctatttcttgagtggacctaacggctgctgcagaggtcacagtaacgctttcagatgccctgggcaaagtgggctaaatgctttttaactctgggtcacctctttctagccctcagttgactccaaagagtaattacaactcatagtgaacagaggcaaattcgtctcaggctcaacattaataatttaccattagttataaatcttaaaagaaaacattccctggccaatgcacatatctaatattaagatgataagatttttattcttagaaaaaaagatatatgaaaaaatggaaataaaaatacttgaaggaggaaaacaaaccacttctatcaactatatccttatcagttataccacaaaataatcttattatcaaacacacaatcctaaaattacaggttatttcccctcctgtattacatatgtatagaataactaaccaaggatttttaattctttcttcaaagtgtatatcctacctcccatttctttttattctcattgccaacaagtccaaatcagcccacccctaaattattacaaaagccttactcccttaagtgctttcattcatttattcattcattcatttattcattgaacaagcattttctgagcacttgctatgtaccaagtcctctttttcatggattatttttctaatgggaaaaatgacagaatgctagtaaattggtagaagcaaactaatggaggtgtagaaattgatacatgacagagaattgctggagtgatgcccttgaggaaatggacagacaggaggaggggtggccttcaccaggaccatggaagcagagtcgcatgagaaaaggtcggttacaggaacacaggtatgggtaaggggaaagacatggaagcaggagcttgtggaagttctcttccatagctcccagcttctccgcgaagtagggagcaggctcattagcataaaggttagagtcaaaacttcttcctcctgccaaatcctcctaatccaaacattaattatagtcaaacacctcctcctcagacatcgggcacatattgacttcccatttcacggacctcctgcagccccttcaactcctgtgaccttcccaggcttgctctgctgttccctactgacatggtggctgaaggggtacaggataaacccttgattccatcataacacacattgtatgtcagcaattcaacggcataaaacttgaaagtaaatatcactaagtaggtgatacccataaccaaggaaacatttattttattcatatgaacaggtataaacagagaataataaaaatgtttttctaattgtacataaacagtagaaggtccctgttgatctgagaagtgccataggcatggctactttgcctatagcccttggccactcttgagtggtataatagcgtggcaggcaatttgagtaaaaactgctttgtcgaaaagcatccaagttaaagcagatcttgtttaaactcagacactgacacatataagggcacaataacttctagctagttattattactttaatggtcaggaagaaacttgcaatagtcaagaagtgaacattttccttgataaaatgagaaaacgatcaccaatgaatattcctagtcactggatattctacatattaatcattatcttgctactaagaaaaactttctgtcctttcctttttcttaatgctgtatcaggcaagaccaagtttaaattttcacttcccaatttactagctatgtgatttggttattaaagcaaagatattaaaccaacctccacttcttacacatcttactctcttcatttcctcatgatgacttaaaataatatatttggaattaccactttccctcccattgctcagattttgtgctctcttcagaccctcttgctatctcctgttatagagaaactctctggccctattttctcagtggtccaaaacaatttcagtaaataatgttagctagatgctgttgttttctccttttaaggagaaaatgtggcaattagcacattctgcttatttctaccatggcccatcacatcttggcaatatttgaaagctgcataaagaggtttcatgcaggacaacgtgatctaagaggcaggagctagtgggagcaggttgtttcagatgagaaaatggagggcatcaacctatagacagccttcctggaacaatttagaatgattgtagccccacaggaggagcactccccagattcaggcttgcacaagaggcagagtgacaattcctccctacttggaacatcaacgttcctacagatgaaaagagatgcctgtctgatctgaatagctggaactctgggataggagtaaggctgggaggtggattcctttcctgctggcctggcagaggagctgaggtagctcccacccttctccctgataaaaacctcagcacatctaattgagagctcccccagccaccttcatggagactgggacctctaggtattagcactgggtattacatctacgcacctgacctagctacaactggttcctactcagggataccccccctactggcctgaagcgtgaatcatcaactcagtaaataaaatactaggggaaaattaaataaataaataaagtttgcacctcaagagaatgagataagcttcaagatatccctgccattccaacccaatagaagacagtgaatttgcccacacaccaaacacataattactacaaccagcatctaggaaagccagtgcacaaagtctacaacttaggaactcatacagagtctttacccctaacagtacaaagaatcaaattaggctataataaactataaacattaaagtctgatccttaaaaggaaaaataggaactcattgaaaaacagagttaaatcaaaaataaattcaagaacaatctgaagaaacagtctacccaaatgagaaggaaccagaaaagtaattctggcaatatgacaaaacagggttctataacacccccaaaagatcacacgagttccacattaatgaatccaaactaaagggaaatctctgaaatgctagataaagaattcagaaggttgattattaagttactcaaggagataacagaggaaggttaaaaccaacataaagaaatttttttaatctaggaaatgaataaaaaattttccggagagatagatatcataaggaaaaaccaatcagaacttctggaaatgaaagacacacttaaggaaatacaaaatgcaatggacagtttcaacaatagactagaacatgtagaagaaagaatttcagagcccaaagaaaaggctttcaaattaacccaatcagtcaaagataaagaaaaaagactcaaaagacatgaacaaagtctccaagaaatatgagattatataaaacagtcaaactcaagaataattggtgttcctgagggaaaagaacaaataagtttggaaaacttattttagggaataattgaggaaaacttccctggccttactagagatctagatatccaaatacaagaagctcgaagaactcctgggaaattaattacaaaaagatcatcacaaaagcacatagttatcaggcaaaccaaaatcagcatgaagaaaagaattttaacagaagtaagacaaaagcatcaggtgacctataaagagaaaccgatcagactaacagaagatttctcaggagaaaccttacaagccagaagggattgggatcctatctttagcctccttgaacaaattaattttcagccaagatttgtatagccagtagaactaagcttcataaataaaggagagagaaagtctttttcagacaaacaaatgctgagggaatttgccactacgaaactagcactacaagaaatgctaaaagaacttctaaatcttgaaacaaaagttcaatgtgcaccaaaatagaaccaccttaaagcatacatctcagagggcctataaaacaataatacaatgtaaaaaaagtatctaggtaacaagtaacatgatgaatagaatagtacctcacatctcagtattaacaatgaacgtaaatggcctagatgctccacttaaaaaatacggaatagcagaatggatagaaaacaaccaaccaaatatctgctgtcctcaagagactcacctaacacataaggattcaaataaacttaaaggacaggggtgaaaaaagataatccatgcaaaaagaaatgaaaagcaagcaggaatagcaattcttatatgagacaaaacagactttaaagcaacaatagtaagaaaaggcaaagaaggacattatatattgatgaaaggattagtccaatgagaagacattacaatcctaaatacatacgcacctaacactggagctcccagatttataaaacaattactaccagactcaaaaaatgagatagatagcaactcaatggtagtgggggacttcaatactcccaatagacagatcatcaagacagaatgtcaacaaagaaatggtggacttaaactatatcctagaacaaatggacttaacaggtatttacagaacactcttcccaacaactgcagaatatacattcttctcttcagtacatgaaatattctccaagatggaccatatgataggccacaaaacaactctcaattaatttaagaaagtcaaaatcatatgaagtatcttctcaaaccacagtggaataaacctggaaatcaactctaaaaggaaccctccaaatcaaacaaatacttgaaaattaaataatgtgctcttgaatgattaatcaatatgaaaatttaaaaattatttgaaatgaatgataacagtgacacaacttatcaaaacctctggaatacagcaaaagtggtgctaaaaggaaagttcatagcattaaatgcctatatcaaaaagtctgaaagagcacaaattgataatctaatgtcacacctcaaaaaactacagaaacaggaacaaattaaacccaaacccagcagaagaaaagaaataacaaacatcagagtataactaaatgaaagtgaaacaaaaaagtacaaaagataaatgaaacaaaaatctgattctttgaaaagataaacaaaattgataggccattagtgagactaaccatgaaaagaagagagaagatccaaataagctcaattagcaatgaaactggagacattacaaccaataccacagaaataaaaaagatcattcagggctactatgaacacctttacatgcacaaatcaggaaatatagaggaaatggacaaaatcttggaaacatacaactctccgagatcaaataagaaatagaaactctgaacagaccaataacaagcagtaagactcaatcagtaataaaaacactgccaacaaaaagccaggacaagacagattctcagctgaattctactaggcattctaagaagaattggtgttgattctactgaaactatcccaaagatagagagagagggaatcatccctaattcattctaggaaaccactgtcaccctaatacaaaaaccaggaaaggacataacaaaaaaagaaaactacagattaataaccctgatgaatatagatggaaaacttctcaataaaatactagctaaccaaatccaacagcatatcaaaaagataacacatcgtgatatgatcatatacgcagaaaacctaaaaactcatccaaaaagctcctagatccaataaatggattcaataaagtctcagaatacataatcaatgtacacaaaccagtagcactgctacacaccaagaatgaccaagctgagaatcaaatcaagaatgcaactctttttacaaagactgcaaaacaaataaaatacttaggaatatacttaaccaaggaagtgaatgatctctgcaaggaaaactaccaaacactgctgaaagaaatcagagatgacatgcacaaatgggaacatatcccatgctcatggataggaagaatcaatattaagaaaatgaccatactatccaaagcaatatacagattcaatggaatttccatcaaaatatcatcatcattcttcacagaattagaaaaaaaatcctaaaattcatatggaacaaaaaaagagcccacatagccaaagcaaggctaagcaaaaagtgtaaatctggaggcatcacattaccagacttcaaattatactacaaggctatagttagcaaacagcatgttactggtataaaaataggcatggagacaatggaacagaatagagaaccaagaaataaagccaaagacttacagccaactgatcttcaacaaaacaaacaaaaacataaattgggggaaaggatacactattcaataaacggttctgagataactggcaagccacatgtagaagaataaaactggatccccatctctcaccttaaacaaaaatcaaatcaagatggatcaaagacttaaatctaacacctgaatcagaaaaactctactggacattggcttaggcaaacaattcatgactaagaccccaaaaccaaatgcaacgaaaacaaaaataaataaatgggacctaattaaactaaaaaccttctgcacagcaatataaataatcagcagagtaaacaacagacaacccacagagtgggagaaaatattcacaaactatacatccaacaaaggactagtatccacaatctacaaggaactcaaaacaagtcaacaagaaaaaaacaaataatcccatcaaaaagtgggcaaagcacatgaatagacagttcttaaaagaagacatagaaacaaccagcaaacatatgaaaaatgctcaacatcactaatcatcagggaaacacaaattaaaaccataatgagataccaccttactcctgcaagaatggccataattaaaacgtttttttaaaaaatccaaaacaatagatgttggtgtggatgtggtgaaaaaggaacatttttacactgctgatgggaatgtaaactagtacaatcactatggaaaactgtaagaagattacataaagaaccaaaagtagaactaccatttgatctagcaatcccactactgggtacctaccaaaaggaaaagaagttgttttatgaaaatgcatgtttgtagcagcacaattcacaattgcaaagatatgaaaccaacctaagtgcccatcaaccaacaagtggataaagaaaatgtggtataagatgtacaaagaagagctggtaccattcctactgaaactattccaaaaaattttaaaggaggaactcttccctaacccattctatgaggccagcaacatcctgatactaaaacctggcagagatacaacaaaaaaggaaaacttcaggccaatatccttgatgaacatcaatgcaaaaatcctcaacaaaatactggcaaactgaatccagcaccacatcaaaaagcttaaccaccacagtgaagtaggcttcattcctggaatgcaaggttggttcaacatacgcaaatcaataaatgtgattcattacataaagagaactaaagaaaaaaaacaacatgattattctcaatagattcagaaaaggctttcaataaaattcaacatcccttcatgctaaaatctctcaataaactggtattgaagaaacacacctcaaaatagtaagagccatatatgacaaacccacttccaatattatactaaatgggcaaaacctggaagcattttccttgaaaaccagcacaagaatgctctcttacaactcctattcaacataatattggaaattctggccaggacaatcaagcaagagaaagtaataaaggatgttcagataggaagagaggaaatcaaactatccctgttttcagatgacatgatcctatatcaagaaaaccccattgtctcatcccaaaaatttcttaagctggtgatcaacttcagcaaagtctcaggatacaattcaatgtgcaaaaatcactagcattcctatacaccaacaacaatcaggccaatatccaaatcacaaatgaactcccattcacaactgccacaaaaagaataaaatacctaggaatacagctaacaagggaagtgaaggatctctataaggagaactacaaaccactgctcaaagaaatcagaaaggacacaaacaaatggaaaaacattccatgttcatggataggaagaatcaatactgtgaaaatggccatactgcccaaagcaattcatacattcaatgctattcccatgaaactataatttgacgtccttcacagaactagaaaaagctattttaaaattcatatggaaccaaaaaagtgcccaactagccaaggagatcctaagcaaaaagaacaaagctgcaggtatcatgttacctgactccaagctatactacagggctatagtaaccaaaacagcatggtattggtacaagaacagacacatagaccaatggaacacaatagataattcagaaataagattgcacacctacaaccatctgatgtttaagaaacctgacaaaaacaagcaatggggaaaggattccctatttaataaatggtgctgggatcactggctagccacaagcagaaaattgaaactgaacccctttcttataccacacacaaaaatcaactcaagatggattaaagacttaaatctaaaacccaaaactataaaaaccctagaagaaaacctaggcaataccatttaggacataggcactgacaaagatttcatgatgaagatgccaaaagtaattgcaacaaaagcaaaaattgacaaatcaaatctaattaaactaaagagcttctgtacagcaaaagaaactatcaacacagcaaaaagacagcctacagaatgggagataatttttgcaaactatgcatctgacgaaggtctaatatccagcatctataaggagcttaaacaaatttacaaaacaaacaaacaacgccattaaaaagtgggcaaaggacatgaacaaacacttttcagaagaaggtatacattcagccaacaagcatatgaaaagctcaacattactgattattagagaaatgcaaatcaaaaccccaatgagatgtcatctcacgcccatcacaatggctatcactaagaagtcaaaaaataacagatgctgatgaggttgtggagaaaaagaaatgcttttacattgttgatgggagtgtaaattagttcaaccattgtggaagacagtgtggcaattcctcaaagacctaaagacagaaattccattcgacccagcaattccattactgggtatatacccaaaggaatagaaattgttctattataaagaaacatgcatgcactattcacttgttcatgcacatgttcattgctgcactattcacaatagccaagacatggaatcaacgtaaatgctcaaaaatgatagactgggtaaaaaaaagtgatacatataaagaaaatgtgatacatatacaccatggaatactatgcaaccataaaaaagaataagatcatgtcctttgcaggaacatggatagagctggaggccattatcattagcaaactaatgcagaaacagaaaaacaaatactgcacattcttacttataagtgggagctaaatgatgagaacacatggactcatagagggggaacaaggcacactggggtctactggagggtggaggatggaaggagagagaggatcaggaaaaataactaatggatgctaagtttaatacctgggtgatgaaataatctatataactaacaatgtaacaaacctgcacatcctgcacatgtacacctgaacttaaaagttaaaaaataagtaaataaataaatgaaatatttttaagaacaaaatgtatatatacactatggaatactactcagctataaaaaggaacaaaataatgtcttttgcagcaacttgggtggagctggaggccattattctaactgaagtaactcaggaatggaaaaccaaatatcatattatcgggggaaccagctcccaatatttcaatgtaggttctattttccctaagtgtcggccagtctgagaaataaagagaaagaatacaaagagaggaattttacagctgggcctccagggggtgacatcacatatcggtaagtccgtgatgtcccacctgagccgcaaaaccagcaggtttttattaaggactttaaaaggggagagggtgtatgaacagggaataggtcacaaagatcacatgccttaaagggcaataaagatgacaaggcaaagggcaaagcaaagatcacaaggcaaagggcaaaattagagttactgatgaggttctatgttcagctgtgcacatattgtcttgataaacatcttaaacaacagaaaacagggttcaagagcacagaaccagtctgatctcaaatttactagggtgggatcttttccccactctaataagcctcagggtactgcaggagaccagggcatatttctgtccttatctcaaccgcataagacagacactcccaaagtggccgtttatagacctccccccaggaatgcattccttcccctgggtattaattattaatattccttgccgggaaaagaattcagcgatatctctcctacttgcatgtctgtttataggctctctgcaagaagaaaaatatggctctattctgcctgaccccgcaggcagtcagacctttggttgtcttcccttgttccctaaaattgctgttattgtattcatttccaaggtgcactgatttcatattgttcaaacatgcatgttttacaatcagtttgtacaatagtggtcctgaggtgacgtacattctcagcttacgaagataacaggattaagagattaaagacaggcataagaaattataagagtattatttgggaactgataaatgtccatgaaatcttcacaatttatgttcagagattgcagtaaagacaggtgtaagaaattataaaagtattaattttgggaactgataaatgtccatgaaatcttcacaatttatgttcctctgccgtggctccagccggtccctccgttcggggtccctgacttcccacaacatcatatgttctcaattattagtgggagctaaactgtgagtatgcaaaggcataagaatgatataatggattttgggaactcaggaggaagggtgggagtggggtgaggaagggtgggagtggggtgagactatatattggatagagtgtacattgctcaggtgatgggtacactaaagtctcagaaatcaccacttaagaacctatccatgcatcccaaaaccacctgtaccccaaaaactattgaaattttttaacagtaaagaaaatggtgggcatcaaatcatcaagtcatccttgcaaaaccagctctgatatgtgaaattgtataaaaagggctgtgtcaccaataatacaccatgctttccgcaccctcaagagtagagaagattagtgagctgcatacagcagaaaggttgtaaatactatagccaataacaaaatattcaccaacaagtgtagtcagggttttttatttggggattaagaaggggatggtgtgctagaggctaactttgccacagataacttttgttttcttatttctaatttagttttagccaagaatacgtgccctgtgtaatatgagttagggaaaagctggaaataatttgcatatctaaaaaaaggagattggctgaatgaatcatgattttaaccaagtattgggattcgatccagatattaaaactgaagctatagaaaagcactcattaatatcagtatttgtgtatgtgtgtttgtgtgttcacatagaaaggaatttggaatctggacaataagctattttctgtgagttttttccatttctgggttagtaggattacgaatattcttaatgggattttttcttcattttctgcagagaatatactgattttctaataagaaaacaatataagaaactttaatcaacaaattataaacttttttcagatttgaagttttgttgtttttattttgttatatgtattcatattcctttaatttctaattcacttttgtctgtgatgtctgcttgacttgacaatattttcagatatttctatctgtgataggatcataaaatatatgccattggtaacctatttttttatttaatattgtaaatatgcttctgggtcaacaaatacattactgtattaccagcttagtgttatttatctaaccaacctcccctttcgtgtgtgtgtgtgtgtgtgtgtgtgtgtgtgtgtgtgtgtgtgtatgtgaagcaacgaaagcacagatttatggaaatgaaagtacactccacagagcaggggcaggctgaagcaagcagctcaagggcactggttacagaattttctggggtttaaataccctctagaggtttcccattggttacttggttataccctctataaatgaagatttggcccacaactagtctgattggttgcaagagtcaaccaatcagaggctaaagtgaagttaacaaagttacacatgaagacttggcccacaaccagtgattgcttgtgggaggggaccaatcaaaggtactttccatttttcatctgtgatgcagtggaaaggggccaatctcccattttaatgcataattctcacaattggctaaaatgaattaagaaataaaatgtcaagttcacaaaaaaaattaaaataactaagaatgttaagtgcccagaaagaatgtaaaacttcctgaatattatcaatagattttaaaaatcagtgatgagaaatattcaaatgtagtaattttgtattttgattatattgtcactgaaactaatttactttcaaaattttcccaaattggctggagcccaatggaagggaagctccagcatttgtagtgagggtaattgtgggtaggagaaagggagaagaaggcagactcgaaaatctctgtggaagggggaggagaatttataattttaatttgcttcatcagtcctgaagtaaataaacccgtctttggagaataaagaaaatctgtaagttaaaaatgcagcactaaaatcacattttataagagacttgtatccctcctcatcagatgggttcacatgactttcctaagatattgaaaggttttctatccgatctttgtatgtaatatctagaagtctgaatcaaaaggttacaaaaactaggaatgagcaacgaaatttagggaaaaaaggcttaaaataacctttcagtacatgaagagtcattaaatgttgggtagtgaccatttgctttgcctggccactaaacccaaaaagaatttcaagtcataagagaaaaacttcaattatatgtaggaacactagatttttttttattttctggctatagaaatgttcataggccaaaacagtaaaaataatttataaagcacctgcctgagagtctttttctccctcagtctgttatgaagatggtaaaaaatgaaatagatgagcacatgttacaacttggcttcaagaaaggactcaaactaaatgttccttttcaggtttctctaatcctactgttttatggtctctattaagaggaccttaatgggaaccaattaactgtaaatacagtgaggagtctgggcaattaaacaaatggattatgttcacccagtgattacactccagtcatcaaatgattttccagcattgcctactctgagtcacaaatacaaattaaattcagatccaacagccttgaaatttctcattatacatcaactgccatttgcttgtctctaatgattttttgtagaaaaaaaaaagctggcattataggttgacatcacatattttgtatttgtattcaagccaaatagcactagcttttaaaattcaagtacataactaaataattatggtgatttcacaaaaaagataatacaatctcccaataatacataattatacaaatgcctttctctaaatataaagtcacataaaaatgtgtattcctgctccttaacagactaagaaataaaaagagacagttgagcaacttccatgtaaacatttgatagtctttattcaaggtagcagagaccctcacaggagaatattcttacctcattctgatttacttttattactatctcatctttttttttttttttgagacagagtctcactgtgttggccagactggagtgcaatggcataatcttggctcactgcaacctctgtctcccaggctcaagcaattctcctgcctcagcctcccgagtagatgagattaaaggtgtgcaccaccacgcctggctaatttttgtatttttttagtagagacagggttacaccatgttggccaggctggtctcgaactcctgacctcaggtgatctgcctgccttggcctcctaaagtgctggaattacaggcatgagccaccatgcctggcctatcacatctattttaaaatgatcattacctcatcagcctggtattgctattttgtttgcaaagttggtacagggagtagcaccccagaactacagggaggcagacagtctctctgggcatgactgggggaaaaaattctcaactcaatgtaactgtgaggaaaatctaaaaacagacttcagggacatctttaaagacttccaaatattcagcatagaagaatttgttcagagagcatggggggaaaaataagattttttcagacaatctggcatgtacagactttgaggccaccctacaaccatatctctgttgtgacagtcaaagttgttttcattgttaacttgaagcagatgttgtaggtgtcctattaacatcccctgacccttacttcttgcgagcacactggactgaattccaaccatttgcaggtttgtctgaggattttctttaatctcatgactttctgtgtctgcaacatgatgagcctgaagtgctgatgaattactgtaccccagaaacagaccttacccagtgacttcaagagcaagtgtataaatactgctctttctccttttgggtattcaaataaatggctcccaagtacctcaacagatttgagttctaattgcccacagtggtaacttgcccaagaaatcctttatctgcttacttccctaccctgtctcacttcccctactcttttattcatgtttcctaggatcacctccagaataaaccacttgcacttcaattcttttctcagggtctgccttcagggcaacccaaactaagagacaagagaaagaaacccagcaaggttaggcaaataggggactttattgataggctcctgtaagtgcaggaagagcaaagttgcagctgggacttaagaaaatggaatcttgagcctggacattgccatctcttattctaagtattgacctcatgctgtcagactgacttcctccctggctacaaccatggccaccaaaacactgctgggccttttgcctcccagcttcaacttttaactgagcctcagctcaacacgttctcaagaaagaattctgaatggttaaacttgaatcaagaaaacacttctacttttaacattttgggctatagggacatgcatactagaattgttccaccatgtaaggccaaggaggcaggatctctaaagcaatgggacttttggcattgatacttttttgagtattcccaatgtataagccatttaaaccatgtgcttgaagtaaaggcagggaagaaatattttcctaaagaatgaggctgttgcttccagcctgacaataggtaatgtttattaaatccctgctatgctacagataatactatctacttatcaatcgattgatcaatctattgccatccatccatccttccatccatccatccaactatcttctcaatcctcataacaaccctatgttgtagaaattatcattactgccctctgcccccatttcaggtgaggaaatttaggcccagaaaaattaagtagcttgcccaaagtcaaacaggaaggtgtagatccaggattgggcccaggcaatccaggtctagagtctgcactatgtcctgttggctcctaggggaagggacagccacacatcacagttgcccactgtgcacagatgcacccatgtccactggcatcttacttctctcactgctgaagttctgagcattatttactaaatttatgaagaaagtacactttgttatgaaaattacagatgaactcagaagaattaaggtgaggaggagctgaacagactgagaggcaaatgctttactgaggaatagatgtggccttcctggaaccctagagtactaaaatgaaattgaccaatatatgtaaaatcttcaaaacttaactgccaaatgtgaggatcctagaagtatgcctttcagtgaaaatgaaggttttaaaatggttgagtattgccaatgtatcaaggttacataaagttaacattttaaaatctttattttgacattttatgataggccataaaattgtcacagtttaacagtttattgtcttgttttaaaatgttttaaaggatttttttaaaatccttctccaaagagacgcttgaatttcaaaatattggccttctaactaatattctactattttagagaaaacaatttctggcacttcaaaggaaggttttcttgtgttagcatcgtgtcattacttctagggttgttatgaacagtctgaaatgccaagataaaaaagttaataattaaaattaaatataaaaattaataaagtactaatagctaaatgagttaagaaataaattgatgtaaagggatatatgactggtaaggtcacttggagtaactcattcacaagaataagacaaattaaatgtagccctgcaaaataatgaaaatgtttatttaattcttttgcccctaatatggtaatttcactttcatatttccccattgtttgaatcctctgacttctccactctttccattatatgtttaccctcatcaccttgctatcttttctcttctttccttttgatttcttgtgaccattttatccgtcaaccagactcccttctatacatatactgtcataatgtctgaattcgaggaaaatatatctgtttataaaattcttagttagtgcatagaatatggcacatttattacatagaaaacagagcatccaccccagccccaatggcctttccctcgagttctgcagctctgtgctgggaggtccctgttctaccctactttctatattatcctggagactcattacaagcatcatagggttttctaaccctttaatcttctacacttgactgacaccatgggtgtgtgtgtgtgtgtgtgtgtgtgtgtgtgtgtctgtgtgtccgtgtccccaaattaaattgaattcttctagtggtaaagaactaagtcatctgctcctgtgaagtaaatattggaatatccacttgagggacagataaaatgatgaatacacatctctccttcccttttcccagtttcattccacagatattcccccaaaaaaaccgcatttccatcaagtaactgtcaggctgagagataccctgtggctttacaatgccaagaggaaaattctaggtcttccagtgtcacagcacaaactcaacccagccaaactatagctcctgcttttcaccaaatacgctgagcctattcagaattgaactgaaagatttaattttcacaattcaaaaagacactctggagatacaccaaaagtttggaggcacagagaaataaaacacctattttacagaagaattaaaggcattgaacatcccctagcagggatgtggccctattctactagttgcccagtccactgttatgctgggccaagccctgaagtttcttattgtgtctgttattaacttattgcctgttgtctcttaatgtattattcaataaacaatggaatccctttaaatatttctcctttaaagtgagcacaatattaagctttctctatacatggattggagggacactgcaggaggaagaggtttcctgcaatttctgacatgggccacgagtaggcagtataggtataggactaaccagtagagcctatcccaaccatagcccattctccctctgcaaccctgcagcctcagcctggtgatcatttttcttcaaccttctcaaaacagaaaccagagcccctgtgtagcctgcaccctctgaaggcctcctgcttgtgcagttcctggactcgccccctcttctcccttccctgtggcctttaaactctgaagggcacctgtggcagctggactcccactatgtgcccacaccgcagatgctgatgccttgctccctcacctgcacttcagagggttgctcccagcttgcctagcagctccagaacagcttcagcctggaccatctagccaacttttctgctgtctattgggctaccacactttttccaatgaaatctgaaccccttccaagtttatccttccttggtactgtcactcaaccctaaagtaccatgtagttttcttacatcttatagttactctttcatcataattgttcttcatattaaacttcccctatttagcccactgcatcatttctatctcctagttggatccaggctgctatacttcattctaaggagatgtggggctaacgtgccaaccgttagtgtttaaaatagactatttctttgtttcacatgtcttgattcctgaagccatttgggggattcttcttcttttttaaagaaatacggtgctgcattatgatttgttgaatatggccacaagtaccatgcacctgcttccatctagagataaatgtatttcacacatttgggctggctcttatgtgctttgaccaacagaatatggcagaagggatgtttagtgacatccaaggctagccccaatcgggccttgcagctcagcttttactttcttggaatgttactccactactgtcatgtaaacgaaaggccacctgaaaaagatccaagggactctagccaagcatcaacacgaactgccttattaatgaagccatcttggactgcccagccaagccaataattcagccaaatgcatccacatgagttcaggggaaccaacagaggaatgatcaagcaaacctatataaaccatcgtggttttaagcaactaaattttgggatggattgttatgcatccaatacatatctgaaatatacatctctccatcatcaaatgattctaatttcttaattattcaataaattaatttgtggtaaatacatgaggaaacttcttttgaccacacccctcccaccctcagaaaaacatgttaaagtaacacatcttatcactatgtatttcctcttgaatcttgttccaataggaaatgggaaatactatacataaccactaggtattaaatgttcaaaatgacaaagtagataaataaacatggagaaggaaatctagtgcttatgattcacttttacttgtaaaagtaaagactataaaagggcaagagaaaaagaatatagagactgaagataaatgattctgaatttccaattgataaaagaagcaaggacttccactgacagaatcaatcatcagagagctttctttcttgcgttttgtgattctgaggagttcagaacaaatcagactgaaaaatgcataatgtacaatggcattatgtacctacattcacccttttttattatgacttttaggttcaggggtacatctgcaggtttgttatataggtaaactgcatgtcatgggggtttgttgcagattattttgtcacccaccagtaagcataatactcaataggtattttttctgatcctctctctcctccaacctttcatcctcaagtaaatttagattttttaaattttttatttttaactttacttgtaaatatatagtaggtgtatatgtttatggggtttatgagatattttgacacaggcatgcaatgaataataatcacatcacagtaaataggatatccatcacttcaagcattgtgttaaaacaatctaattatactctttcagttattgtaaaatgtataattaaatttttttaactatagtcaccctgttgtgctatcaaatattagctcttattcactaattctattttttatacccattaatcaccccaatccccccaacccctgcccactacccttcctagccccggtgaccatccttctatgttctttctccatgagttcaattatttaatttttagcaccacaaatttttattcccacacaatttttagtcccatatttcacttcttcggttaagttaattcctaggtattttactttatttgtagctctcataaatgatattactttcttgatttctttttcacattgtgcgctgttggtgtatagaaatgctactgctttttgtatgttgattttgtatcctgcagctttactaaatttgttgatcagttctaatagttttttggtggagtcgtcaggtttttccaaatataagatcaggtttttccaaatataagatcatatcatctgcaaacaaggataacttgacttcttccttcccaatttggatgccttttatttatttctcttatctggctgctctggctagggcttccagtactattttgaataacaatgatgaaagttaacatccctgtcatgttctagatcttcaagaagaggttttcaatttttccccattcagtatgatattagctgtgggtctgttgtaaatggctttttttatgttgaggtatgttctttttgtacccaggttttttagggcttttcatcatgaagggatgttgaattttatcaaatgttttgtcagcatcaattgaaatgatcatatagttgttgtcctccagtctgttgatacaatgtatcacattgattgatttacatatccttgcatctctgggataaatcccacttgatcatgaggaataatcattttaatgtattgttggatttgatttgctagaattttgtttattttattttattttattttatttttttgagacagagtctctgtcacccaaactgcagtgcagtggtgcgatctcagctcactgcaacctccacctcctggactaaatcattcctcccgcctcagccttccaagtagctgggactacacatgcacaccaccatgcctggctaatattttgcattgttagtagagacagggtttcgccatgttgcccaggctggtcttaaactcctgcactcaagcaatattggcctgcagttttcttttaattttcttttcttttcttttcttttttttttttttttctggaggcgtctttgtctggtttttgtatcagggtaatactggcctcacggtgtaagtttggaagtataccctcttcctccattttttgcaatagtttgtgtaggattggtattagttattctttaaacatctggtagcattcaacagtgaagccattgggtctcaggttttctttactgggagacttttcattatggcttccatctcactacttgttattggtctgtttgggttttgagtttcttcatggttccatcttggtaggttgtatgtgtctagtaatttacttacttctaaattttccagtttattggcacatagttgttcgtggtagccactaattattctttgaatttctgcagtatcaattgtaatgtctcctttttcatccctgattgtatttatttgggtcttctcccttttttttagtctgtctaaaggtttgttaattttgtttaacttttccaaaaaacaactttccattttgttgatcttttgtattgttttcttcatttccattgcttttatatctgctctttattattacttttcttctactaattttgggtttcatttgctttggcttctctagttctctcagatgcatcattaggttatttatttgaagtttttcttctttttggtttaggcatttatagctacaaacttctctcttggtactactttcactgtatcccataggttttggtatgttgtgtttccattattatttgtttcaaaaattttttcaatttacttatttattcattgacccactggtcattcaggagcatactgtttaatttccatgtgtttgtagagtatccaatattcctcttgtcactgatttctagttttattctattacagtcagagaagatgtttgatattatttcaacttttttttaaatgttttaagacttgttttgtgacctaacatatggtttatccttgagaataattcatgtgctgagaagaatgtatattctgtagccattggatgagatattctgtaactatccattaggtccatttggtctacagtgcagattaagtccaatgatcctttactgattttctatctgggaggtctgtccaatgctatggggtattgaagtctccagctattattgttgataatggtttggctacaccccacccaaaatctcatcttgaattgtaatccctataatccccacatgtcaagggagagaccaggtggaggtaattgaatcatgggggcgatatcccccaagctgttctcatgatagtgaattctcatgtgatcggttttgtgtttggtagttcctcctgcattcattctccttcctgctgccttgtaaagaaggagccttgcttcccctgtcttccaccatgtttgtaagtttcctgaggtctccccagccacgctgaactgcaaatcaattaaacctctttcctttataagttacccagtctcaggtagttctttatagcagtttgaaaacagactaatacaattatatttttgtccatctctctttctttcactctaataatatttcttttatatatctgggtgctccagtattgggtgcatatatatttacaattgttatatcttcttgctgaagtgactcctttatcattatataatgactttctttgtctcttcttacagtttttgtcttgaaatatattttttctgatataagtatagctacttctgctcttttttggcttccattggcatggaatatctttttccttctctttattttcagtctatgtgtctttagaggtgaaatgcatttttaataggcaacagatcattgcgtcttagttttttgtccactgggccactctgtcttttgattggagagtttcatccatttacattcaatgttattattgataagtaagaacttattcctgccattttgtcatttatgttttctggttgttttggggtattctctttcattcttctttcctgtcttcctgttagtgaaggtgattttcttttatggtatgatttaatttattactttttactttttgtgtatctgttgtatgttttttgatttgaggttaccatgaaacttgcaaatactatgttgtaacccattattttaaactgatgatactgattgcataaacaaacaagcaaaaagaaaacataaaaactgtatactttaattttgtccccccactttttaacttattgtttctctttatatgttattgtgctatgtcttgaaaagttgttgtagttatttttattgattcacattttagtcttacttaagctaacagtagtttatataccacaattacagtattataatattctttgtttttctgtgtatttactatttttttttttttgagatggagtctctctctgtcacccaggctggagtgcagtagcacgatctccactcactgcaagcaccgcctcccaggttcacgccattctcctgcctcagcctcccaagtagctgggactacaggcgcccaccaccatgcccggctaattttttgtatttttagtagagacggggtttcactgtgttagtcaggatggtctcgatctcctgacctcgtgatccacctgccttggtctcccaaagtgctgggattacaggtgtcagccactgtgcccagcctgtgtatttactattaccagtgagttttgtatgttcagatggtttcttattcctcattaatgccctttcatttctgattgaagaaccccctttagcatttctcataggacaggtcagatgttgatgaaatcccttagcttttgtttgtctgggaaagtctttatttctccttcatgtttgaaggatattttcaccagatatactattctggggtaaattttttttttccttcagcactttcaatatgtcatgccactctcttctggcccgtaaggcttccactgaaaagtctgctgccagatgtattgaggtccattgcatgttatttgtttcttttctcttgctgcttttgagatcctttctttatccctgatatttgtgagtttgattattaaataccttgaggtagtcttctttaggttaaatccgcctagtgttctataacctcctatatatgcagaatataatatatacatttaaatgagtactatcctttcaaactttagactaacaggaaataacaatcactattatctagtgagtgcttaccatatgccagccaggcactgttcccagcatgtgacatgtatcacctcatttaatctcacaataatcctaggacatgggcactattattatcatccccaggttgcagatgaggaaactgaggcacagaaaaattcaatcatttaaaactctcaatagccgatctagaatttaaacccaggccatctgattctagagtttgtgctcttgataatgccctgtctctgtcaataccatggtctttttccaattatgcttatttttgaaaatccctgcccaaatctcatattgaattgttattcccagtgttgaaggtggggcctagtggaaaatgactggatcatgggggtggatttctcatgaatggtttagtaccatccctttagtgctgttgttctgacagtgagtgtgttctcatgagttctggttgtttttaaagtgtgtggcacttcctcacttcccctctcctgctcctgctctggccatgtgatatgcctgctcccccttcaccttccaccatgaatgtaagtttcctggggcctccccagaagccaagaagataccagcgtcatgcttcctgtgcagcctgcagaaccatgaaccagttaaacctcttttctttataaattatccagtctcaggtatttctttatagcaatccaagaacgatctaacacatctcttttttgaaatttccctcagggccactttattggtcactgaagaatacatatttctgtaatatataatctttacacattttattttgttaaaatgtttaacatcctacttgatctcatttactcactgttgtagtaactatgtaatatataaagataaaataagcaaagagaaaacaaaataaaatagaccctaccatcaaggtacttactatctcaaatgaaaagcattttcttcaggctttattagggtaaaaatcagaaaagttcaaagatatactagaactcaataaaaatatacactaatttttatcatattaatattaaaaaatgacttgttttcacttcaattattcaaagtatttcttaagattctgctagtcaactcctctaggtcctggggaaacagtggtgaacaaaggagacgcaagtcctatgcttatggagcttgtgtgtagtggagagacacactataagccaattcaagtacaacataaggtcaggtagaggcaagactatgaaaaaataaagcagtctgaagggaggttgctatttggggcaagtgatcagggaaatcctctctacataagtggcatttaagcaaagagcagaatgaagtaaagaagtaaactctgcagctatctctgaaggaagagtattccaaggaggagtattttggagatctgaaggaacagcaagaagggaaaggacagggaattaaaaatttgttacaacaaaaagaaataattttctttctaatatgttatttccactaatgtttataatcatgcaagtacttgatcattcatgtagcaaatattacttgtgagttttaaagtaccagacttaggactgctggggattgtgatgaacaaaatcataattgcttatcacaaaatcaacaaaaagttcaattgtgtgaaggaaaagtacatagagtgtgtagatcagaggaaatagaccttgtctaagggggttcagctgaaggcaggtaagaattaaccagatgacaaatagaaaagagtattccaggcaaagggagctgcatgtgcaaaggccctgtggtcagagggagcccagatgaaacagctaggaattgttaaagtttggtttgtggtaaagctgaagaacttggcagaggccagagaatgcaaggttgtctgcttgtggccatactgagggcttggtctttgcatgagcagctggaagtcacttaagtgttttaagccacttaaaattctcaaaattttgagtgtattatagctttcttaagaattctatcaactttatgtatcaaaaaaataatttttttaaaaatttaagaagtgcagttaataggcatgcttcactttgtctctacttaatcagttttacctacaggtttattttgatccatccaatttaaagttcatgagcttctcttctaattatctagtgtcataatatgaatgggattatactaagccatagactaataattcccattccaggaatagttgaagttttccatttttattggaaaacttttattgtattttatacatcatactagcttcataaatcccatatatgttctgtgaagaactagctgaaaatgcttcccagagcctcaaactctatactcttcccaaaaaatgaagttgaagatggtgtctaattttcttctctggaattggaggaagacatagagataaaaaatggaaacaagtaccatatttggatatttttttcccttgagaaggataacaaatacctgcctaataataaatcacatcagatgaatgaaaagaacctttactgaccttctgttctagtacaatcggtccagcaatgtgcccacaaaccctttatctagcagctgaatacagaataaatgctctgaggcacttcctacaagagttgacaaagagacctttcttccattcagtaagttaatatctgaggaagcaaaagcaaatggaaagggcaaaatgacatggggacatcaaactctggggaccctgcagggaagggaaaggggtgcctaggcatctctatggcatccaaatgtccacatcccaggtccacatttataggctcagacaagcttagaaaaattaatgaaaataagaattatagaattacaaaaaaattctagaatgtcgggaccctagccagactcctactcacatttccagtacaagtctatggcatcatacctcaagcaatggccctccagctctctgcctggaatgccccagcccacgccctggcatgccataagcacctgggcataagctccccagagcagccctcagtcagatgctgagggctcccccttgtgattggaaaaaaaatactccaacctctcatccggtgcgcagggcaactcaaagacatcctgtacaccaagctagtccaacccccggcccacggaccgcatgtagcccaacataaactcaaaaatcttttttaaaacattatgagattttggtttttttcaatttttaaaagcccatcagctatctttagtgtcagtgtattttgtgtgtggtccaagacaatttttcctcttccaatgtagcccagagaagccaaaagattggacacccctgctttacactatatcccagataatactctatgaacctaattattaatgttcactgtactggctgctttccctcccaatctcacttcaccactctcctaatagtgtttcctgggacctcctcctaaataaacaatttcactcaaattcttgtcccagattctgcttttggagaatcccaaattaagaaagaaacacaatatgatgtaggactgagttcttttaactccatactcagttaaggacatcaaaaactagcaagaaagacggtttgtgagcccaaattcatagtaaaacctatcagacaagaggcatttctaataactcggagagatgagagaagggagtagaaagaaatttttaaagcaatttaaaagaataagaagttgacagaaagataaatggtagtaagatatactttacatgctattaaaacaatcatagtacacatacatgaaataatagcttatctatatgagtaggttcagcttacaaacccttcagttaatttaaaaattaaatgaaaatgtgaagccgtgtttgcgctaatacggcaaaaaagttggcatgttttggatttcttcctacgtattctatggattctgtctctttctcttacacacacacacacacacacacacacacacacacagttgatactatcatatgagcaattctaaacttaattcaaagtctcaggaataaaaatatgctttcaccaagtatgaccagcagaaatttaagtttgtgttttaattgttctgcaatttgacaatcaaatctgttcagagatatatgattacttgacacttttatgatcaaattttattgtttattttataaaaacagtacacagtgaaacaaaagaaaattattcttctctcagaaagtaacgagtaggtcagccttactgttaagaggataagtagacatcatataagcttgcagcttacaaggtacatgttagcctgccacagtttctttgcatcttctcatgaaaccactttcaagaataaagatgtaaaacatatccagtaagataaatgaaaagtcaccctcttaaaacattattctgaacacttctgcatgaaaggactttgtaaaattaggctgctatttttagacaatttctactcttcctcaagaagagtcgtgtttaattctatccccaggactcaattgtacaactataggctagatttaaaaaaaaataaaagtgtcttgattgcttgacctgttgaatcagatttcagaatatttccctgaaatctgcttttctactctttaccataactgtttgctaatttcagcagattcagacaaatgacatgtgatcagcaaaagaagattcttacttcataataattaatggcttgcaaaggaacccccaaagtatgccaaagaatttaagtgtctcgatttatcaaaatataaacactcatttatctaagaagcaatttactttgtaaacatatgtctaagtatacatatcattatttattcattcacacaataaagtttattcagtgcctattatttgccagatactaggataggtattagtgtacaaaaatccttgccctgcacttgaatgtttataggtagaaaagagaaaaagagtcatacatacaagagggtacaataaaatgttccaagtatcatgttgggtagcatatctattacttcattctcagattcattaaacaactattgcacacctactatatgccaaggatcattgcaatttacaattgatataagtaatccccatgaggggcatgataccttagaagaaagattatttttgtggtggttgttttaagcatacataatgatccacaattctagtaatgtgtattacctagataattgaaaaaacttataaaataagctttctttcctgaaattctctttcctttgcaagtcaataatataaatgaaagcctaaatcagttaagtatgatgtttgagagccataaaagaattgtccttaccaagaatacaggattgttccaaccacagaggtgagtttactgttttcttgtttttgctttgccaggccaaagtcagctacaattcacaaaacaacgcaatatgttactatattttcccagagttatcattgttccttagcatttgacaatctacacaataactactacacttcataaccaaaggcttttcttttcttaatgctatatattttgatataatgaggtttatcattttaaaaaaacataaaataagtcttgctgactgaaacataggacaaagtacttattgaaactgtgattccattttttaggttatcctttataatttttaagtaaacagaatgaatctaacatttggcatagggcagtcatgaccttgtcaggctaaaagaaaagtaaggtacacccaaataaataccatgaaggcctgaaaacctaaaattaactggcatcaacgtgtactaatcacagtacaagtatgttcaaaataatctcaaaatatttatatatcaacaacatattctgatttttatcacagaacaccaaatatctatatgtaatattagcacaatcttgtacttttcaaaatatcttcaggtacttctcttttttctctctttttttttttttttttttttgagacagaatctcactctgtcacccaggttggagtgcagtggtgcgatctcggctcactgaaacctctgcctcccaggttcaagcaattctcgtgcctcagcctcccaagtagctgggattacaggcacgtgccaccatgcccggctaatttttgtagttttagtagagacgtggttttaccacgttggccaggctggtcttgaactcctgaccttgtgatccacctgccttggcctctcaaagtgctgggattacaggcgtgagccaccaggcccagcctgtcttttataaaccactcaacaacttaggtcaaaatgataaaaacagatatttttcctatccatttgctacagattcacagatatttcaagaaatttaattaccaggattgcacaaaaaagacaatgcagaaccagtgcaagaattcaagttgtttttccaaataagctttgatattctcaatatcatgttgtaaagcacagcaaatgctcatggaatttcactggaacaaacttcaatgcagtatttgattatatatactaaaatacctttcaggtcaaaaatattccaaagtcatttcatttcaaaataataaaaattcgcattattaataataatacacgtttactaaacaacaagtttatactagcataaattcagccacttacatgaattgcctcatttaacactcatagcactctgaaagacaggtattatcattagtatagcttagtgcttaaaagacaggactcaggaactggacagcctcaatctgaatactgactctattatgagcaacttgagtaaccctgggcaagttattttatcttgttttccaatagctttcttttttcttttttttttttttttttgagacggagtctcactctgtcacctagtctggagtgcagtggcgcaatctcggcttactgcaagctctgcctgccgggttcacgccattctcctgcctcagcctcccaagtcgctgggactacaggagcccgccagcacgtccagctaatttttttattttttgtatttttagtagagactgggtttcacagtgttagccaggatggtctcgatctcctgacctcatgatccgcccacctcagcctcccaaagtgctgggattacaggcgtgagcctccatgcccggcctccaatagctttcttatctataaaataaggattataataatatactgctgatatatattgtaaacagaatagtatgaaagtaaaatttaaataatttaatatatgcaaatgtcatgtatgtattatatatattttttattatactttaaattttagggtacatgtgcacaacgtgcaagtttgttacatatgtatacatgtgccatgttggtgtgctgcacccagtaactcgtcatttaacattaggtatatctccaaatgctatccctcccccctccccctaccccacaacaggccctggtgtgtgatgttccccttcctgagtccatgtgttctcattgttcaattcccacctatgagtgagaacatgcggtgtttggttttttgttcttgcgatagtttgctgagaatgatggtttccagcttcatccatgtcctccaaagacatgaattcatcattttttatggctgcatagtattccatggtgtatatgtgccacatttccttaatccagtctatcattgttggacatttgggttggttccaagtctttgctattgtgaatagtgccgcaataaacttacgtgttcatgtgtctttatatcagcatgatttataattctttgggtacatacccagtaatgggatggctgggtcaaatgctatttctagttctagatccctgaggaatcgccacactgacttccacaatggttgaactagtttacagtcccaccaacagtgtaaaagtgttcctatttctccacatcctctccagcacctgttgtttcctgactttttaatgatcgtcattctaactggtgtgagatggtatctcattgtggttttgatttgcatttctctgatggccagtgatgatgagcattttttcatctgtcctttggcttcataaatgtcttcttttgagaagtgtctgtttatatccttcacccacttgttgatgcagttgttttttttttattgtaaatttgagggagttcactgtagattctggatattagccctttgtcagatgagtagattgcaaaaattttctcccattctgtaggttgcctgttgactctgatggtagtttcttttgctgtgcagaagctctttagcttaattagatttcacttgtcaattttggcttttgttgccattgcttttggtgttttagacatgaagtcctcgcccatgcctatgtcctgaatggtattgcctaggtattcttctagggtttttatggttttaggtctaacatttacgtctttaatccaccttgaattaatttttgtataaggtgtaaggaagggatccagtttcagctttctacatatggctagcgagttttcccagcaccgtttattaaatagggaatcctttccccattgcttgtttttgtcaggtttgtcaaacttcagatggttgtagatatgcggcattatttctgagggctctgttctgttccattggtctgtatctctgttttggtaccagtaccatgctgttttggctaccgtagccttgtagtatagtttgaagtcaggtagagtgatgcctccagctttgttcttttggcttaggattgacttagcaatgtgggctcttttttggttccatatgaactttaaagtagttttttccaattgtgtgaagaaaatcattggtagcttgatggggatggcattgaacctataaattaccttgggcagtatggccattttcacaatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgcgagttcactcatgatttggctctatgtttttctgttattggtgtataagaatgcttgtgatttttgtacattaattttgtatcctgagactttgctgaagttgtctatcagcttaaggagattttgggctgagacgatggggttttctaaatatacaatcatgtcatctgcaaacggggacaatttgacttccttgtttcctaattgaataccctttatttccttctcctgcctgattgccctggccagaaattccaacactatgttgaataggagtggtgagagagggcgtccctgtcttgtgccagttttcaaagggaatgcttccagtttttgcccattcagtatgatattgcctgtgggtttgtcatagatagctcttattattttgagataggtcccatcaatacctaatttattgagagtttttagcatgaagcgttgttgaattttgtcaaaggccttttctgcatctgttgagataatcatgtggtttttgtttttggttctgtttatatgcaggattacgtttattgatttgcgtatgttgaaccagccttgcatcccagggatgaagcccacttgatcatggtggataagcttttggatgtgctgctggatttggtttgccagtattttattgagaatttttgcatcaatgttcatcagggatattggtctaaaattctcttttttggttgtgtctctgccaggctttggtatcaggatgatgctggcctcataaaatgagttaggaaggattccctcttttttttattgattggaatagtttcagaaggaatggtaccagctcttccttgtacctctggtagaattcggctgtgaatccatctggtcctagactttttttggttggtaaactattgattattgcctcaatttcagagcctgttattggtctattcagagattctacttcttcctggtttagtcttgggagggtgtatgtgtccaggaatttatccatttcttctagattttctagtttatttgcgtagaggtgtttatagtattctctgatggtagtttgtatttctgtgggatcggtggtgatatcccctttatcattttttattgcgtctatttgattcttctctcttttcttctttattagtcttgctagcagtccatcaattttgttgatgttttcaaaataccagctcctggattcattgattttttgaagggtttttttgtgtctctatttccttcagttctgctctgatcttagttatttcttgccttctgctagctttaaaatgtgtttgctcttacttctctagttcttttaattgtgatgttaggatgtcaattttagatctttcctgctttctcttgttggcatttagtgctataaatttccctctacacactgctttgaatgtgtcccagagattctggtatgttgtgtctttgttctcattggtttcaaagaacatctttatttctgccttcatttcgttatgtacccaggagtcattcaggagaaggttgttcagtttccatgtagttgagaggttttgagtgagattcttaatcctgagttctagtttgattgcactgtggtctgagagacagtttgttataatttctgttcttttacatttgctgaggagtgctttacttccaactatgtggtcaattttggaataagtgtggtgtggtgctgaaaagaatggatattctgttgatttggggtggagagttctgtagatgtctattaggtctgcttggtgcagagctgagttcaattcctggatatccttgttaactttctgtcttgttgatctgtctaatgttgacagtggggtgttaacgtctcccactattattgtgtgggagtctaagtctccttctaggtctctaatgacttgctttatcaatcggggtacccctgtattgggtgcatatatatttaggatagctagctcttcttgttgaattgatccctttaccattatgtaatggccttctttgtctcttttgttctttgttggtttaaagtctgttttatcagagactaggattgcaacccctccctttttttgttttccatttgcttgggagatcttcctccatccctttattttgagcctatgaaattctgggttgaaaattcttttctttaagaatgttgaatattggccccaactctcttctggcttgtagagtttctgcagagagatcagatgttagtctgatgggtttccctttgtgggtaacctgacctttctctctggctgcccttaacattttttccttcatttcaacttcggtgaatctgacaattatgtgtcttggagttgctcttctcaaggagtatctttgtggcgttctctgtatttcctgaatttaaatgttggcctgccttgctagattggggaagtacccctggataatatcccacagagtgttttccaacttggttccattctccccgtcactttcagatacaccaatcagacgtagatttggtcttttcatatagtcccatatttcttggaggctttgtttgtttctttttactcttttttctctaaacttctcttctcgcttcatttcattcatttgatcttccatcactgataccttttcttccagttgatcgaatcggctactgaggcttgtgcattcatcatgtagttctcgtgccttggttttcagctccatcatgtcctttaaggacttctctgcattgattattctagttagccattcatctaattttttttcaaggtttttaacttctttgccgtggcttcgaacttcctcctttagctcagagtagtttgatcgtctgaagccttcttctctcaactcgtcaaagtcattctccatccagctttgttccattgctggtgaggagctgcattcctttggaggaggagaggcactctgatttttagagtttccagttttcctgccccatctttgtggttttgtctacctttggtctttgatgatggtgacgtacagatggggttttggtgtggatgtcctgtttgttagttttccttctaacagtcaggaccctcagctgcaggtctgttggagtttgctggaggtctactccagaccctgtttgcctgggtatcagcagcggaggctgcagaacagcggatattggtgaacagcaaatgttgctgcctgattattcctctggaagttttgtctcagaggagtacacggccatgtgaggtgtcagtctgcccctactagggggtgcctcccagttagtctaatcgggggtcagggacccacttgaggagacagtctgtccgttctcagatctccagctgcgtgctgagagaaccactactctcttcaaagctgtcagacagggacatttaagtctgcagagttttctgctgccttttgtttggcaatgctctgcccccagaggtggagtctacagaggcaggcaggcctccttgagctgcggtgggctccacccagtttgagcttcccggctgctttgtttacctactcaagcctcggcaatggcaggcacccctcccccagcctcgctgccgccttgcagtttgaactcagactgctgtgctagcaatgagcgaggctccgtgggtataggaccctccgagccaggcacgggatataatctcctggtgtggcgtttgctaagaccgttggaaaagcgcagtattagggtgggagtgacctgattttccaggtgccatctgtcacccgtttctttgactaggaaagggaattccctgaccccttacacttcccgggtgaggcaatgcctcgccctgctttggctcatgctcggtgcactgcacccactgtcctgcacccactttccgacactcctcagtgagatgaacccagtacctcagttggaaatgcagaagtcacccgtcttctgcgtcgctcatgctgggagctgttcctattcggccatcttggctccacccccatgtatgtattatatataaatacatgtagtagagtattgaataaatgatgtatattattatttaattatcacaattacccatttgatagatgaggaaataggctcaaagagaatgtgtgacttgcccaatgtctcacagggagaaattaacaaagtgagatattaatctggggttgcttgattctaaagccccaaatctcaccaagacactgccaatatagaaaaataaggaccagatcaattcaatgataaactcaaccaaacttttaagaaatatataccaattctacacaaactctaccagaaaatagaagagggaatatttcccaaatcacttcataaagccaacattacatcattctaaaaccagtcaaaggcatgacaagaaaagaaaactacagaacaagagcctcatgaacacagacacaaaaattattgacaaaatgtaagtaaatcaaatccagtgacatataaaaagcataatacataatgatcaagtggggtttatgccaggaatacaaggctaatttgacttttaaaaatccatcagtgtgagttcaatagaagcctgaacaccagcagtatgcaatatatccatgtaacaaacatgcacatatagcccctgaatccaaaataattttcaaataaaaattaattggccaagcctggtggctcacacctgtaatcccagcgctttgggaggccgaggcaggtggaacaactgaggtcagaagtttgagaccaccctggccaacatggggatatcccatctctactaaaaatgcaaaaaaattatctgggtgtggtggcaggtgcctgtaatcccagttactcaggaggctgagacaggggaatcactggaacccggcgggcagagcttgcagtaagccaagatcacatcactgcactccagcctgggcaacatgagcgaaaatcagtctaaataaataaataaataaataaataaataaataaataaataaataataattttaaaaaatcatcagtgtagttcaccagatcagtacattaaagaaggaaaaccatgatcatctcaacagatgtgcaaaaagcgtcagcaaaattcaacatctattcctttcagcaaaataagaatagttgggtattttcttaacctgataaagagcatctaccaaaaaaagctgtagctaataatctacttaaccctgaaaaactgagtgtttcccttttaagttcaaaaacaaaacatgtccaccattctcagcattcctagtcaacattctattgaagattcaggtaagtacaatatgtgcatatgaatttttgtgggaacataattttaaatttccctttgaaaaatgccttggagtgggattactggatcatattataagcatgtgtttaatttgattttataaaaactgccaagtcaaaatgttttccagttttttctctcaccagaaatttgagcgttccagttgcttctgcatccccatcagcatttaatgttgtcagtttttgtttaatcagccattctaataggtacatagtgatatctcagtatagttttgatttgcatttccttagagcttatttgtgttgaacacttttcatgtatttatttgccatctgggcatcttcatttaaagaaatggaccacttcatgcatttgcatgtcatccttgtgcacgggccatgctaatctctgtatcactccaattttagtatacatgctggcacagtgagcacctgggtatcttccttagtgaaatggctgctcaaatttttgcatttttcattaggttatttattttcttatttttaagttttggatacaaattatttgtcagatatacaatttgcaaatatttcctttttttttttttttttgagacagagtctcactctgtcatccaggctggagtgcagtggcgcaatctcggcttactgcaagctccgcctcctgggttcatgccattctcctgcctcagcctcccgagtagctgggactacaggtgtccgccaccacgcccggctaatttttttgtatttttagtaaagacggggtttcacagtgttagccaggatggtctcgatcctgacctcgtgatccacctgcctcggcctcccaaagtgctgggattacaggcgtgagccactgcgcccggcctacaatttgcaaatattttctactagtctgcagcttatcttttcattctcttaacgtttttcaaagaatagaagttttaaactttgactaagtcaaatttattagtttattttacatgttatggctttgatgctgtctaagaaatatttgcctagcccaatactgcaaagactatatccatttttttcttccagaagtttcataatttaagtttcatatagtgctatgatccaagctgagctaatttttatataagatacaatatgtaggttgaggttctgatttttttatggggatttgcaactgttcctgcaccatttgttggaaatagtcccttcctctctccgagcaccagatttacatattcatctggataatcaaaactttcacttaagtgtctcctaggcatctcaaaattaacacactcaaagagaattctcaatcttaacccaaacaactcctccttggtttcccatctcagtaagtggcaccatcattgacctaggtactttccttagttcttgtgctagctgtcaacttattccctttcagcatcaaatccacccttcatcattgccctgctttgttaatggagctggaccttgataatgtctctccttcgccagctggcttgatgtaaagctttgtcagtagagggtgtgctgaagagaaactacaggagaggcttctcttcttttccaggttctgacatgcttcctctctttccttgctcctgtagcacttgtgcagtgtgcaggatgcttagtggtgctcacttcccctagaggcagcttcgtagacagttccactggcactatatccagcttcctggcaagttttgcaagcaccccagcagacaacataccatgaaattctgctggcatctcagctgttttcacaacacctccacaggtagattcccagtaacttctaccggcattctagccaggctcagtctagttagtctcaggagcacccaagccaacagcttcctactgagttctactcataccccagaaaatggcttcctgaaaaacatggtcatcattccaggggcagctttctgtttgacagctttatcctgcagcatttcaatgcaatttctgccatctgtgggctatagtcataccctctccaacaaagtctggatctcagcccttgaggagaggggctgtcttaaaatttgctccttctttgtatagtttgcctcagccctagaggtagtagctgcttatatatgtatacctcattttattgtgcttcactttattgtactttgcaaatattgcattcttttttacaaattgaaggtttgtggcaaccctgtatccagcaagcctatgagcaccattttttcaacagcatctgctcactttatatgtctctcacattttggtaattctcataatatttcaaactttattattattatatctgttatggttatctgtgattagtgatctttgatgttactattgtcattgttttgggacactacaaaccatgcgcatataagacggcaaacttaattgctaaacattgtgtgcatcctgactgctacattgactggctgttcccccagctctcactctctatgagcctccttatccccctagacacaataatattgaaattaggccagttaataaccatacattggcctccaatcattcaagtgaaaggaatagtcatacatctctgacttttgatcaaaagctagaaatgatgaagcttagtgagaaaggcatgtccaaagctgagacaggctgaaagttaggcctctggcatcaaacagccatgttgtaatggaaaagctctggaaggaaattaaaagtgctactcagtggagtggcacttctgaacacacaaatgataagaaagtaaaacagccttattgctgataaagagaaagtttaagtgatctggacagaaggtcaaaccaacacattcccttaagccaatgcccaatctggagcaaggccctaactctcttcaattctgtgaagactgagagaggtgagaaagctgcagaagaaagtctggaagctagcagaggttggttcacgaggtttaaggaagaagacatttccataacataaaagtgcaaggtgaagtagccaattctgatatagaagctatggcaagttatccagatctggctaagacagttgatgaaggtagctacactaaggaatagatatccaatgtagacaaaattcccttctactgaaagaagatgccatctaggactttcatagttagggaggagaagtcaatgcctggcttcaaagcttcaaagaacaggctggctctcttattaaggactaatgcagctggtaattaagttgaagccaatgcttattgaccattctgaaaatcctagggcccttaagaatgttgctacatatactctgcttgttgtctataagtggaacaacaaagtctgaatgacagtccttctatttgcagcatggtttactgaatattttaagcccattgttaagaactactgcttagtaaaaaattcctttcaaaatattagtgtttgttgacaatacacctcatcactcaagagctctggtggatatgtaaaaaaagattaatgttattttcatgtctgctaacacaatatccattctgtagtccatagatcaaggagtcatttctacttttactaattcagagatacatttcataaggctatagctgccatagatagtgactcctctaatggatctgggcaacgtttacctcctggaaaagattcaccattctagatatcattaagtacattcatgattcatgggaagaggtcaaaatatcaacattaacaggagtttggaagaagttgattacaacccttatggatgactttgaagggttcaagatttcagtgaagaaactcactgcagatgtggtggaaataacaagagaactagaattagaatcggagcctgaagatgtgactgaatcattgcaatctcacaataaaacttgaacggatgaagagttgcttcttctggatgagcaaagaaacaggtttcttggaatggaatccactcctgggaaagatgctgtgaacgttgttaaaatgacaagaaaagatttagaatattccataaatttaattgacatggaggcagcagggtttgagaggattgactccaattttgaaagaagctttactgtgggtaaaatgctatcaaacagcatttcatgctacagacatttattttgtgaaaagaagagacaatctctgcagcaaacttcactgttgtctcattttattaaattgccacagccacaccaaacttgagcaaccaccaccctgatcagtaagcagcatcaagtcatgaccctccaccagcaaaaagattatgacttgctgaaggctcagatgattgttagcactttttagcaacgaattatgttttaattgaggtatgtgcctaaattgctttttagacataatacacacaaatagactattgcacacaaatagactataacataatgtgaacacaacgtgtacaaactgaaaaaccaaaaagtttatatgacttgctttattgcaatatttgctgtattgtggtgttctggaacaaagtccacagtatctccaaggtatacctgtatatgctattcctgtgttctttattgggttatctttaactctttgtagttaatcttagtactagttaaaaatcattttaatacatgaaacttgtcctgttaaaattactcggttgttcctgtctcatgaatgagtcctgactgatatagttcctcactttcctttaccacagcaaaatcctattgtttctacaaaaagtttatatatatagtgaattaggccacctctcatcacctccactgaagttgtagttttgaaaaatgttcaccagttctttaacattcctcccttcaggaggtgaatcttaattgtccttctcttatgtgtggatgagacttggtaactcatggctaatgaactgaatatagcagaacggatgagatgttacttccaaggttcggttataaagaaactacagcttccaattgtgttgtgctctctcttgctcactgactctctctcagaacccagcaaccatgtagaatagtaaaggttattctgctgaagaggttatatagagaagagcagccctcaaggataaaaggccaaatggaagagaaatgaggcactcactccagtcaaaacccagaacccattgccagccatggtattgagccttcttggaagctgaccctccagccccagtccaggcttcagatgatgcatccctggctgacagtttgactacagcctcatgagaaaccctaagtcagaatcacccagataaactgctcctggactcctgaccctcagaaatgataagaaaataaatatttgttattttaaccctccaaatttctggggaatgtgttacccagcaatggataatgaatacaactgccatcatccgtccatgctactgtgacgtctcactgaggctactgagctattcctcccgaacagactccctccctccatctctcctcatgaaatataattctccacttcaggtccaaaaggatcttttaaatatctaaagttgccatcacgagtgtccatttactcatttgtcactacttacaaggttaaaactctacaaagacgtttgataaatactaagaataaaagccaaactactacaaggtctacacgaccatacatgatctgggcgttcagaatgacttttctagtacacactataaaaaaaaagtcctctccttcaatattcttctattacatttatttaattcttaacatatttcattatctgaaattactttatgtatttatttagtattttttcattcatttagggtctgtcatttctaactagtatgaaagatccatgagaggactttgtattgcttatccctgtagactgatggatacatatcttttaatacatgtatatgtacatatataggcataactatatgtatatccatctatctttccatccatctatctatcttctatctatctatctatctatctatctatctatctatctatctatctacctatctatctgtctaacctctccacctaatagtactattcacatataggacatattagaagactaaatcgtataaggtggtgttaacaactattcacaaactagatggcttgctatctttccccttttatgtactggagaaaattagttaaaattaagcaatcactatacagaaaaaaaaaagtattcaatattcacaacttcaatatttttagggagcccactataattttagcatacaattcttgaccaacttataaccaaaaataatgctttggcttttctttctaatgctatgtaagagtcatcttattcttactaaaatgccatttattttgaaaggcaaaaactgaggagcattacaatgattttattcactccagttaatttagataatagcagacacttggacagatatccataaaaacacagagagttgagaggtattcttaaaatgagcaaaaactaatattgtttggacatttgggagacctgggtggtaacagaaatgtttctattactctttcctcatttgtgatcatatttggagaagaagaaaatgttttatttcagaaattgtactcataaaagcattcatgtgccattacaggtattcaaaatgacaatagaaaacattttgcatacagcacattatgaaaaaaaaataggatccaaagaaattctcccctttgacaggacaaatgatacagaaaatgttaaattctatagcatgtttacactatagccctacaattaccagccttcagatggaaaagttgtgtgtgctttggctgagtccctagattcttgctctctggttttcaaaaatggcctataaaacttaccttactgtttgcaaaggattgtttcaacaacagcatgacaataggtgaaaagcagtttgaaatactgtatagatgcaaggtattcccaaccctatccacagggaacccagctgttcacaacctttcacccatcacatatgtgtcagtgacttccaaattcagctgtaaagtcccagcctttgtctggggtttcacctccagccctataaagcacctgccacttcccacccaagactgggctcatcattcagtcatcagggatatcccagtcaaccagatggcatctcatcttccccatttcctgggcttgaaatctttgccttttctcacttgctgctatattcaacccctcaccagctcttgtatctgcatctttcttttgatttgtctgattatagtttaaatgtgccaggagcttaggctctcactcttcctgcaaaaaaggggatgcacttctttagaaagcttttccttttaatccatcctacagggtatttgacaacgaaacaatctaccaacacctgccttcatcacatcaggcccccacttatgtaccagaaggtcttccgattgctattttttacaaagtttccagctgccttatctggacttcatgattgtccatttactcatttgtccaacactaagagcatatgttctaggtgctgaaccaggtactcaagataagatgataaccaggtcaaaaaccatccatgatgacacagactttagggaccagtggtgtagatacacattaaataaagaatcacacatataaatgtaaacttacagttgtgataagatcattaaagaagactgaccttcaacaaatccctgtcccactgacacttccttctctgaaggtcactcagattctaatctctgccccccaactgcttcctaaccttcccccatatatggggttaagagagggtattataaggaaaacagctgattgggaaaagcctctgtgacaaatggtgactgggttaacatctgaaggaaggcagacattatctaggtaagaggagaaagtgaagaagagacttccaggcagaggaaatggcatgctcaaaggccctatggtcaagggaaaatggtctactgaggaactgcgtggccaaatgggggttattgacaggctatgcaagaccctgcagccatgttcaggtgactgacctctctcataattgcccaaattaaaatgtcccctccaacaaactactcatccttgtacagcacttgaccataagcatcttggtgcctttcaaacatgtctttttcgttacctgaaatggcttcctctgagagaatagtagagagagacttggttaagagatgacctctagaagtagacatggttcattgctgacactgtcaatctacaaacagggaatttaagcaagttttctaaactctctaaacctttttcactatctttaaaaggcatcagagtattgaatgagaaaatgcatatctatccttttatcacatagtaaatgctcaagggatgtagctatgggtggttgttccttttcttcaaagcatagctaaaaatttttatcatcttaaagatgtcttccctgagtaaaatgaaaataattaatgacctgacaatttcgggaaatgattatttgaaacctctataatactaggcaatgacagaggagtctacttgagcacaactgtgaaacaggccagaataaagatctccagctcatttaccactctactctttcctgctgcctcagtaaatggaatggctaacctacaatgtccacagcaacaggaccatcagtaacatcctctcagtgcaggagtcagtgagggacgggaaggagtttcccaggataatgctcagagttttccctcaacgaacccctgtctcactgacacttcctcctctgaaggtcattcagattctaatctctgcccctcaaactgcttcctgaccttcagctaaatgaagtccaactactattaatattaaaattatttctaattcaacaaatggcatgctaattaagtctaaagtagatattcctaaacaaagagtaggcggcaggtgtttggtgttggtgtgccagggacccctgtaccatgccactttccacttctccaaagcttccttctccagtgcagactccaccagggatgagggagagggaaggaacttctgtttctcaacagcatcattatttgcttgattttattgatggagttatgatgacacagagcttcatgatgaaaaattcaacacttgataaaagaatgctttctgaattctaggtaactccatatctgtggtacataaacattacctagctctaagatgtgtatcaacagactggatccttgggaaaactaatgtccttagctcagactcaaatagacactgtatctggggttaatgggaagtaaaccacagagggctcttctaaaatcattcttcagaatggggtttgtttctggttattcagttggaataatggagctctgtacatatagctctaacattacataaaagtgccaagggccagactcctataaggatgggaagtcaggggtgcactctctttttttcacatatgcgcacacatgcaggcatacacacacacacatgcacacacacacatactgtgtgtggcatgatactagttcttaaaaggcctaggatggagatcagggcagtacctctgaagctccaatggctttagtagacttagctggctggaaatgctgatgacataatcagaagcatagtactctgtaccactgaattagtctctacaaaaataggtactactgcctactcactatgtttcttcagaaaacacactttgggaaaactcacagagtgaaaacaactcatccagacgacatcacacatcagattccacccccttcagttaaaagctctcagagaaccaaatcatatcccaaatacacactaaaatgaactctactgtattaaccttagtcttcggtgtttttatttggccttataaacctcaattatgaggttactatttccaactttcacctaaggtcataaaaatttggtgtctccttctgtgctcacccagttcactgtctcatcagaaaaggataacaattgtcagggttggaaactaaccccatctggctctaactttgtcgaattcccattcttatctttttcttgtagccaacttaaaaatatagaatctgagaaatgcagaatgacccaccaaaggtgtaagaatctttaaagtacttcagaaattggatttgactgaatttcctttgacatttcctttttatgttatgagacccaatggcaatacaaggcaactgtgataacttgacaaaaatattcttactttcttactaacatgaggccaatctgttgactgagaaaaattccatggtgatccttcttacaacagttgctatgagggtatttaacacaagtggctcaatattctgtagtcttttaagagtactcaagtcgtgtcagctcaaactctatagacactatatccggttaacgggaagtaaaccacagaacaagttcaaagcaaggcatgtcgacagacctacaaaaaccatgaatagagtccatcatatatgtatttgaccaggaggttttgtaagtatatgagtaatgtgcacataaggactttgagttccctatcagaaatgcaatactaactcttttttttatataatgacacaaatttctcagccacagtttagccaaccaataacaattaaaagtcctctaatcctctgaaaaatttaaaatactgaagattctggcaatacagggtaggtccaattcaatgtctgaaactttggtggcattcaagaaagtaaaattttttctttgagttactgtttgctaagatgacagtgggaactgcttggacctttgcccatgtgcgcatgcaatttctacattaatattcaactcctcttgttttaagcactctttctagacaatcttggctatcagaaggagatctcaaacccaggtatcacctcaatctctgctccctatttgtaaaatggcttctgaatatttccacctggatgtgtttttgttcatttgctcattaattcattcattcttctattcatttggtgaataaaaatattaagtgctatcagagaaagaaggtcaagaaagttcatttctctcacctcaaggagaagatggcaataagccagtgttttcaatactttgtgccatgtgctatgagacaggcaagcccagtgtactaaggggtcccagaaactggacatatcagatgtggatgtcaaagatgccccctggaggaagcgcatttgacctgagtggcagaagggaggaagagcattccaggcagagggatggcatgttagaagtcccagaggcatacagccacatcctgttcaggaaagtgcaatctgtcccaggaggtcagagcaaggagcaaggaggagattacgaagaaagggctttgggtgccataaggaaactaaactttatcttaaatattataggcaattacttgaaggattttaaccagaagaagagcataattagattttaactaagcatgtccaaaaccttacacctaaatctctgccaatggcagagcaatcttcacaaactcagcctctttctcaactgttctcatacctcacatctcattaactggccgacaaatctttttaattctaggtcccaaataactgctgaattgagcccctttttcacattctcttctccttctgtcattggaaaaacccacatcatgactttcctggacaaaagtgcaagagccttcagtggcaaacattgtgggccagctctccaaaaaccatcaaccaaatcctctccctttctcatctccaactatagaggctggaagctcacctcaacagtctctcttacaatgaggagtagtcacatgacttggtttcagtcaacacaatataagaaggctaatggagaccttctttggaagattttctttaacagtaaaagcagatgagacagcatttggagaagacaatttttttttctagattttacccaagcagccaccttgcctcccatctttgaatttggtaataatgtctggagctctggcaaccatcctgtgactatgagatgacaaacatatggagaagtcaatctgctggggatactggaaagaaaggacagaaaggcctagatcaccctaagctgctgaacccaccctggaactactcactctcagaccccttgttgtgagataactaaatatcctcatggtttaagccatcgttagtctggctttttgcacctgaacatatcctaactgatacatgtcctaaactgagtatctgggtccagtctttccccagcatgctccctcacctgccattttaataatccttctacctcccagatctgatcatataatttctagtctgaaaaatctctgaggataagtctttgaccaagctccccacccaccaaggctccttcatctcttgccacatcaaacaccttgatagttcctagacacactatactccttcatgtctctatcctctgcatgtgctatgcctctgcattaactgctcttacccttcctgcttaactctgcaccaaaagatccctaaggcacagttagtcacattttccccagtgcttatatagctgtgatagactatataactattcactcatattctctcggaggaggaatgcatccacatcctgctacacctgactttctttgaccaatgaaatctgagtagaagtaacatgtgttactttgggacagaagttttaagagccacggcatggtttcccatgttctgtctttcctgcctctgggatgtagaagcaagtacagaggaagctcccttattgacacataatggacatgtagcattagcaggataggagtcttgttaagtcagaggcagacaaaattttctgtaaagaccagatagtaaacattttaggctttgcctaaatggaacaaatatggtctttgtcatgtattcttcctttttcaacaagcatttaaaaatataaaaaccagtcttaactcacaggacatataataataggtcacaacttgatttgtcccacaggctgtattttgccactgttttaggctgtattttgccactgttttaagctgttgagaatttcaggttacttattacatgttacagtattttgcatatacattctagccttcatcactctgtaacagaattataagcttcattaagacaggggttatgtccttcatgcttgctgtgctcacttgtaggatgtgtcagctaggaaggtaattgctgagtgaataacagacgttttccccataggactgtgagctcagggagcagaaaccatggcttttcatcttatatctatcccagcaatgcctgacctgtgataacatttgaagagccttggagcctttgataaactttacactgaatcaggttttttcttgttgttatcatcagagcaggtgccaaatatcacttgagaaacagaaattcacatagcctgtttgtttgcaagatgaacatgtgaccttctgtgtcatgtactaaagtccatgcctgaaatctattaactataattaaatgagttttgttttttcttttccttttttatttgaaagcagaggaggcaagcggacatggaaggtttacattaaaataagggtttttgaaaaggtcaagaaatctggaatggtgggttcaagggtaagttcagttttaccaaattccctcaagagtcattttgtaatgtgatggcacaatatggaccttatttggcaagtgacagtatttagggcaaatgttgactgtgtctcaccccatgtaccactgaatcggggtctgtttccttggatggtttcaaaggctgcaaataaatggagaacaagacctgaacatgtgtcatggcacatgccatcaaaagatagtctttcaaatggaaatatatttagacttaaaaatatatagcatttgcaaaaccaagcatagcagaatatgtgagtactttctattctgcttcctcatcaaagcaaactcctgccagcatgcttactataaataagtgcaaaccaacctcaatcttaaaacatttaattcacctatattgagaaaaatgagaagatgaaaattttagttttctgaaagcttttttttctgatcacattttcagtacactttgtctcatgcatcttaaacatcatttggcaattctgtgtttcttttctggaagtaaataaaccttctagcgcaagcaaagagaaaaataaaacataacaaggctgcccctctgtggtgacatgctttcacacccacagcagccagcccattctcacaggctctactaattgcagctgcattccacttcctaaaatatggaaattttatacacttacttttaaattaatgctgcagggttttaatttaaccataatccctcttaaagataagagactaatggacatatttacattatatcaatagagatagacactgaaaaatatttcagcactattatatttaaagtattttttaaagaatgacatcaaatctctgtggattatcttttcagtcataaaatcattttatagtcactgaaaataatgggagtacatgaatgccctaaccacacaattgctttagtgaagagaaactagactaggctaggatcccattctgagctcactagcttctgtgtctgaaggctgctagcctcaccagtatgccaccaacctgtgctgcttctttatttgacactaggaaaatactgcttcacttaaagctaaacggccttaaaatctggaagtaggccgagcgcggtggctcacgcctgtaatcccagcactttgggaggccgaggcgggcggatcatgaggtcaacagatcgagaccatcctggccaacatggtgaaaccccgtctctcctaaaatacaaaaattggctgggtgttgtgggttaaaaggtgaattgaccatatgtttttatctcctctaaatctcaaaccccctaaaatggaaaaaaaaaaaaaaaaaaaaaaaagctgggagaggggatattctttggaatgttactaacccacaggaacaatgagaatgggcttggcaacaacagaggatgagatattccaataaatgtgtggcagatggaaagcaggtagaagatggtgtcagactcagcagagcaaaaatgctacccatgcatctgaggaggaaggcttaagggagcccatttaaccctgcagagcccagggtgccatccaagggagaagagaagcagaaagctcaatacatagaattgagatcaagttcccaggtgccctcccacatacacacagccagtaaatcaagcaccctctgccactaacagaaaatattcatttttcaaagaaataaaccagcaaggaaccaagcacggtagaattcgacgaaaatttataaactgaatgtggttccttgagccccgtttgttgacgctgctcagaatgacagcaaacaggcgcacatacccccaggcaagatacttgaagagtattctctagaaaaaacaaagtttagatactgattttggagtcttcaaaggaaaatttccattttattataatgaagggcaccagatgacagcctcaactggaactcgcagtgcttctgacagcctttttcatgccttcctcaaaattattagagaccagcccagggtcacaagacagttgagaaaagcccccagccagaaagacagataatactaagcaggaataaaacatgtatatatgctactgtttagttatatatgttttatatgtgtgtgtgtatatgtgtgtgtatatgtacatatggtgtgtgtgtgtgtgtgtgtgtgtgtatatgtatatgcatatatatatataccttcagaagatgcagaaacaattcaggatgctaaagaaaaaaaagtctatattaccctgagaaagaataaaaacagggttccataaaaataaaacacaaaataagacaaaaatttttgaaattaaaatatgataatataaatttaatattcaatggaatggaaaagaaagttgaagaaataattataacaaagagacaaacattaaaaactaagataattactttttaaattaggagatcattttgtacatatggtatctaagactaaaaagattctaaaaatgaaaacagagagagcagaggggagaaaagtagtgaagaaataatgcaggaaaacttcccaggacttaaattttaagtctccagattgaagagcacacgtggctacagacacattgaattttaaagacccatccaaagcagtggataaagggaacattctgaaattttccagagtgataaaatacctcatgtatcaagaaataggcctcagaagaacactggatttcctgacagcaaaactagataccagaagactagagaaatgcctttaaaacttgagagaataagaactttcatctgagaatacatacaccaagccaaataccagtccaataagagggtcccataaaaatatttgtagcaagcgaacatccaaaaaacataacgcccaaagcactctttattagaaaagtaccagaagacttacttcagcagagcagggaagtttacaaagaaaaagacacagaacataagaaatggagtctacaatcggaagaccaacaaacaatagttccatgataatggctgtgcagcaggcctaaagtgaaacccagagtacactgcaacaagcagctgcaggaatgaggagtccaggaaaacaaaagtgggagtacttatcatgtttgaccatgtggaaaatagtactgagagggttttataattcttctggaagatttggagaaaagtaaataataggtacaaagaaaactgggaacacaaacaaaaaagaaggcaatcattaactctgagaaaaacaaaactacctatgagaaaggataggtaatcaacatcgaacaataattacacagcagcaataatgtaaacattgaatattgacttaacataaaattctgctgtaactgtactggcaggatagtagatggggaagaagaagaaagaaaactaaattctcacccattacaatagaaaatcaaataccataagaaaaagaataaaaagtggagacgtggccattttgtgggaacagaactaaagtttcaaagggatggggcataaaactgtttttctctataagctttttattttataaactattttgatgcgtgataatgattaaagaaagtaaatataagtttagaaaaaaataaaccaggctactgcaataaaagattaagcttagtacatttaaatgtaatgaaaggaaatgattacagctaatcttcataggaaaataaaatgcagagttggctattactcagaaaatatggcctgaacagccatttaaggaggattaaacatatttgttctgttgtatatatacataaatgtgttatatatatatatatatatatacataactgtgttatatatatatacataactgtgttatatatatatacataactgtgttatatatatatacataactgtgttatatatatacataactgtgttatatatatacataactgtgttatatatatacataactgtgttatatatatatacataactgtgttatatatatacataactgtgttatatatatatactatttgttataaaattaaaacacacaatttataataatccttattaacttataaattgacattccagcaaataaataaattataaaaaattttcaggaaatataagttcaatttataaaaagagaaaacataaaaagcctaaggtaaacaaagttataattaatttcaaatgattaagcaaatgtgtgtccaagataaagattcacagttattttctctttttttatttcacaatgcattggcttcgaaatatttccaagtagctttgtattgaaggttatctagagtttctgttgtaggttgttttttatttttcaacaaatatattaatatgatgttctacttacgaaaatttggacagtaaatcttatcatcattcctgaacacatgttgttatagcaaatgtgtacatttggaattgccttcatgggtactgaaattctaaaaccaagggactcagctttagatgctgtcatatgttgtcatatgacatcaatgatgtctccacatcaataacattgatggcagtagtctccagcactgagtttctaaggcaacccaatgggagtaggggcagcaaaaatattaagacctctatttttatttttaaatgtattcctttatgttttatttctgtagattttgttatttactacagaatctttgttcagtaatatatatgtatagaatttatacataagcctatgtatattggcagtgtattctcaaaaaatttttattgctgggatgttacggtgaaaaacatttggagactgctggtttaggaaggtgtctccctaattgtagttagtgaaccattaaagtccatgagggtaacacaagtgttcatgaggcaggcaggagaaagctaatatgtcatcctaagctaaaaacttaattttaagttatgagtaagaattcaacaactgggaggagaaagtaagccttctcatttgcgaaattttatccaacatcaggcctacctgctacagatgaagtaaattgtgataaaaactctatgttgaaatatacaaatggctagaggatttatagccctccatatgtacatttgtcactcataaggcacagactatggtaaaatggttcaaaacaatgtgctcatgtgttggtcataaaagcttttgttgatgaggcagtgttctacagtaagaaaaaacctgaaaaccattgattttggaattaaatacttaagtattctaagagtacttcattccctcatatgggcaaaatatagctcagtcatttagaactatactagtcactgtccaacatggtagccacttatcacatagggatgtctaaattaaaatttagtaaaatttggccgggcattggggctcacacctgcaatcccagcactttgggaggacgaggagggtggatcacacaaggccaggagtttgagaccagcctggccaacatggtgaaaccctgtctctactaaaaatacaaaattaggtgggcatggtggcgggtgcccataatcccagctattcaggatgctgaggtgcaagaatcacttgaaacccgggaggtggaggttgcagtgagctgagatcgtaccactgcactccagcctgggtgacagagcaagactctgtctcgaagaaaaaaaaattaattaaaatttaagatgtatttcctcagtcacactaatcacatttcaagtgctcaatagccacatgtggctagtggctactgtattggacagcatagacaaagaacattcccatgagtgccaaaagttctactggacactactactctaggatagtattcaggaattcttcagttaaaagtttaaaaatctttatacttactaacggttactttgtccttatcccccaacataatgttgtttggtgtcagatctctatggacaatcctcttctccttgtgtaagtatcgaagagctaagcacagcttgaaacaatgaatagaaaacaaattttatttcccccaacatacatatagccaaagatgactactgcacgtctttaagaagccagctcagaacattactgttttaagaaaaatttaatgaagataaaagcatacctgtataaatattttccatagtctttcttcagtaaaatggtgatgtttttccttcaaagaactgaaatgctctccaagcggggctccttctatcagctccataactatgtacaacctatcatctatataaatatcacaaaaggtcacagaaatttaaactcaatacaggcatcttgaaaaactttacgaatgagagttcaagcttcccagtgtctgtgcgggacactaacactaaagaattagggatgatgtgctaaaatatggatccactcagccctggaagaggtggaggtgagggggtcttagggaaactggggcccagccacagttatcttctggctacagacaaccccttagcataagtttacactggcaaatgtatcattttctatgtatgccaggatgtggaatgattgaaaggtgccacagagaacaagtaaatgatctccagtcatggaggattccctgaagaaaccgtaagcccatccttcctcccagtagtctaaaatttacgctcaaatcaagtcagacattcagaaaattgcattttcaactgtattgtttcatagtctgatagatttaccttacagaattttacactggaataatgccatggtcttgcaatgacacagttgaaaataacacacatgatagaaatttctgttatgtctttcaaaagcaaaaaaaaaaaaacaaacaaacaaacaaaaaaaaacaaaactggacttctccaggttttatcttacagatacagagaacttcatgactgattgtgtttgtctttttgctttggatgccaaaaaacaaaggagcaaattctacttcctcctctaaaaccaatagggtttattaacaatgggatgtgatatgtgtcttttgaaaccttgggatgtatacaaaatatgtgtgtagaaaatgttgacaaaaatggaatcatgttctgtaatttatgctttttttcattaagcagccttatatttcagtacacacagatccataccattctttctgctggttgtatggtattgcacaatatgggtataccataatttatttaatcattttcctacagatagacatttatattgtttccaatttttcataatttcaagaaatattcatttatgtaccaatactacctctagctttatttttaattttctcatccttcattcctctttattgcaatttcctaatctattttatcatattttatgtatttttaagccatttccaattcttttttttttttttttttttttttgagatggagtctcactctgttgcccaggctggactgcagtggcgcgatcttggctcactgcacgctctgcctctggggttcacgccattctcctgcctcagtctcccaagtagctgggactacaggcgcccgccacgacgcccggctaatttttttgtatttttagtagagacggggtttcaccgtgttagccaggatggtctcgatttcctgacctcgtgatcggcccatctcagcctcccaaagtggtgggattacaagtgtgagccaccgcgcccagcctttttttttctttctgaggcagagtcttgctctgtggcaaagctgaagtgcagtggcgcgatcttggctcagtgcaacctctgcctccagggttcaagcaattctcctgcctcagcttcccaagtaggtgggattacaggcgcctgccaccacgcccagctttttttttttttttttttttttaagtagagacagggtttcaccatgttggccaggctggtttcgagcccctgacctcaagtgattcgccagcctcggcctcccaaaatgctaggatcataggcgtgagccaccgtgcccggccgccatttccagttctttttggaagctgtcaggtagtaaaaaacgtttttgttttttatattaagacaatttatatcatttcagtacaagtctgaagccaaccttgatttttttgaagggatatacactaaattatagaaaattattttaatatcaagaacaaatggctaaggggacaggatttactgcatgagttttagcactgagtttttctgagtcatctaggggaagggagatgggtaaaattgtaacaaatggcaaaatacacacacaaaaggttttcttaaataacaatagcactgaaaaagaggtagtccggaagccccagtcattgccttatgtctctttaaatcattcttcaagtggagatttatttcgacatttcatatgtgacacatatcattaaagcttagcaatacttgtattatttctgtcataggccctacttaaaaaaaaaaaaaaaaaaagagtggctgagtttagctttatctgttttggttctagttcagcattccatcatacctgcagaaagcaagcctggctgccagaatcagtctgggctccatcgccacctttgtggcatttacctgaacttcaggtaaaagaaatctcaaagacctagctctctccaacttattttggggatggaaaatgacacctgagtcaacaaaaacaactttcttttcttaaggaaaccaccatccattagttttctttttccttgatcctattaagtgatttttttgtatatgagaatagcaataactattttggtttgttcatgcgtttttcacacaggcagctaagtattttataactatcttcaggtgactgactaggtcactgtttcactagtcaagaaagtgatgcttaagaccatctactgtcatattaacaaaaaaaggtcaataaaatagttgattaggtttcttttgtgacattctgatacaaaaatatatgtgacaaaaatgtttccttatttagaaatatcatgaaaactcatacttactttccagaaatgttttgtaataacgtacaatgttgggatgataaagctataagaaaataaataacaaacatgtattgcactgcttcaaaatacaagttttttcactgactacttagttggacttcatatttgaaaactacaaagaaattatatttatttacaaaactaagcatttcaagatatcatcgaactgagattgttgtgatttttaaaaacttgttgcttataaactgatctgaaaatagcaatcctctatagctttattaaataaaattaaaaacgttctatcacctaactttactatcgaacttaaccaagagaactatagaggtagaaggaaccttaagaattcctttagcacaccttgtcacaacccgacacacagactgtataaaggagaaaagtgaaatgcggtaacttctgttgactacaaatattcattgttctttacctctctctaccatctaaatatttatggaaagtttgtgcctatttacactatttctgtctttctatgctctccaaaatgattagtagaaaataacataatctaagagtcgactcagtttaagtcataataacagttgacaaggacttcctacttaaccaagctttagtcaggctcctctgagtcctcttcgtgactaggcctcatccttggtctgtcagttttagcaacttatatcctgctaagtcagtttatggaaaaatttcccacccttgacatccaattaagtttctcatccactcacccttgatatctaaccaagttcctcttagtaaacttccatccactgaccctccctcaccctgaccattggctctgagtccccagctgtccagtcctcgaattcagagttgggttcaatctctctcctctattacaatagtttgacttctattgcaatagtattgaataaagtcttcctcaccgtttttaaaaaatggtgcaatttctctttgatataagttaagaatgttagtggaatttctaattttttaattaaaaaagatcattttctagaagaatgctaataattttgtagtttttgcttataatttgagtttctagataaaatttgtcttagaacagtcaccatcacatcaacaaatggcttgcttgcatctctttttggtctttctgcacgtctttttgaagggagattgctagctgtccaccaaaaacctgctgtcccattgcaatacagttgaagctggacatggcttcccagttagagaagatttctcagcctcccttgaagctgggggtgaggctaccactcagttctgacctgtggaatatgagaggaagcatgtgtgcttcctgtgtgaactctaaaccttgggaatagccctccatgatcctcctcatctcaccttggatgtgagcatggctatggcagtttcaaccacacagatgaagacagtgcactagaaggtaacagcacaagaagagagaaaaaagcctgcatccccaaatgatcgcatggagcagagaacaccttcaacctggtttactcactttgggattgttccgtgaaagagaaataacccactgtactgtgagtcctctttctaagcacctgcatttgggatcctctttgttaatgcaggttaatcttaatgtactctccattctagccccatttgttttgcttctgcctgccactacctcctcctttaaggactcaatgttatcatcctttccatcagtttgatcctctagtgagagggcaattttgagttacctcaaagcccaagcatatgcttcctatctgaccctagtttgacagtttcttttcttaggaaatgtgctaaaacaaataatctactgcatcaactagcaagtggccagcagatcgtaagcaatatgtgaccaggtaaccaaccagaaccatattctggacctggctcacccacaaggactaaaaccaaatttgggtccagatgaaaacactggactggcttaggtcaaaagccctgttctagccttgtgctacaatgaaagagcacactgtggaaggctagatgaccatacaaacacatgaacaaactacacatgaacaaactttttaaagtctagtctattagtatataaaatcaactataaaataaacaattaatgataatatttactataatgtacacactggagtagaactatcgatttttatgaacaaaggtctccttgtttatggaatttgttacatcccaacacagatgctatgcaaatgtgaccagtggaggacaaaagcagcaaagctgatagtgcaccacaggaattataaatgaacagtattcgtgatgaatgtgcaaataaggaaggctgaaaaagaaaccaatgtgttcttggatcacacaaagaaattccatttctctttgaaatgtttattcttcctcctcaaacaaactttcataatgagagttaattgagctgttacattatatcagagtattctgctcatgccaatacataataacccaacttgaaaatctacattttagatctaataaagtcatatttgaggaatgttaacagcttggttccatttggcaaaagtcaagaaactcttagtcatatttctatgtatgtaactaagtaaccaaatatcctaaaatataaggagaaaagaatagatatgctcacaatgaaaagaaaaggatttctcatatatgatgcattctgtactgtaaatccgattgttttgcatccatgaccctgatataaactccagacagtgttttatgcttcaatgtcaagccttaggaaaaaagctggcaaaaatatcactgcttcagtgtcaattatttcacatggaactagttcataagcagcatggacaagagcaccacaactctactttcttgcaatgacatgtatttaagaaaaacatcttcagaaacaaggaaaacatttacctgctctttaattattgttaattcagaaacaatattccttacgctgctgtctcgatctttcttatcctttccaaatgctgggttatgtaaattgacctctttcattgctaaaagattttgaccactatgctttctaacctaaaataaagaaaaacacaacaacaacaaaaggaacagggtaaagaaggagaagagagaaagaggaagaaagagatagactaacaaagtcacatgagtaactaagtcatataaataagtcacagagcatttaaagttccagctgtatttacattaagctcagctcaaaacatcaaaacactggtatcccctgggtcagtctgcaatacttagtagcattttttaatttagagattgcatcatgcattgggagaaactattttgaatacctttgtgagagattaataatgccttttgtcttaaaaagtcagtggccaatttctagagcttacagctaaaacaatattagtgtggctatctctgttggacaaaaacaatcattctaattttcatatctgtttgctatttttcaatgacaagagttctaattcaattgaatatcggtgtgcaagtgtgacatccggtttggttgggagtatcagaaatgttccccaaggggaaagtcaccttgtaaacacagccaaaagctccacttccaagatgatccaaaattgcatagttgcctatatatttcaaaggagctttgttctgattaatgctttcaatattttcagcaatttgcttcagttcatcctcctaatcaaaatataaaaaggaaatgggtttctgtgataaattacatcctgactacatagcagcctgccaaaatattgaaaactcaggacttaccactaataaattcagcttggataccaattcttcataagcactgatatcacgtacataatgccctatgtcaatgaagatctcaaacaagtctgtggggaaaagtctacagagaatattacacacacttaaagtagaacttggacacagttgatcattacttcccttttttatttttttgagacagagtctcactgtgtcacccaggctggagtgcagtggcacgatctcagctcactgcaagctctgcctcccacgttcacgccattctcctgcctcagcctcccaagtagctgggactacaggtgcctgccaccatgcccggctaattttttgtatttttagtagagacggggtttcaccatgttagccaggatggtctcgatctcctgacctcgtgatccgcccgtcttggcctcccaaagtgctgggattacaggtgtgagccaccgcacccggcccattacttcccttttgaatgcagctcactcactgattaattacatgaaacaaatttaacttcttttggttatcaacaaagttggggaaataatattccccaacttatctcgaaaaaatacactatttacagtttttgagaggtaagaaaaaaacaaatggagaagaaagttctagagatctgctgtacaaccttgtgcttacagttaataacactgtacacttaaaattttaagaaggtagatggcatgttaatatttttaccataatttaaaattagatatgatacagattatacaaaaatcttacttgtaagatatttgggggtataggcattgaatacattagaaggaaacatttattgggtgtttttttgggtgtggagcactttcacaaatgtcatttaactcagattttagtaagaagtaaatactaacccaacttttaaataaaagtttcatgaaaataaaaatactggtacatgaaaaataaaacaaataaagagattcattcatcattcccaagacactggtttcaaggggttttaaaatctttgagttcactaaaagggatgatttagagctctgaaatgaaagattataaagaataagtagctgggtgtggtggctcacgcctgtaatcccaacactttgggaggccaaggcgggtggataacctgaggtcaggagttcaagaccagcctggccaacgtggtgaaaacccatctctactgaaaatacaaaaattagccaggtgtggtggtgcatgcctgtagtcccagctactcaggaggctgaggcaggagaagcaacaggatgagcctttgtcaaaaaaaaaaaaaaaaaagagaactaattttacttcattttcctctaaatccaaacagtatagaaataaagtaacaacataaaatgctccatgctttctgcacttgatctcagccaaaaggccgaaaagtgacgctccatgctttctgaacaaaaaatactatattaactcaatactttatgtctattctgccttattaacaaaattttaataaaaacttgggcctatgattttggctaacccacctaactaaatggtgtgcagaacaccactgagggaaccagtgtttgcttcccgaaatggtgaccttttggtcaggctcaccaacacagtatcttgaccccagaacatccagcctccccttcaaatgagctcctacaccatcaaagacacacaaaaaaacagtttgttttccctttgattaaattccctttgattaaagtgaaattacccgattgactttcaaatttctagctggaaaaaaagaagctcatattttaatgccatcttttaaaaatgttaatatctttaattatcaaaaagaaagctaaaatcacagcagtcacatgtaattaaggggagttgtattgatatagcaatttatgctctttcatcatcattctgttaatattcagtgtggctggatactgaatcactacagtagctcacttctatctgtgaaataagaaatctgaagacacatggtttgcatactgacgcattattttccttctgttgcatctaagccaagtatgtgaaaacagttcaatctaatgatctcctaaacctaatgatcacttatatttctctaacctcataccttttaaagagtggtctgtttctttccatactgaagagaaatctcaaggctctgaaagcataacactagaaaacaaaaggatatgtgattctcaaatggtagctcaacaaattaaaacattttcaggaaagaattaacaggaagtaaacattaacgtgactttattgtaagtggctggtccaagttggagccaaagcttctaactgaaaacaaaaaacaccaacacctggggtcattcctgtatttaaaaagtgtttatgttgtagaatgcagggaatattggccttgcttcacttggtactcgtcattaatttctttctagaaagtacaaaatgagtacagagacaagaaataaaattccgatgctgagaaaaccaaatgtctaaagatttccaggagctcaaggtttattttgtttctagcctgctatgtatacctcaatatttatatggtttctgtgagaaaataaacactagaaatgatgacatataaaaatagccgcaggcacactggattcaaacttgacaaattggtctcttgagtaaagagtcttaagcattccccaaatagaacaatctacactaactccctagaacgctcagaaagaggcctgtgagcctttacctaggaaaaataaacatctgacattttgcagtactgagaaaaaagagtgtgcccagcctgcagctgtgcctgcacaataggccaccattggagtgatcagggtttggtgaatcaaatctgggatcatttcctaaaatcagtgatctgaacacagaagggtcccatacaaaattgcccagagaggtgaggccggtaacaaaatgacatgaaggagccaggtgagagcagtggagactgtgagaaagggagagcatgcatattcctcaaaagccctccatctggaattctaaaaaaccctctactggcttaacgaaatgtctctgcaggatgggtttgtctttatctgtttaacagcacagtgtcatatatctgtgatgcactgaagaaatcaagtcccatgcctgcaccttcccgttggtagcgctccaaaaacccctgcctgccagcacagagacaccccgaaagagtctgctgggtttggccatcattttggatgataactcttaaatcagattggagacaaaggttgtttctttcttccttttcaaaatgacttgggggaaaaaaaaagatgagctacaactattgcaaagactaactttaaatcagattttgacattagggccactgccccccgcccccactctgccaatacccactcctcaaaaacgaacatagaaccctgcgtaactgttcccctttcttacatgtgagccctcaactcctggagcactgcctccccaaaccacacaccccagttccactgagcagctcaccctttactcagctctcccaacacccactcctcaaaaatgaatgtagaacctggctaactgttcccctttcttacatgtgaggcctcatctgctggagcactggcccccacaaccacacaccccaaccccactgagcagctcacacttccctcagcacactctaagctcacagctttcacacttggtgcatgctgttccctctgcatggaatgcccttccaccctgcagcagatgccattggtgccccacccaatatccccttatccacttggcaagtcccttctcatccatcaagatccatgatggcaaataattttccccctgttgttatattctgatacataaggaatgcatatttttttaaaaaaatagaacttattgataagcaaagaaacacctaaataaatcacctaattctcccacacagagaaaccactgttaagccttctgtattgttttaatattatttgattccatgccagtcttccttgccagatatttttccctcatagtcagtacagggaccagtactaacctaaacattctaaaaatcatagatcattttaccatagttacccaagatttcaataacttgatactgaaggacaagagacatgtttattacctgtaatagattactttttgctgcattcttttgcttatttggtaaaattaattttgctattgtatatacaccattttcctgaaagaataaaggggtcatactatgagtgacaacactgtagtgatacacaagcaaaaagaggcaaataaacaatctcaaacattaatatcaaagaagaaatattagtataactatggaccttgaagtaaacattacaggacaatatttaaaatgtcaacataacacttttaaacaccaaagagtacaactacaattttaaaatttcaactgtctgtggagaatcaagattataataaagtacataaacgtaaagtgattcaaataccttaaaaacaatgagagattaaaaagggacagagtaaaggtgtcccaatatcttagatttatatctttgatatttatttatatccttaattaccacaaccataaagggagaaattatattccagttattaatttatgtctttattataatcttgacatctttctagattttttaattgaaatatacacatgaaggaatgaacaaataataataccttacagccacttttctattatctagtaaatatataatgtactgatctttactgtgtgcaggcattcatattataactgcaaagagctttatttgccttattgcatctaatctctgtaacaactctgtgaaattagtctataatttccttgttttatacatgagaaaaccaatacttagagtggatacattatttttttagaagccaagccaagaagtaataattccaggaattgaacctcaatctggccaacttcagatgccctgttctatcaactaccccctgatctgctgagtttctcttatgtcctaatttaatcattgatgagctgatcccttactaacatgtacggatcttgaagttggatattgtaatgacacaaccaaaaatgttttctctgtaaaattcactaagtaggaggtaacttttgtgatagaaacccatacaagggttgtacatatacatgtgtatgtttattaatatagatctattaatttatatttatgtgtatatatacatacacacacaaacatgtatatatagctgtacatatagtagattaattagtggattatactttgcaaaatcagtttcttggcaataaatattttgtttgctgtgtctcaatcatcatttttaacttaataatctgatgcatagtcttaatcaaaatgattgctgtccttaccttatggtattctatacacccagaattaatgcaattcagagtatcccttttagaaagaaaaaataaaagggaccgcacataacataatgaagaaacatcaattaaccacatgtcagtcctttttaagtcaaatgagttaaaggaggaaggagaagaatataaagtggaactttattagttaaacgagaaatgttaaaatagttttaaaatcacatgatgggaatcccaaaacctatgttctgggatacagactgcaccacaaggtgagttgattatgaatggttatggagacctgaccttgagaaggagtgctctcacctgaaccacctggtgggcattggtgtcattgagcaccagctcagtgagggcagcacagcaggctggaatgacaacaatcaaatgcatagtgtgcatcattacaataaatatactatcacataaatactcttactccacagggtatttttattattttgctatttttattagcaaagtaacttctcaagaaacactaattttccttttggcacagctctggaagaaaagaagttgacttgtaatggcttctaattctcctccccatgtaattcatgtgcgtgtctattccactgcaaccatttattgagcactttcttcgtaccaggaggcaagtattgcatctgtccatttcattgtaatccccagtgcccaaaacatgcctggcacttagcaggtgctcaacaaatatatctataatggttgataaataaaagaatgctttaaatatattattcaactcaatccttataataagagtatgcactgtgattaccactgttactggtgagaaaacagtttcaaagagttactagactaggccacacaaccagtaagtggaaatgaccaggagtgcagccccagtctgccagacgttaaatccccagccctaagcagcaccactcttgcctcctgacagccactgtggcagcctttggtggtattttgcactgagatacttgtgctctcagaagtatgccagactctatagcacagagctcctataaaggataattccattttactgtgctgaagattttacatatattcccacataattctcacaatgatcttctatcattgataccatgattatcatcaccattttacataagcaaaactggagcttggagaaattaaggaactttcccaaggccatatagccatcaatgagggtggagccaaaactcagaccctactcttaaccgtttatgtttttaatttttatttttccatttttatttaggtattaacatggtttggctgtgtccccacccaaatctcatcatgaattgtaatccccacaattcccacatgtcataggaggaacccggtgtgaagtgattgaattatgggggtgggtctttcctgcactgttcttgtgatagtgaatgagtctcacaagatctgatggttttaaaaatgggagtttccttgcacaagccctctctttgcctgctgccatccacttaagatatgacttgctcctccttgccttccgccatgattgtgaggcctccccagccatgtggaactgtaagtccattaaacccctttcttttggaaattgcccagtctcaggtatgtctttatcagcagcatgaaaatggactaatagagtaaattggtaccagtagagtcgggctttgctgaaaagataacagaaattgtgaaagtgactttggaactgggtaacaagcagagcttggaacaatttggagggctcacaagaagacaggaaaatgtgggaaagtttggaactccctagaggcttgttgaatggctttgaccaaatgctgataatgatatggacaatgaaatccaggccgaggtggtctcagatggagatgaggaaattgttggtaactggagccaaggtgactcttgctatgttttagcaaagagattggtggcattttgcccctgccctagagatctgtggaactttgaacttgagagaaatgatttagggtacctggcagaagaaatttctaagcagcaaagcattcaaggggtgacttgaatgctattaaaggcattgagttttaaaagaggaacacagcataaaagtttggaaaatttgccatctgacaatgcaatagaaaagaaaatctaattttctgaaaagaaattcaagcctgctgcagaaatttgcataagtaatgaggagccaaatgttaacccccaaaacaatggagaaaatttctccagggtgtgtcagagacctttgtggcagtccctcccatcacaggcctggaggtttcagagggaaaaacggtttcatggactggacccagggtccctctgctgtgcgcagtctagggacttggtgccctgcatcccagccacttcagtcatgactaaaaggggccaaggtacagcttaggctgttgcttcagagggtggaagccccaagccttggcagcttccatgtggtgttgagtctgcttgtacacaaaagtcaagaattagggtttgggaacctctgcctagatttcagaggatgtatggaaatgcctggatgcccaggcagaagtttgctgcaggggcggggctctcatggagaacatctgctagggcagttcagaagggaaatgtggggtcagagcccccacacagagtccctgctggggtactgcctagtggagctgtaagaagcaggccactgtcctccagtagaatggcagatccactgacaagtgtgcacagtgtacctggaaaagccaaagaaactcaacatcaacccatgaaagcagccgagagggaagctgtacctcacatagccacaggggcggagctgcccaagatcatgggaacccacttatagcatcagcgtgacccagatgcaagacatggagtcaaaggagatcattttggagctttaagatttgactgccctgctggattctggacttgcttggggcctgtagcccccctttgttttggccaatttctcccatttggaacagctgtatttatccaatgtctgtaccccattgtatctaggaagtaactgacttgcttttgattttacaggctcacaggcaaaagggacttgccttgtctcagatgagatgttggactgtggacttctgagttaatgctgaaatgagttaagactttgggggactgttgggaaggcatgactggttttgaaatgtgaggacatacgatttgggaggggccgggagcaaaatgatatggtttgactgtgtccccacccaaatctcaatcttgaattgtaactcccacaattttcatgtgtcatgggaggaacccagtgagaggtgattgaattatgggggtgggtctttcctgtgctgttctcatgatagtgaatgagtctcacttgagatctgattgtttttaaaatgttttttttgtaaaaccattgaaagtgcatggagtttccctgcacaagccctctcttgcctgccatcatccacgtaagatgtgacttgcttctccttgccttccaccatgattgtgaggcttccccaaccatgtggaactgtaagtccattaaacctctttcttttgtaaattgccctgtcttgggtatgtctttagcagcagcgtgaaaatggactaatacgggtatagaataagctatgtaacgtaaacacatcttaagtgtaaggctcaatgagatactacatatctatgtgccctgtaaccatcctccacccagaggaatgtgtaggctatatttccagttctcaaaggctccttgtgccccttctcaggcactcactctcctataattccacatctaagtaactgttcttctgaattctatcaccgtcaatctcatccactctttgaatgattgctagaaacactcagagctctgagattccactggattagacttctggggagtcttcaaacagtaaacccccagcacaagaccttgtactgagacaggggcctttcagagtaagcagaaatggcactttgaggaggagctcctatgtccttgttttcacaccatctatgaagaaatatcttctgtattcttcaggagaaaatagtagacagcaaggaaagcctgccctctcccacttccccactccctcattccctctcctgcagtctgctctttcccctcagagtctccctgtctcctgctggcccataccacacctctctgctccctttctgtgggccgctctagggcacccaaattggccaatagcactcagaccgcactgtagctccagttgtcccaaaggccaggtgcccccaggcagggcacaaactgcatgactgctcaaggtggccctgccaaaaagcattgatgcattgctgctcctgcttgcatgtgaaaatcctagacagggcagcatctttcagtcttctctttggagctcaagaagcatggggaaggtactctcttgcacctggtgagacaagtgtgtgcactgtagattcccccttatgtagggtgccctgggatctagaaaattctagaaagcatgattctggccacagatcaagctgcatcccctaatccagctttcctcataataaagctaatgttttgtatccttatctctgacttctgtgtttatctcttgctaggttcagaacacag

SEQ ID NO: 328 - DNA, 136798 bp, Homo sapiens
attaaacattttttttcttcccagtcttgggtatgtctttgtcagcagcgtgaaaacagactaatacagtaaactggtaccagtagagtggggcgttgctgaaaaaatacaccaaaatgtggaagcaactttggtactgggtaacaggcagagaattgaacagtttggagggctcagaagaagacaggaaaatgtgggcaagtttggaacttcctagagacttgttgaatggctttcacaaaaatactgataatgatatggataatgaaatccaggctgaagtggtctcagatggagataaggaacttggaaactagagcaaaggtgattcttgttatgtttatcaggggtttccgcttttgcatccttctcattttcttttgccaccaccatataagaagtgcctttcacctcctgccatgattctgaggcttcccaagacatgtgaaactgtaagtccaattaaacctctttttcttcccagtctcaggtatgtctttatcagcagcgtgaaaacagactaatacagtagcattcttttttcttgtcatacaagcaagaaatatctgatttacctttatttttggactatcctattctatctaaacctgattatgctccttaggaagattccttaggggatttccaaagacttcttttctttctataaacatattgtcaacaaaaaacctatttcactggcctcctgtgcttaagcctctttcatttgcacttatttcaaatattattgctagttgttaaagtcctcaaatttaatttgaccattctgttataatgagatctcattgcctttaggagttctaatatgaatatcacttattcattgatggcatactatggattctgtggcttacacaaagaagtatacacaggggcttcaaaatggctgactagaggcatctggtagttgcctcctccacaaagaagaaccaaaatagtgagtagataaacacacttccaatagataatctgagagagaacactagactttcaacagaaaagtgacaggaaacacttgaagtgaaaataaagaggaaagcaaggtaggctgcttggccaggatcagctgagagcctacaaaggctcaacaatgtagggaaagagtaagtgagtgactcctgtagttcaaatttctactatgactcttgcatgctagccacaggaaagaccctagatcctcaggcccctagactaacatagggagtgcctggggacagacctgaagagaaagctcacaatgagtgtcacacacaccctgagccctaaccatttacagcaaggcaccatattgagagaccagatcccaacagattgcatcttgtctgggtgcccaacagaccatgcatatccacatttctggagcctcattgacatttcccaccagcagccactaccatagctgactgctgcctccatgactgaagcacaagccattgacaaaggccacactgcctccagcagagaagctgcagtacattttcacgggttccaaggacaaacgtccctgctcacagtagctgccacttcaagctgccacaattggggccaaaacacttctaaagtgctcactcttcagctgctgcctccatgactgaagcataagtcattgacaaaggccacactgtctgcagtagagaagctgcaatacattttcatgggttccaaggacaaacgtccctgctcatagtagctgccacttcaagctgccacaactggggccaaaacacttgtaaagtgctcactctccagctgcctgcatatggttgatgccactgaaagaaacccttcccttcccagtaacaaggctggagcacagccactgccatctccacccaagtaggactttggtcctacgaattgttctacccaagcataccacggccaatgcctgaattcaccaccagtaggcttgaagaaaagtcttcccagccaaactctggctctgcagtgcctgaacatgccttctggaggggtctggggaacatccagtccaggcaatcattgttggcaccagagaacccctcccagagtcctaggtcaggcccacccaacctgctaccacaaccacagcaagaacccacctgtaggcctggggactgacccatgcaacctgtcacagccactgccaacaccagtatggaccacgtgggatgcagaggttagtcccatcactgctactaccatctcccatgctaccctcactgcccagaggcctgaacccgcccacctacttggctcattgctgccactaccagcacctgagcaagtctccaggaggcccaagcctgcctgcaccctctaacactggtgccagtgtacccacccttaagcccaagaacagtcatgttcagcccactgctgccacaactggagcccaaggacaggcccatctggcatccccgtcttcagcaaaacttctccactgcccccactaacaaataagagagaaaatgagaaggatgcaataacctaatctactgaggaaatcacaaacagcactgatgctgtgtacagcaaaatgaattacatggagagtatactactgcatgcacccagtatcaaagccaaagtgtcctacctagcatgatagatacttcttcagtccttccatacaaaagcaaatccaaaaaattgaaacaagccaccattataccagatgtgcagatatcaatgtaaagacacagaaagcataaaaagcaaggtaatatgacacctccaaaggaatacagtaatactccagcaatagatttcaataaaaaataaatttataaaatcctaaataaagaattcaaaataatgacattaaggaagctcagtgagatacaagagaatacaagaaaacaataaaaataatttagcatatgaaagaaaaatttaccaaagagctagacattatttttttaaaagaaccgaatagaaattctggagctgaagaagtcattgaatgaaaaacaaaatacttgcaaaagtttcaataatagactagatcaagcagaagaaagaatatcagaacttgaagacaggtctttcagaataacacagccagaaacaaataaacttaaaaataaataaataagaataataaagtatatgtgacataggggacatcttaaagcaacgaaatatccaaactattggtgtcccagaaggtagagataaatgaaggggttaaaaaacctatttaacaaaataatggctgaaaacttcacaaatctagcaagagatttagacatccagattcagaaagtttagagatgcccaaacagatatactacaaaaaggtatttttcatagtacattatagtcaaactatcaaatgttaaagacaaagagaatgctaaaaacaacaagagaaaaatatctagtcatttataaggaacccccatcagactaatagtggtttctcagcaaaaaccttacaggccagaaaagaatgtgatgatatattcaaagtgctggaaataaaaaccaaaactgccacccaacaacagtataaccaacaaagttatcctttataaatgaagaagaaataaaatctttccaagagaagcaaaagctgaggaaattcatcaccagtagatcaatcctgccataaatgctttaagaagtcttacatctgaaagtgaaaagattatatctattatcatgaaaacacatgaacgtttaaaacccactggtaatgcaaacacatgaataaagaagagaaaggattcatatgttaccactacagaaaaccaccaagccataatgataaacaatgagagaagaaaggaacaaaggatatacaaacaaccagaaataaattaataaaatgacaggaataagtcttcagatatcaattataaccttaaatgtaaatgaattaaaatttccacttaaaagatacaggctagttaaatggaataaaaatacataacccaactgtatgctgccttcaagaaactaatctcagctataaagatacatatagagcagggatgtccaatcttttggctttcccaagccacattggaagaagaagaattgtcttggaccacacatgaaatacactaacactaatgacagctaatgagctttaaaaaaaaaaatctcataatgttttaagaaagtttacaaatttgtgttgggccacattcaaagccatcctgggctgcatgcagcccacagactgtggattggacaagcttgatatagactgaaagtaaagggacgaaacaaaatattctatgcaaacaaaagccaaaagcaaacaggagcagctatacttatatcatataaaacagactttaagtcaaaaatagtagaaaacaaaggtaattatataatgataaaggagtcaattcagcaagataatatgactattttttaaatatacacacctaacaccagagaactcagatatacaaatcaaatcttattagatctaaagggagagatagactccaatacaataatagttgggttggaactttaccactccactttcagcattagacagatcatctagacagaaaatcaacaaagaaacattagattcaaactgcacattagaccaaaggacctaaaagacatttacacttatagaacattttatttaacagctttagtatacacattcttcttatcagcacgtggaacattctccagaaccgaccatatgttaggacataaataaattttaacacatttttatatattgaaatcatattaagtgtcttctcagaccacaacaaattaaaactagaaattaataacaagaagaacctcggacacttaaaattaaacaacatgctcctgaatgaccactgggtcaaggaggaagttaaggaggtaataaaaaatattcttaaaacaaatgaaaataaaaaataccttgaaacccagcataccaagcccaatgggatacagcaaaagcagtgctataagggaaattcatagcaataaatgcctacatcaaaaaagaagaaagcttctaaacaaataatccagtgatggtggcaccttaaggagctagaagaacatcaagaaaccaaacccaaaataagctgatggaaagaaataatgataatcagagcagaactaaacaaaatcaagatttaaaaactaattcaaaagatcaataaaatgaaaagctttttttgaaaaaaacaaacacagtcaacaaacctctagctagaataacccagaaaaaaaaatgagaaaagactcaaaacataaaaaccaaagtcagaaatgaaaaaggaaacattaaaactgatatcacagaaataccaaagatcatcacagactattatgatcaactatatgctaacaaactggaaaacttagagaaaatggataatttcctggacacatacaacctactaagattgaatcagaaagaactagaaagcctgaacagaccaataatgaataatgagattgaattaataacaaaatgtctccccaaaaagaaaagaccaggaccagatgccttcactgctgaattctaccaagctttcaaagaagaacacacaccaattttcctcaaactattccaaacaattgaagagaaggaaatttcccctaactcattctacaaggccagcattaccctgataccaaagtcagacaagtatgcaacaaaaaagaaaactaaaggccaatatgcctgatgaacacagatgcaaaaattgtcaacaacatactagcaaaccaaattcaacatcacgtaaaaaaaaataatgcaccatgattaagtagaatttatccaaggaatgtaaggatggctgaaaatagacaaatcaataaatgtgacagattatgttaacagactaatgggaaaaaagcatatgatcatgccaggtgacacaaaaaaagcatttgataaaattcaacagttctttataataaaaactctccacaagagtgttgaaggaaaaatacctcaatacgataaagaccatatatgccaaacccacagttaacatgatactgaatggtaaaactgaaagcccttcctttaagaactggaacaagacaagaatgtctactttcatgactcctattcaacagagaactggaagtcctagccagagcaattaggcaagaaaaagaaatagaaggcatccaagagggaagtcaaattgtttgactttacagatctagaatgttacatctagaaaaactaaagactccaacaaaacattcttagatctaataaataatttcagtaaagtttcaggatataaaatcaacatgcaaaaatcaatgataaaaatcagtaatgtttctgtaccccaataatgaactagctgagaaacatatcaaggaaacaattccatttacaatagctataaaaaatagctaggaataaatttaaccaaggaggtgaaagatctctataaggaaaactatgaaacactgagcaaagaaagttaagaggacacaaaaaatggaaagatagcccatgcttgtggattggaataattaatataattaaaatgatcatatggcccagagaaatctgtagattcaatctaatttccatcaagatggcaatgtcattgttcactacaatagaaaaaaaaaacctaaaattcatttggtatcaaaaaaagagactgaatagccaaagcaatcctaacagtggtaatgaaaacaataatagtatggatataaaaatagtaatgaaaacagcatggtataaaaacagacacatgaaacaatgaaacaaagtagaaaacctagttataaattcatgcatttatggttaacccattttcaccaagatgggttataaagtcaccaataaagtcaccaagaatggacactggggaaaggacaccctctttaataaatggtgctgaaaaaatttgatatccatatgcagaagaatgaacctagagcccgacttctcactatattcaaaaatcaaatcaaaatggattaaaaactaaaatgtaagacttgaagctataaaactagtagaagaaaacatagggaaaacacttcaggacattggtctaggcaaagattttatggctaagatcccaaaagcacacacaacaaaaataaaaatagacaaaaaggaatacattaaactggaaagcttctgtataaacaaagaaaacagttaatagagtgaagaggcaccctgatgaatgggagcaaatatttgcaaactgttcttccagaatatacaaggaactcaaacaactgaacagtaagaaaacaaataatcttattaaaaggtaggaaaatacatgaatagatatttctcaaaagaagagatataataggtaccagacatataaaaaacaaatcactaattatcaagaaaattgcaaatcaaaaccacggttagatatcatcttaccatagttagaatggctactactaaaaagacaaaaaaaatcagatactagcaagtatgcggaaaaatgggaattcttaaagaaaatcaacaaagaaacattagattcaaacagcacattagaccaaagggacctaaaagacatctacatttatagaacattttatttaacagctatagtatacacattcttcttagcacatagaacattctccaaaatagaccatatgttaggacataaaataaatttcaacaaatttttataaattgaaatcatattgtcttctcagactatgacaaaataaaactagaaattaataacaagaggaacttgttactgttggtagaaatgaaaaattagtacaaccactatgaaaatagcatggagatttctcaaaaactaaaagttgaaatgccatatgctccagcattcccactattgaatataagggggaaaaattcagtatataaaaggaatacctgcactcccttgtttattgcagcactatttaatagagcaaagatatggaatcaacctaagtgtctatcaactgacaaatggataaggaaaatgtggtatatatacacaaaggaatactactcagcaattaaaaagaatgaaaccatgtcatttgcagcagcatgagcagaactgcagatcactgtgtatgtgacataagccaggcacggaaagacgaatatcatatgttctcactcatttgcggaagctagaagtttgatttcatggaagtaaataatagaatgatagataccaggagctgggaaagatgtataggtgactgtggggtataaacagaggtgggttagtaggtataaacatacattagacagagaaagtaagttctaatgtttgatagtaaagtagggtgactataattaacaacaatgtattatatttttcaaaacaactggatgagagaactcaaaatgttcccaatatatagaaatgataaatactcaaggccatggacaactcagttacccagacttcatcattatatagtctgtgcatgtaaaaaattatcacatgtaccccataaatagcacaaatatttgtatctatttttaaaagcatataagtgcacctctgttatcagaaattacattaaagtgtcacattatttggaatggaaaagtcaaatgacatcaaaatgtaagatgtgatctgaacaaaatgtgtattgccagttgtgccctgtacaaaggtatctggccaaatgtagagggagctgctagaagctaaaatttagttcatgttaaacttactaaaccacaggctctagttgcatttgccaaggagggtactgttttctaattctcacaaggtacaatacaagcaaatagttgctctatgtagcacataagacgtggtgacagttcctaggtttccttctctcaaaaagtcttaaattcagaggaggcagctatcattggagattcatgtgttggaacaaggctccatgtatcatgcacaatgtgaactgggccttgaaaaattggtaaaatttggttcaaaagattcggtggaaaactgctaatgaaagaagcatgaacatttaatacccaaagatgagaatgaacgtaatgtatttaagaaatgtaattgttcctaaaaatctataaatccatatttacatggatatttttgttacccagacataagcattaatttattggtgtccttcctcttggcccttttttgtgtgtgcacatgcatgggacgtgcatgtgcatctctggttactgtacttgggaagagaataatgaaaccaagcgaggctataaaaatgggagaagaccagcaaatacaaatattagctgggcatggtggcaggtgcctataatctcagctatcccagaggctgaggcaggagaatcgcttgaacccgggtggcggaggttgcagtgagccaagatcgctccattgcactccagcctgggcaacaagagagaaactccatcaaataaataaataaataaatgagaaatacacgtatggagttgacttctgtttgacaaaaataaagatagaaaagtaatatgatggaaatacatatgaaggagatagaaagtgaaggaaatagacatcacagaatagccagcaaattagaaataaaagcatgagaatgattttcaggagtccatagtaagaaaaaagattcggtcaatagttcaatcaagaaacatttattattatttaccctatgccaaacagagagctgagggtgagaagatataaagatgaggaaacaaaagctcctgttctcaagaagcccacaatccaacaaagacataagacaagtgtattagttcgttttcatgctgctgataaagacatactcaagactgggtaatttataaagaaaaataggtttaatggactcacagtttcacgtggctgggaaggcttcacaatcacggtggaaggtaaaagacacgtcttacattggcggcaggcaagagagagaatgaaaaccaagcgaaagaggtttcctcttataaaatcatcagctctcatgagacttatttactactatgagaacagtatgggggaaaccacccccatgattcaattatctcccactttcctcctacaacatgtacgaattaggggagctacaattcaagatgagatttgggtggagacacagcaaaaccatatcaacaagcatatcgattgtggtatttcaaatctaataaccagagccctgattaaggcacacgatgagacatcagagccagctgggaaattacagcagatttcagcgaggacagggaaagcaactttgaaggatacactagactcatgtatgtatagattgagataggaaagtaaacaaaatgccttagaaatggctgagagtaaaaagttggagcctgcccagatggcagcaagcaaaggaggtgagaagactaaaaggcacaactaaaacaaagacgttttggaaagttgagtcaatggaagtactatttcctttgtagatctttaagcagcaatatttttgtttgtatatatacatacaaataaatttatatatttacttatattacatataaatatatttagaatatataaagaatatatattcttagaatgtcttagaaatatatattcttagaaagaaatatatattcttacaatatatatttatatacattaaaaataaatttatatatttatttatattacatataaattattacatactacattataaaaaattacatttttataaataaaaaatttataattttatatttataaaattattaaaaattttataattttataatatttatattacatataaatatatatttagaatatataaagactatatattcttagaatgtcttagaaatatatattcttagaaagaaatatatattcttagaaagaaatatatattcttacaatatatatttatattcttagaaatatatattcttacaatatatatttatattcttagaaatatatattcttacaatatatatttatattcttagaaatatatattcttacaatatatatttatattcttagaaatatatattcttacaatatatatttatattcttagaaatatatattcttacaatatatatttatattcttagaaatatatattcttacaatatatatttatattcttagaaatatatattcttacaatatatatttatattcttagaaatatatattcttacaatatatatttatattcttagaaagaaatacatatttatattcttagaaagaaatactatttatattcttagaaagaaatacgtatttatattcttagaaagaaatacgtatttatattcttagaaagaatatatatttatattcttagaaacaatatatatttatattcttagaaacaatatatatttatattcttagaaagaatatatatatattcttagaaagaatatatatatattttcttagaaagaatatatatttatattcttagaaagtatatttatattcttagaaagtatatttatattcttaaagtatatttatattcttagaaagaatatatgtttatattcttagaaagaatatatatttatattcttagaaagaatatatatttatattcttagaaagaatatatatttatattcttagaaagaatataaaagaaagaatatatattctttctaataatatatacttatatattacctatatattcttagaatataaaagaatatatatggaaatatagaaaatatatattctaagaccacatatatgttatatgtgatatatatgttttatatagagagatatagaaaatatatgttatatataagatatacatgttttatatatgatacatgttatttatatatattattttatctgctaatcctccatgggtgctgatatgtttccattactgatgttatgaagaaattactattcacacacacaaataaatcagcaattatggcattttctgctcaagcacagttgataatttactgaaaaaatttaaaaataaaaattatgaggatattgcctaccatgtttggcaacaatccacaagactaacaccattttatgcttcagagtttattgcaaatataaatgtatttttaggcaagaaacgatttgagaaaccacagtattccctagctcatcctggaaatggtaattagcacatcagtaaatcacttgtagaattttatttccatgaacaagaaaataatgttatctcactcagtgcagcaggctgatgtgagttatgactttcagaaaaatgaagccttatgattagccaccaaaggtgcaaatttatgaagatgatgttgctagtacagcaacatattattctgaagcacagagtaatgctcacagaacattctaaagaattccctagaatagcttaagagcacaagtatatcctgccccatttccttccccctgagatcagagtgctgaacctttttattaattatctttgtttggtttggtgctcttaaatactccaagaaagtttctttgaatgtatctatagcaagttgctttgtactataaattcattttagtagttacaattttaagaagaaagctggttaaacgctgataaaatgatccaggctattatataaataatcgctacctgcacagtatttacgcatcactttaaagctcaatgtagcttgtaaattttttaatctacttgttccttcatttttcagtgattacttttatttttgcattattacacagttcatagaaaaaagatgtgtatttcttctgtttttctgctgaaaattacttaagagaaaatgtcttattagactgctttgaattactcatttactaatctagaactccctatgtctaacaacatcacgaaaaagaaataataaaataatagaataaaagcatggaaatgggaccttatagataatctatggataatctaaagtggcagtctacaagaatcccaccaaaatatctgtcctgtgcatccatagcttattcatggggaatttatcaccagtgcgtatttaatcttcatacacccatggcagttactctttacatctccaatgggtcttctctgttattctgcattatacctgtgtaagatgaaataaaataaagtctgtttgtatattagattgcttacatattttcagagaaagatggtagagtaaaattgattttaccctaacctctcagcaatcaactaaaagcaatatttaaataatgaaaacaaaattaaatagacaacttcatttctaataaaacaaagaagtagtgactacctcatatcacaaattatgatgatatatgtcaagtaaagtaaatttgggtcaaatcatgagataatgcagaaagtaaatatagattttaggcaacagcctgaattcttcaaaactgatggaatttttttaagaacccaacaaaaggttgttatgtagaaaagcagagcctggaagaggatttgagttatgacagcaacctttgcccatttcatacttgagaggggaaagagaaatagggcttatgaacaatcaccaaaaggcatcataataaaagtaacaaggataaactatataataaaaaccaaagaatacctaagcaacgtttctgaaaaagaatgagaatctattgtctatcagagtttcttagaataacatgttggaataagtggatatttgctgaagaaagtttgagttctaataacatctctacacctctaatttctcagataaatagcaatatatttgaaatattcaatttttaacaaaatttctgactggtcatatcttaaagtattatcatttcaaatccaatttatttctaaatactctctttttgtcaaaaaaaagacaaaagggacccagattcttcttatgaactaatgaagaagcagaaagaaatacttaaatataataatgtcatggttataaatgtctttaaaaataaataaggttctataaaattcaactagttagattacatttctatttctgaaacatcaaaataaaggcaggagttttcctcgtttcctaaaaaagtcaccgtcaagtagcaaaaataagaaccagaagcaattataattgtaaaaatgataaattcattaaacaaatatttattacgtcactatatggtacacattttgtttgaagtaccctgacataagtacaaagacaagtaaactaaacataatttttgttcacgtggaatttacagtctactgagagatttaaatgtactaatatgttctactgctttatctttaaataatgagagaatttgagaaatgagaagaaataactaattatgataggtgaaaattagttaatgttacttctagtttgattgtgacaaaataaatacatgtgacaatgttgatttggagatgattaaaatataaactaacatttttcctaattattgtcactttcttattatgtggaatgaatattttccagtctaattaacaaaatatgctttgtgtcacatataaaacaaaaaaatgtattgttgtgatgccagttcctttcaataaaaaatatttggcactataaatatataataacaaaatgtataagtattaaagaaaattgttaaaatttattattttattctaaattacatatatgggaaaatatatttatcacaaaatagctattatgagcctactatgcataaaatctcaatgtactattatatattttatgtccaggatttttacttttaaataatctctatcaattaagagaaaaaagcagtctgcttattacttaataaaaagtgagatactttactgtaacaactcgtatagtgataaatatatttaaaagtggatgaaatgctataggaatccaagtcataaaattaaatttatagttataaaaggtgagatagaaggcaggtgttctccttatcctctccgcaaatcattctatggcaaaacccagaagcagaagcacaaactccaagcctttggatttcagaaaaagtttacagagcacctttcttgaaaataagtggtatatgcaattctacatgccatatttatcttggaggaagacatacatctcttcaaggagcattctactggtgaaactcaaaaaggaaaaaggctgcattgagagacataacactctgtattcagatgtaaaactccaattattctggttagcctctcatatagctccggccccattccagtcctgtgaatcacttaaaaatggctgatctaggggaaactcatgttaccaaatccaagtgaaattttttaaatgaccattgtatgcgtatccaaggatatttaaagaaaaaaaagttgaacacagagaagagaacacggaaaaacaaacagtaaattaggagtattcactagaaaaatattgccacaaaaacagataaaaagactgattaactgtattgccactaatgaacagtattaatgaagaaatcttctatatagatcaagagcacaatgtcacaatacaagagtttagaaataacaagtcaagacctaagatgtgatcagctttgtttactcttctacatttcttgagaagaaagtaccctattcgtattagggtgttaatttcaaaaatatctgtgaaatctactgtattgtttatattatacaggtctagatctttattattttttatatacttgacttgacttgaactgagagtgatatatttgaatattttaccattccagtttatctgtaaattttattttgcatctcatgtagttcctgccttatgatggatatttgttatagtatttggtatgcaggtatttaaaacttctatatcttcatggtaaattgtaaaccttcacatcatgagtgtcctacctacctacttttcaagttgaatttttcactttagtactccttaaccctatgtgtctgccataccaaatatcttacagtttcattaatgagtcattcattgtatctctctctgtctcagtggaacacgctaccccaattaattagtttacctggcacttcaacaagacttctctgaaggttatgctctttccttttactcactagaccatataaatatctctgttatagtattaaaaatataaggctaactattattttccatttatgtcctcttctagactataaactttttaaaaataattgctttgtggatttatctctgtgccctcagggcctgcagtgtagccaacactcaatgggtgtttatgattttaggcagtgtgatgagattaaagctatattccaggcatcagttaaggttataagaaaaaatatttagttctatgcagaacagcattcaaggtaaagctctgggcaaaatgtcatagccacagccagataggctggacggatgaagagaaaagaaaaacatatgacctggcacaatttttggtgaaaaaaaagtagagtttaagaggaaagatggctcacataaatgtggcatataaatacacagaaggccacctcagatactggaatctggacaagtatagcaggcagagttctgagaagatactaagacccttggttcctgatatatacatgccttcctctaattattcaaaccaaatctatgtgcttctgtgaaggaattttgcagtgtagttagatcctagatcagctgactttaataaagttgaggcagtgagtctgatctatttacgtgagccattaaaggggaggaggctcttcttaaccaaagaaatttaaagtatgagagggactcaataagagcaactgtttattgctggcttcaaaggtggagggaaacatgccaaaagattgaaagtggcctcttccagctgagataagctttgactgacaaccagcaagagagccagcattagtcctaaaaccacaagaactgaattctccagcatgaatgcgcttgaaataggaccctaggctccagatataaacacatccagctgaaaccttgatctggtatgttcttgacacatgggttatattatgcttaaagttctcacctacagaactgtcagctattaagtggcagacttaaggtaacttaaacttaaggtattaagtttgtggtaatacattgtgtagcaatggaaaactaatatgataagtaactaattgtatgccccaaccccttactaatgaatgtagtcagaattgtgtcaaaagccatgggtgggacttagcatctagcttgaaaatctttgccatatacttctagaccacatttaggagggcaagagtgacgttagcaagccttctagagactgggttcacctctctgaaactcagtccccacagtggaatataactttctactgcgggaatgcttgctgcctcctgtgacctgcaaccagaaagcaatctactcagatggctttcagatcctactctaccatttaattgttgaattaccttggacaatatattgaacttaactaagcctctgtttcctcatctataaaatggggattggagtaaccattttataagtttatcgtgaggatcaaatgagataacatccttaagcttttagcacatttttgagaatatagtaaacactcatacatattagtattaattcactatctcagacaaatttctttccttctctaatgttcttccctggcctaaaaaaaccacatatgcatgtataacgggtataacggccaagaataaatacccatatgttcaggatataatacacaaaatgttgtaaataatgtctctttgtaaatgttagaatatacatgcaaataaagacttatctgacttcaacagcaggtggatttacataagcaacacacagttaaatagctgggaccatgtccattttaccaatacattttataatatgctgtctacattttaattgtaacacctgctcctgattctgaaagaaaaaaagtttatttatcctttaagtaggttaggtgaataaatattgccatgttttaacccatcatatattatataattatttcttattcctagcaaaatattttcattttgagttccaatagtaaaaattatctcaaaaattctatcaagcactctatggattcatggttagtctgtctgaagatattaaaatgaaaaatcactgccctgacttgaaacttaggagataccagagtaagagagactgaatataaagctactgtaataaatactaacaggaataaggaggtgaaataaggaaatgtgagctgaaaggaaagggagatactgatgtggaaaggagatactattgctgatataaaacaaaagcatctggaaactgaccagttgtggagaatgaagaagaatgaagagagaaaatgtttctttttcatttcttagttcataaacaatgagtaagcaaaccctgtcaagcctatgtccacaattctgaaatcagagatataaaaaaaaaaatcacattccttttaagttagacaaacctgagtttgagtctcagttctaccatttattattttttataattattattatcattattaggtattgttctgtcacccaggctggagtgcagtggcacaattacagctcactgcagcctctacctcctgggcaccagtgatccaccagcctcagcctcccaaatagctgggactataggcatccaccatcatgcccagctaatttatttaattttttgtggagacagagaatccctatgttgcccaggctggtctcaaactcctggactcaaataatcctcctgcctcagcctcccaaagtactgggattacaagcatgagacaccatgcctgtccagttcttccatttataatcaccatgactgttggcaaacatcttaatttccttgagatttgatcttgttgatggtaaaatagtgatggtaaatgtctttgcttatctgtatcactcaactctcttgaaactcaaacgaatgtgtgcaaaagtctccttaagttttctaagatgatgatgtcattgactatggtagctatcagaggtagcaaagcagatttctgtcaggctctgaggaagatagggagttcagactatggcatgttatagatgagaaagcagcaggatatgcaagtgtaaatttcaaaatagatatatggagatatctctggaacttaggaaaacagtgagggctaaacaaaaataaacaaaaatacaaaaacaaaattgatttaagaatcatctctgtagtactgatggttgaaactgtgggagtatatcagatggtcaaagaagtttaaagattttaccatagtatgaaagaagagaatagtcacaactacagagttaagctgtgcatacaaaagatgattaggatgcattctttgcctttaaggagcttatattttaaaggcagaatcacacctgagtacataaaattttaattcaatacaggtactaatagagtatagaagcctcatttctgaagttccttaaaggcaagagaggtcatcaggaaagctacatgtctgatgcttgggaaactgaggagatttgaatgaaatgaaaatgaaaagaatattgcgtttcatactttgttgactcaagtggattttcgtcttatttggtttaaattagtaaaatgtttctgatatttgccaatcaattctctctctgacaggcagccacacaaaaaagtgatcttttctttgtgtccaaaaatataaatctggctccggatttgtatcttggccccttgcatttgtttaaacagaatactttaatgactgtcttccaacaccaagctcataatttgagttcaccattccatgaccatattctttcatctaacctgttagaagggtaggccttgtgggtacagccatgaactgcaaaatctagatagaaaggaaaataaatacgacaggaagatttttgaacacttgaccctctaacatggcactttataatatagagagtagtatttactttttaaaacaaatcattcaaaccttctttatagtatgcattccacaacaatgtctgtgaatttctattttgctgtgccctctactatatgaagaaacatcattgttgaaactgttgctgatttcttaaagaacacattaaatactagaattctattatgtctttaacacgtttattaattattgagttcaaatatattttcatatatttatttaaattttctcttttgtcattatctacttgcatcctttgatgatacctcaaattattaggtattattttacctctgaccctctctcatctatctccttgcctccctctttttctctctctctctctctttctatcctttctcttcatattcttttcttatactttcctttaaacattggtttcataataataatcaaaaaacataactacagtagtagtagtagagtgaaaacatataccacaaacaggaaaatttagaaactttcttcccccaagctaacctttcagaagtcacacacagatttgccaagccccaagaatggattactcacccctattaaagattacttttgaagaatactcattctgggaaaccataaaacaatgaataatgactcagaactataattctatttgtgcagatgactcaactggcttattgaaattttcttacttcctggactcttttatataaagagctgagtattttagaatcccagactactatatatgtgtgtgtgcttgtatatatatatatatatatatatatatacaagcacacacacaaatgcaagatatatatatatatacatatatatatatgccaggaatcaagattctaaaggaaatggtagaagggagaacatgcagaaaatgacagaggaagcagttattaaattttccaccaataattcccagaaagtggtatgcaaatcctcaggtcttgtctccaaaaaaacttaatcctaaccctgaaatctgtgttcaacatgtcctccagaagatgttgatgcttgctcaagtataagggctgtcggttttgaggaccatgtgatgacatgcctaccctgccaccaaaatattatttacaggttactccagttttgtcttggatcccttcacattgcagttagttcatgctcaccactgtgactatgacaccttccgagggtgggaatacaactaaacaagattttcaaaacaacacttctgctggaaactcaactaagttttaagattcacattgggcttcctgagtctgatcaggcattggaactttaaaagaagggaaggacttttttttcttacctccacatcattatccacagtccctcccagacagattctcagagaccattcactcatgcattcatttgtgtgttcattcatgcttgtgctttgtgcctgggcacacgcctgccactgggatacagaagttaaccaacagatatgggccacgactgcacagaagttagataaatgtcttttaaaatgtcttaaaaagatgattgatgtgcattataaagtcccatggtatttaattttaaactctgattacaaaagtataggaaactatgaaagaaagaggatataatttaaaattcataaaaaattttcccaaagaaatgacaatataggaaaatatcaaggtcttccttgtccaaatgtttgtccatcccctcagggaataataggacactcagctgggaaaattgcgtgtggtagtgaaaggaggggccagctgggcttcctgggtcgagtaagggctcagaaatctgtgaaactcattcatttcctgcatcaggacttacttcggtcctggatgaataatatcgaagatatgtgcttaaaatattcctaacaccaggatttgtgcatgtgttttcttccccaagagagctacaaagagcgaaaattttgctgtaagcttccctgtgtcctctctccctctctcccttccttctccccgaaaactaaaaggaatgttaaaagcccatttttctgtgaccagtggaccttatctatgctcctaattccaattccttgtaaacatcctttgtaaagtcctgtaagatcctgtctcctttgccatgctgctgttaaggtcataaagtagataaaacctaagttgcaattcctgttttcctcaagatctaaaacgagtcacaaatggttaattgtctttgtttctcgctctggtaacatcttccccctgcaggtatttcccaccttaaagagtttaaaaggaaactgcataatctaacccttgctacctgctggggaccccttccatgctgtggaagctttgtactgtcactctgttcaataaagcctacagctttttttctcttggtctgtgtctccatcactcaccgcaggcagctgccacaccaattctttggcgtggctaaggcaagaacctttggcgttacagtaggaagaaaagaaattattttcttcctcttcctttgagataaaataaatatgtggggaaaagtgcactaccacagtatttattctttttatctatcctgattactttcaggattatgatgataaaaaaatgtgctagcccatcaatttaaaatgaaatactgaatatgtattaaatcaaccaacttacataaaggtgaagatatagactgggttttcaactgagtggttgtacagcacttcttacctgcagatatgatatgcaaccttattttcatcaaataagaagtggggcagggtgtcaggcctctgagcccaagccaagccaccagcatcccctgtgacttgcacgtatatccccagatggcctgatgtaactgaagaatcacaaaagaagtgaacatgccctgccccaccttaactgatgacattccaccacaaaagaagtgtaaatggccggtccttgccttaagtgatgacattaccttgtgaaagtccttttcctagctcatcctggctcaaaaagcacccccactgagcaccttgcgacccccactcctgcccgccagagaacaaaccccctttgactgtaattttcctttacctacctaaatcctataaaacggccccacccttatctcccttcgctgactctcttttcggactcagcctgcctgcacccaggtgaaataaacagccatgttgctcacacaaagcctgtttggtggtctcttcacacggacgcacatgaaatttggtgccatgactcggatcgggggacctcccttgggagatcaatcccctgtactcctgttctttgctccatgagaaagatccacctatgacctcaggtcctcagatcgaccagcccaaggaacatctcaccaattttaaatcaggtaagcggcctcttcttactctcttctcccacctctctcactgtccctcaaccactttctcctttccactcttcaatctctcccttctcttaatttcaattcctttcattttctgggagagacaaaggagacacgttttatccatggacccaaaactccggcgccggtcatggactgggaaggcagccttcccttggtgtttaatcattgcagggacgcctctctgattatacacccacgtttcaagggtgtcagaccatgcagagacgcctgccttggtccttcacccttagcggcaagtcccgcttttctggggaaggggcaagtacctcaaccccttctctccttgtctctaccccttctctgcttttctgggagaggggcaagtacccctcaaccccttctccttcacccttagcggcaagtcccacttttctacagggcaagaacccccaatcccttatttccacgccccaacctcttatctctgtgccccaatcccttatttccaagccccaacctcttatctctgtgccccaatcccttatttccaagccccaacctcttatctctgtgccccaatcccttatttccacaccccaacctcttatctctgcaccccaatcccttatttccatgccccaacctcttatctctgtgccccaatcccttatttccgcaccccaacctcttatctctgcaccccaaccctttcccacttttctggaaggtgagaacccccgaaccccttccctccgtttctctactccctcttttctctaggcttccttccttcactatgggcaaccttccaccctccattcctccttctactcccttggcctgtgttctcaaaaacttaaaacctcttcaactcacacctgacctaaaacctaaatgccttattttcttctgcaatgccgcttgaccccaatacaaacttgacagtagttccaaatagccagaaaatggcactttgaatttttccatcctgcaaaatctaaataattcttgtcataaaataggcaaacggtctgaggtgcccgacgtccaggcatccttttatacatcagtcccttcctagtctctgtgcccagtgcaactcatcccaaatcttccttctttcccacccacctgtcccctcaataccaaccccaagcgtcgctgagtctttctaatcttccttttctacagacccatctgacccctcccttcctccccaggctgctcctcgccaggctgagctaggtcccaattcttcctcagcctctgctcctccatcctttttatcacctcccctcctcacacctggtccggcttacagtttccttccgtgactagccctccccctcctgcccagcaatttactcttaaaaaagtggctagagctaaaggcatagtcaaggttaatgctcctttttctttatcccaaatcagatagcgtttagggtctttttcatcaaatataaaaatccagcccagttcatgacttgtttggcaacaaccctgagacatttcacagccctagaccctaaaaggtcaaaaggccatcttattctcaaaatatattttattacccaatctgctcccgacattaaataaaactccaaaaattaaattccagccctcaaaccccacaacaggatttaattaacctcgccttcaaggtgtacaataatagaaaaaagttgcaattccttgcctccactgtgagacaaaccccagccacatctccagcacacaagaagttccaaaagcctgaactgcagcagccaggcgttcctccagaacctcctcccacaggagcttgctacatgtgccggaaatctggccactgggccaaggaatgcccgcagcccgggattcctcctaagccgcatcccatctgtgtgggaccccactgaaaatcggactgttcaactcatctggcagccactcccagagcccctggaactctggcccaaggctctctgactgactccttcccagatcttcttggcttagcggctgaagactgacactgtccgatcgcctcggaaccccccagaccatcacggacaccgagcttcgggtaactctcacagtggaaggtaagcccgtccccttcttaatcaatacggaggctacccactccacgttaccttcttttcaagggcctgtttcccttgcctccataactattgtaggtattgacggccaggcttctaaacctcctaaaactccccaactctggtgccaaattagacaatactcttttaagcactcctttttagttatccccaactgcgcagctcccttattagggtgagacactgtaactaaattatctgcttccctgactattcctggactacagctatatcccattgctgcccttcttcccaatccaaagcctcctttgcgtcctcctcttgtatcccccccaccttaacccacaagtataagatacctctactccctccttggcaaccaatcatgcaccccttaccatctcattaaaacctaatcacccttaccccactaaacaccaatattgcatcccacagcacgctttaaaaagatttaagcgttatcactcgcctgctacagcatggccttttaaagcctataaactctccttacaattcccccattttacctgtccgaaaaccagacaagccttacaagttagttcaggatctgcgccttatcaaccaaattgttttgcctatccaccccatggtgccaagcccatatactctcctatcctcaatacctgcctctacaacccattattctgttctagatctcaaacatgctttctttactattcctttgcacccgtcatcccagcctctcttcgctttcacttggactgaccctgacacccatcaagctcagcaaattacctaggctgtactgccgcaaagcttcacagacagcccccattacttcaatcaagcccaaatttcttcctcatctgttacctatcgcagcataattctcataaaaacacacgtgctctccctgccgatcgtgtccaactaatctctcaaaccccaaccccttctacaaaacaacaactcctttccttcctgggcatggttagatactttcgcctttggatacctggttttgccatcctaacaaaaccattatataaactcacaaaaggaaacctagctgaccccatagatcctaaatcctttccccactcctctttccgttccttgaagacagctttagaaactgctcccactctagctctccctgactcatcccaacccttttcattacacacagccgaagtgcaggactgtgcagtcggaattcttacacaaggaccaggatcgcgtcctgtagcctttttgtccaaacaacttgaccttactgttttagcctagccctcatgtctgcatgcagcggctgccactgctttaatacttttagaggccctcaaaatcacaaactatgctcaactcactctctacagttctcacaacttccaaaatctattttcttcctcatacctgacgcatacactttctgcttcccggctccttcagctgtactcactctttgttgagtctcccacaattaccgttgtccctggcccagacttcaatccggcctcccacattattcctgataccacacctgacccccatgactgtatctctctgatccacccaacattcaccccatttccccaaatttccttctttcctgttcctcaccctgatcactcttgatttattgatggtggttccaccaggcctaatcgtcacacaccagcaaaggcaggctatgctatagtacaagccactagcccacctcttagaacctctcatttcctttctatcgtggaaatctatcctatcctcaaggaaataacttctcagtgttccatctgctatcctactactcctcagggattattcaggccccctcccttccctacacatcaagctcgaggatttgcccccacccaggactggcaaattagctttactcaacatgcccgagtcaggaaactaaaatacctcttagtctaagtagacactcactgaataagtaaaggcctttcctacagggtctgagaaggccaccgcagtcatttcttcccttctgtcagacataattcctcagtttagccttcccacctcaatacagtctgataacagatgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaacttaaaaaggactggacaatacttttaccactttcgcttctcagaattcaggcctgtcctcggaatgctacagggtacagcccatttaagctcctgtatagacgctcctttctattaggccccagtcccattccagacaccagaccaacttagactgtgcccccccgaaaaaaaaaaaaacttgtcatccctactattttctgtccagtcatactcctgttcaccattctcaactactcatacatgccctgctcttgtttacactgccggtttacactgtttttccaagccatcacagctgatatctcctggtgctatccccaaactgccactctaaactcttgaagtaaataaataatctttgctggcaggactatgccgaatctccttaagcactctctaatcagatatcctgagttgtcccaattcttagatcttttatacctgtttttctccttctgttattccatttagtttttcaattcatacaaaaccatatccaggccatcaccaatcattctatatgacaaatgtttctcctaacatccccacaatatcaccccgtaccacaagacctcccttcagcttaatctctccaactctaggttcccacgccgcccctaatcccgcttgaagcagctctgagaaacattgcccattctctctccataccaccccctaaaaattttcgccgccccaacacttcaacactattttgttttatttttcttattagtataagaaggcaggaatgtcaggcctctgagcccaagccaagccatcgcatcccctgtgacttgcacgtatacgcccagatggcctgaagtaactgaagaatcagaaaagaagtgaatatgccctgccccaccttaactgatgacattccaccataaaagaagtgtaaatggccggttcttgccttaagtgatgacattaccttgtgaaagtccttttcctagctcatcctggctcagaaaacacccccaccgagcaccttgcgacccctactcctgcccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacgcgcatgaaacagggtgcagtggctcatgcctgtaatcccagcactttgagaagccacggtgggtggattacttgagcccaggggttcaagaccagcttgggcaatatggcaaaaccctctctccctgtctctgcctggctaaaaaattagctagggatggtggcctgtgcctgtagttccagctaatcaaaaggctgaactgggaggatcacttgtgcctgaaaggtcaactctgcagtgagccgtgatcagatcactacactccagctcgggcaacagagggagacactgtcttcaaaacaaaaacaaaaacaaacaaacaaacaaaaagtgggtcttcccattaaagataagctcgaatgatcaagcatcccaatgaatgcttcgatgatcaatgatcaagattaagaatcccaggtgtccagaaaaaacgtgatcattaattccaagggactggtgaagaaagaaagaactctaggtcaagagccagagagagtggtcaggaagcaaacgtgatcgacaatgatgaaatccaataaagcaagctgtaggaagaggagcctgaaattatgacataacaagtgaatggaacacaaccaaattttgatacccagttcctgcagttagttgaggtggaagaacatgtccagagtggttataaatatcaaaatattcatagggagagattagcatgaggataagaaaatgccttttactagtagataatagctctatggtttgtacaaaggagagattctcctgtgaccagagggaaaagagtaatctcactccctggaaaaatttagatgaaagccagggctaatcttaagagcaagcaaaatagattgcaatctctgcagtgagatatatttttctacttcttcaatagttatagttttattctatattcttcttattttttcacttaataattaaatagctagtgcatttcacgtttctaaaaattaaaaatgtaaagaaaagttatgaatgggaaggaattcctgccactactctgctctgtttgttcagcacacctcccccaaccatcctcaccaggtaaccactttattgtgtatctttccaaatttccttcaagcatataaaataaaaaagcatacattattttctatatttgtctaccatttatacaccaggtcagcatgccatgcacactgtcctgtgacttacactttttatttaacaaagtatttgaataatctttccataatattacagaaatttgttgtattttacagttggacatcattgcattgtattgaaaacttatatttcataactagtacccttttagaggacatttaggttgtccctaagcttttccaactacaaataattatccaattaataaccttgtttaagaatcacatttggatgtgcaagtatattacagcaataaagtcccagaagtcaatgagtttgtcaaattctatttgtctttgtaattttgacaagaattagcaaattgccatccacagagatcgaaccaagttacaccctcaccagaaatggatgagagaacccatgttcccagagcccagctcaaaatatctcagattttttccattttttgctcacgtgatagattaaaaataggcattcaacaagcttttttaataaggttgagaattttcccgtatgttaaatatccactttgcattattttctgtgaactgtctgttcatattatttgtccttttctctgctgagttattagaaagtttgacattcaaaaattttaacaatctatttggcacgattcccagccagtggcaaaagatgccagcccaattagaagaagtgccagatgtaaacacctggcatgtccagagcaacacattccagtggaaaattagacctgatggttggtctttctccaggtgttttcagcatagaagagctgaaaatactgtttccaaattaatcttttatattttgactctgcttatgttattttttgaaaggcaattcacgtgttttttagataattaaattttcaaacctcttttatgccatctgcattttcaattaaaattttccactccaaatatttttagcaaattcttttattttgagtacatatgatttcaaatttttacatgtagtctcttaagacatttggatgtcatcctagtagacgttgtgagatataaatccatcattatttttaccagatagttattatttgtccagctatctctattgattaacccttcttcttccctaatgaaaacaatcttacccatatgctaaatttccttaagtattataacttatttctgcactttctattctatttcatggatctctatcacattaatttaattagtaagtctttataatatgttttaaatcttatatgtcttattctatcctcattgctcttcttttacaaagtttttctatttattcttgtttattttcttacattagatttagagtcagttggtatagtttctttcttcaaaaaagatgtaggtgtcattttcatatacttctcatgaaaacaaaaaaaattagaggcgaacttagtaatatctagcaaaattgcatgtgcattttaccttttgaacatgtcattctaattctagagacctagaccagatatttattagcaaaaacataaaaagacatatgcacaaaacaattcattgcagcactatttataatagcaaaaagctggaaagcctaaactactgtcaataggaggccagttgaataaaatatgtctacctacacaatggagtaaagagtagctgtttgtattgaggattatctctctatactattatggagtgatctgagttaagtggtatctaatgagtttttaaattttcctctgtttctctgagcttttacctattgtcacttgtttttagtgcattttgttttttatcagtggattaaatagtgattaatcccattttttctcaaaacaaacagctttcatatttattttacattttttctgtatttgaatgcattttggggttattttataatctctagattcggatgcttcataactttatttaaattttctttattgttatataactatttaagtctgtgcatttctttttagcactccttcagtgaattccatagttattcaatgtaatgtttttattgttttctaggaattctacaattccaggttgcattgtatattaattctagagaagtttaaaagttattgctttgtttgtttcttttaatttccagacagaagtacctttttattttctggttttgttatattttctatttttaccacatttcaatcagataaattttctatactatttacattttatggaatttcttgaggttgcttcatgagcttttaaatggttaattttcataaatgcaacaaggacacttaaaaaaatccattattcttatttttcagggatcaaagtttggtacataccaatcaaaggaacttttaaaattatgttatttatttcatcatagccttaaattttgtccagtttgatctgtcatagactaagaaaggtaaattcattcgcttgcagtaagtggatattttctcctttcgtcttctatattttctcagctacttctgtatatctccattttaaattcctcatattagcattacaaagggccttctcttcttctttgaataattgatggactaaattgcattttgtttaatatcttaaagtcaagatctccacattatttttatttgcatttggcctggaaatacatttgcccatttctctcccagattttctagattgtcttgctcactgatgtgatttttaacctagagttagtttcgtttatggtgtaatatgaaaatccatttcttttaatggatggataagtccattaatatttactgtttgtaagaataacatacccaggaatacaggtaactaggcaggcaaaagacctctacaatgagaactacaaaacactgctcaaagaaatcagaggtgacacaaacaaacagaaaaacattccatgctcatggatagaaagaatcaatattgttaaagtggccatattgttcaaagcaatttatagattcaatgctattcctatgaaactaccaatgacatttttcacagaactagaaaaaaaaattttttttaattcatatggaacaaaaaaggagcccaaacagccaaggcaatcctaagcaaaaagaacaaagctggaggcatcatgctacccaactttaaactgtactacagtgctacgttaactaaaatagcatgctactggtacaaaaacaggcacatagaccaatggaacagaatacagagcccagaaataaggctgcaaatctacagccatctgatcttcaacaaagcggacaaaaacaagcaacaggaaaaggactcctgatttaataaatggtgctacgataacttcttagccatatgcagaagattgaaaatggaccccttccttatgttacaagaaagaggtcccaatccagagcccacgggagggttcttggatctggcgcaagaaagatttcagggcgagtccacagtgcaaaggaaaagcaagtttattaagaaagtaaagcggtgaaagaacagctactccgtagaaagagtagggtgttcctgaaagtaagaggagaaatgcgtccacccaaagtacactactcgtatatgtaggataaaaaaaaagatcatggggagatgtgctgtgatacaagcctttgtgataaaggattaattttcttaatactatattttgcaagaattagtattattatctttaaagcaaaatcaggaatgcctttgttcttaagatattgaggtattaggacactcctaagtctggatctgtttagcaaacattatccatctgctcccttaaccataaacacctagaggctaggaatacctaacttctggaatgtagcctagcaagtcccagcctcattttcctggccctcactcaagatggagtcattctggtttcaatgcctctaacacttacaccctatccaaaaatcaactgaagatgaatgaaagacttaaatgtaaaacccaaagctataaagtccctggaagccagtctagacagtaccactctagacataggacctgtcaaagatttcaagttgaaaacaccaaaagcaattgtaacagaagcaaaaattgacaaatgggatctaattaaactaaagagcttctgcaccgtaaaataaattatcacatagtaaacagagacaacccacagaatgggagaaaatttctgcaaactgtgcatctgacaatagtctaatatccagcatctataaggaacttaaatgtataagaaaaaaaacaactaagaaaaaaacaaacaacccccatatggtttggctgtgtccccacccaaatctcatattgaattcccacgtgttgtgggagagacctagtgggaggtaattgaatcatgggggcaggtctttcccgtgctgttctcaagctgttctcatgatagtgaatgagtctcatgagactcatattttaaaaagggagagtccccctgcacaagctctcttctcttgtctgttgccatgtgagatgtgcctttcaccgtctgccatgattgtgagacctctccagtcacatgaaaccctaagtccaataaacctttcttttgtaaattgcccagtctcaggtatgtctttatagcagcatgaaaatgaactaatacaaaccccattaaaaaatggtaaaaggacatgaactttccaaaagaagacatgtatgtggccaagaagcatacgaaaaagagctcaacatcactgatcattagagaaatacagatcaaaaccacaatgagataccatctcataccagtcagaatggctattactaaaaagtcaaaaaataacagatgctggcaaggttgtggagataaggggatacttatatcctgctagtgggagtgtaaattagttcaaccactgtggaaagcagtgtggtaattcctcaaagaattaaaaagggaactactatttgacccagcaatcccattactaggtatatacccaaaggaatataaattgttctaccataaagatacatgaatgtgtatgttcattacagcactattcacaatagaaaagacatggaatcaacctaaatgaccatcagtgctagactggataaagaaaatgtggtacatatacacaatggaatactatgcagccataaaaatgaatgaggtcatgtgccttgcagggacgtgaatggagctggaaaccattatccttagcaaactaatgcatgaacagaaaaccagctacttcatgttctcacttataagtgggtgctaaaggatgagaacacacggacacatagagggaaacaacagaaactggggcctgagggtgaagggtgggaggaggaaaacgatcaggaaaaatatctaatgggtactaggcttaacacctgggtgacaaaataatctgtacaacaagcccatgacatgagtttacctatgtaagaaacctgtacatgtacccctgtacttaaataaatatgtgtgtgtgtgtgtgtgtatgtgcacgcatgtgtgtgtgtaatagttgaaataagttatttgggctttttaaataatttcaactattattttaaatttgggggtgcatatgcaggtttgttacatgtgtgtattgcatgatgctgagttttagggtagaaatgatcccatcacccaagtagtgagcataatacttaggtcattttttagcctttgccaccctccctctctacccctgctaattgtccccagtgcctattgtttccatctttagctccatgtttgcccaatgcttagctcccacttgtaagtaagaacatgtggtatttggttctctgttcttgcattactttgcatagaataatggactccagctgcattcatgtcgcaacaaaggacatggtttcactcttttttatggctgtgtagtattccatggtgtatatatacattttctttatccagtgcatcattgatgggcacctaggttgattccatgtctttgctattgttaacagtgttgtgatgaacacagacgtgcaggggtctttttggtagaacgattaattttcctttggatatatattcagtaatgggattcctaggtcaaatgctcatcctgttttaagttctttgagaaatctccaaactgctttaacatagtggctgaacaaatttacattccttccaagagtgtataagtgttccctttctccacagcctcaccaccatgttactttttgacattttaataatgtcgattctgactgatgtgacattaatatttgttgacatgcagatgccaataaacattgccctgccagaaatatctatctgttgcaccacttgggtgtgtgcttttagggggatttcctctcaagtttcagctattagctcttcaccatgtatttttcttttctgagtatctctgccgtactctgtacatagttctccctgtgagatcacatacactgtcagtaatttgttccataaaaatgctttttaaatctatgtaaggtgtacatcaatcaggtaatgaaacacattcttgtttgatttatgaaatcacactcaatgctacatgggacatttacccctctaatactggcctcaaggatacagtcttacatttccaccttccttggagatatattgaatattctgccttcgaatatagccaaaatgaattcaaaaatttctgccaaatcactgttctccaatatgaactccatattatcctcaaaaaaatatgtagcaaattgacagaccactgtcctttttctcatttcattccccttgcctagaaggctatattcgtgtatggagagcccactcatcctttaagatccaccttcaatttgaaacttttacttgctctcccagttgagcatattctcaccttctttagaacaaaatttgtttgggatacaccactgagttttgcgtttataaaattcatcatcgtcttgtgaattactttcctacgtgaacattatttttgcaattaaattgaaattatctcagaaaaatggaacttccttataattctatagatacatacttgacagtactattcaactgcagagattagacctcattaagagtttgtttataattatagcaccttagtgtaattcacctattcagtttactggttttagagtaattctgaaagaaatcttaatagagatattcggtgatgagcaaaaagctcatacgtacctagaagcaaagaagaggcagaaagaaaagtgtattagtcagggttctctagagggacagaactaataggatagatgtatatatgaaagggagtttattaaggagaattgactcacacgctcacaaggtgaagtcccccgataggccgcgtgcaagctgaggagcgaggaagccagcagtggctcagtccgagtcccaaaacctcaaaagtagggaagctgacagtatagccttcagtctgtggcagaagacctgagagccccgacaaaccactggtgtaagtccaagagtccagaagccaaagaacttggagtctgatgttcaaaggcaggaagcatccagcgcgggagaaagataaacgctggaaaactcagcaagtcagcttcttccgccttcttctgtcttaaagccaaggtgacagctgattggatggtgcccacccacattgtgggtgggtcttcctcccccagtccactgactcaaatgttaatctcctctggcaacacccagagacacccagcaacaatactttgcatccttcaatccaaaggattaaccatcacaaagagcaagaaacaaagaatggtaggaaagagaagacaacatactttgtttcactcatatttttattggagcaatcccttttcctaggtcaaaatttttagttatagaacatttaataaatctttgcatttacagattttttccaaaatcttataaaaatcttcaaatatgcagcaaagttgaaagaatttaaaataaacaccagtacattcacttcctaaatttaccactagtattttatttatttttaaccctgtatttactcatctccccgtcatcaagctctattcgttttaaagtaaatcacagaatctatattcttctgcttaagtacttctgaatgcagattataaagaagagtgcaatttttttacagcttattttcttttatttaaaatttactgcataccattatctgaccataccattatgtgacagctacactgggacagctctgtgcttaacaactggagatgcctagaaaagtctgggaccaagataaaacaagtgggttaactaacgattaatactgtgctgtttaattttcccattttatactttacacccaagaccaacttgtttattgatcgcttacacctggtgtaactggttaaatgtttactagcttggcaatgtgactaatcagcataaaagatccagctggaaagtttttcccggtctcatgaaactcatattcttcattccatattggtggcttataatccacagactaagagtgttatatgagacaaatccctgcggagctgtgcccaggagtctctctggcccccaggcttgcatatactttctttctccagttgtgccattcttttcaccttgattcaaggcttacatgagtattctccttgagggttttttttttaatctaatcttatagtttttgcatttatatagtatgaaataaataaagtgtaggagagatttgagtttcaataaatggatatagctggataacccaaactcctttcgagacataggatattatttttaccccagaatgttcccttatgccccttcccaatcaatctcttgaatactcccagagacaactcctgttctcttggtttgatttttctcgctatacttaggtttgcctatcgcaggacttcatatacacgaaaccatacagtacgtgcttttatggttagcttcttatgctaagcataatgtttttgagattcattcttgttgctgtatcaccacattgctgctttttattgttgaaaaatattttcatgtattaatataccacatattcattctcctattcatgtacgccaaggtttttttttacagtttaaagcaattcagaaaagagcagaatgatcgtaattataaaagccttttggttttcatttctttgggataaataacaacgataaaaaatgctaggtctcggccgggcgcggtggctcaagcctgtaatcctagcactttgggaggccgaggccggcggatcatgaggtcaggagttcgagaccatcctagctaacaccatgaaaccccgtctctactaaaaatacaaaaaattagccgggcgtggtggcgggcgcctgcagtcccaactactcagctactcaggaggctaaggcgggagaatggcgtgaacctgggaggcggagcttgcagtgagccgagattgcaccactgcactccagcctgggtgacagagccagactccaactcaaaaaaaaaaaaaaaaagaaagaaaaaaacgctgggtctcatggtaagtatattttgagttttataagaaagtgccaatactttctccaagtggctgctgcattttacattcccatcagtaatgtatggatttcagttactcaatatccttatccatatttaatgttatcagcctatttactttagccactcacatggatgtataatggtatcctagcatagttttaatttgcattttctgatgactaatgatactgaaaagtgtgacatatgctaaaaggacatttatacatgttcttttttcctatatatttaaaatattttgccaatttttaattgaattgtttgccttttcgttattgagttatagcattttattatgtattctaggtaacagtccttttgcagttatatgttttacaaaccttgtcacccatgctgtggcttgcctatacatatatttaactacaatgccttttggtgaacgtaagtatttaacaattttttaaagcctagtttatcaatttaacctgcagaagcataaaaagtaataaatcattgttgttttaaactgtaattttttgggtggtttaatatacaataataacgcacttgtctatatacataggttaaaggtaaaattttaaaaataagtttaaaaaatgagagatttgattcagtctcacccatctaaagggtgctgaactgataaaagctgaacatttttattacaataaatataaatcataactttcttatatattcccccattcaggcatgaatactaaggaattcaaattcttcatgcattatgcaaagactgacacagaaactcttgaaatctcacaagaatggagctccactttaaaattttggttggtactttttttaagtgctagctcttgataatttgtttgatgtagccaataacacttcttcaatgtgaaaaatcagtcgactaaaattatttgagtcacaaaaaattggagatgagatttatatagttatggttgtaatgtataataattatattataatgtaatatataatgtaatacaatcaattataatgtaaaacaatcaattaaaaagattgtaagagcatctgtcctcatttacaccaggggacaataataatatgatatgctcttattaactgtattaactaattaatgttaatgaagattgtgggtgtcttgtttttcttgagaagacagttacaaacttcaaagctgtgtttgacgcacttatatttgaatacaaagagattaacaaaatcaaaaatcttttgtaaataaattatattattttgtgttttaaaatttcatgtgtctctggaaaagagtaattttaaaaccttaagaacagtagagccatctaaatttgggggagatatggaaaaagtacatcctctaaaataattttctttaatttgaaatcacaaaaatatacagcctaataatgaaatgattatattatgtttgggataagttattaaagagtattcctttacttgggttatattaggttaagacttggtttttatcctgaaagtgtatactaggatccatgtccatccattcactccacaaatatttattaaatacccagctttatgccaggtgttgttaagagctctgcaaatacaaaaatgagcaaaattaaaaagtttttaccctcatggagctgactttataatgagaagaaggaattcttaactaaattatatagtggaaataagtactctagagacaaataaaacaggttaaagtgttggtgagtggtgaaagaagagggaacactatgtgctagggaaagacctatctgatagatgatgctcaaggagataattgaagggcatagagagccagccatttagcttgctggaggaaaagtggtccaagaaaaggaagagaaagggcaaaagcctcagaacaaaactatgtgcctatcttccagaaatccaatgaggctggcacagagtgacattagggatatatagctggggtcaaactatatcatatctcttagcgtactatagacttctttttctttttttcccgtgactgagaaggtaaaccactggatgactttgagtagagaagcgacataacctaactcttttataattcaccctttctgctccatgagcaaacatcaaggttaagaatggaaagtgtcgcagcaattaggagactagacagttatccacttaagagatgtttgtgccttggaccagcagggctagcactggacatgaccataatgtggctggataaacaagtctagagttcaagagagaagactggcttggagttctaaattcgagggaccataccatataggtggtatttaaagcttcaaaattggatgatacctctttctaagtggatatggttagaaaataaagtgttgagggagacagaggaagaacaagttaagaagctgtgaaataaaaccagaggttggaggtaaaacaggcaaatgctatgtatccgaagctaagtaaagaaagtgtactaagaagaaaggagagtcatctactgtgtcaaatggtgctagtaggtttagcaaggtgaggtctgagaaatgactgttggatttgtcaatatgagtgaaaggcactggtgaaaggaacaattttgatggtgtggtggggtaaatgcttaggggacagaccattcttccttagactttggggtaagaggggactgagaaatggagatgccaattgtagcagaaaaattggccagaaaaaggattttttaatgtaagaaatcataacactttcataagcagctagaaatgatgcaatggagaaaaagaaaaactgatgacctatgtaagaagaacccaacagtaaaacatcatggaacatttctctagattcacccaatccctgtgttccgtcttcagagctaactcttgctcttccttctgctgccaccttcgtggaatgacttcttttttaattttatttaattttatttattttttgagacggagtcttgctctgtcacccaggctgaagtgcagtggcactttcagctcactgcaacctctgcctcccgggttcaagcaattctcctgcctcattctccccaagtagctgggactacaggcacacaccaccacgctcagctaatttttgtatttttagtgcagatggggtttcgccatgttggccaggctggtctggaactcctcacttcaggcgacccactcgcctcggcctccaaaagtgctgggattacaggcatgagctactgtgccaggccctgtggaaggacttctgaagcctcattagttgcttctagctcttcatctctggctccattctccagaaatctatgcctcagtcctcctctcttgtctcagtaaagcatgccctcatccttcattagacaattttaaaatgatttcaccttactttccgaatgtatcctacacctattttgaatctaatagtcttaaatagtttagcaagaggcatttggtatgtgggtgcatacttttgcaatatttataagaaaatgttcagttttattcgcgctaactttagagccaagcaaagaacatttatttctttattagaaaattctgaaacgtggggatatagtttggatatttgtccctgcctaaatctcatgttgaagtgcagtacccagtgttagaggtagggcctggtggaaggtgtttggatctaggagcagatccttcacgaatggcttgggctatccccttggtgatgagtaagctctcactctgaattcacaggagatctagtcatataaaagtctgtggcacctcgcccacttctgctcagtctccctcatttgctcctactttcatcatgtgagaagcctgctcctccttcactttccaccatgattgaaagcttcctgagacttccctaaaagcctagcagatgccagcaccatgcttcctgtaaaacttgcagaaccacgagccaattaaacctcttttctttataaatttcccagttttaggtacttaattataccaatgcaagaacagacgaaggtacctagtaaatcatctttgggaatactcactagatttcccaagttcccttgatacaatttctccaataggaggtaatcattcccatgaggaggcaatactcacttctctccatattgtcacacactctatcccttgttttctaacctacttctcctcctctcctctcacttcctttttttaaaacagcaatcttttctgagtagaaaaggaatagtccttaactgcaaaaaagatatactagaaaatataaggaaaaatttaaaaagaagaaaattactgaaattttaaccactcaccatatttctgattcatttctctgttactttgcaacttgttttacaaataagaaatcacacataaaatttgcacttaaaatgattagaaaatgaccaccattttctaactataataaaaatactgttttacataactatagattttgtagtatttcattgtgcagacacaccacagttaagtttgaaacagttaagtagttgctagtattttgtcattataaaacatgtgttgtaagttgttattctgtaaatgtttatctatgttctttggagtgttccttaacgcatatatccagaaacacaaattctgagtcaaagcatgtgaacctaggctctgggtcatatgttcacacattatagtttccaaaaattcatgttttacatctttagtaatttgctaaaaatagtatactagagttatgatttatatactaattattagtaagcataatctctttcaaatttgattaaacgtttgcctttctggttttgtgaatagtttgagtgccttgtccagttatctgtggcttactttaaagtatttccccctctataaagtggtttaatgtcccttttattaagaaaaccaacaatctttcacattttattttaaatacattcctgtgttttttcttttaattccattttggggtttttaaatttgtttgtttctggggtttttggaggtttgtttgtttctgggtgtttgtttgtttgtttttgttttgttttgtttttactttagtgtcttgaaggtgtttacaaacagtaagatagagtggttatttttagctgtttggttttattccaattcataaagcttgtctccactcacaagttagataaatacctatctatattttctgctgttttaaagtttcgttttctatgtttggctttttcatccttttataatctattttgataaaatggagtgaagtgaaatcaaaatggatttttaaaactatctcatcaacattctcaggaatacattttgaaagatctatctctttcacctgattcacgaggatttatttatcatgcattttgttatagggtctggttccatgacagctattctaccctattgatctgccagtctatttttcaccagtaagtacaacagtttaatcatttaaattacacagttaattattctagttttatataatattttattatcttctaggactagaccctatatattcttcccttcaaaattttcaaaatgttttacacttgctactttgttcagataacaatgaagtctatttttattgtagttttgtatagtgattgagaaaatctactctaaatccaatttgcataggttcatatatcccagcttcattaaacactagctttataacaagttcacacgcctaggttcatacgctttgattcagaatttgtgtttctggatatatgcgttaaggaacactccaaagaacatagataaacatttacagaataacaatttacaatgcatgttttataatgacaaaatgccagcaactacttaactgtttcaaacttaactatggtgtgtctacacaagttatgtgaacactctttgcctcagttttgcttctgtaacttgagtataataatatacataccacatatagctgctgtgatgatagagtgaattattaaatacatgtaaggcacttagaatagtacctggcaacataatatagaatattatgtagagatattttctattattatttagtgacaaccactttgttaagttttatatgcatcctatcactgaatctatgtttgatcccagttctcaggactctccccatatgacttagtgatcttctgaaaactaatcaagttaaaataatttcatattttttcatgagcaaggagttccacaggggaaaatcctgagattcatttttccatttgtttcaattatttttataggctactgattctcttgactttccaaccaacagaatggaaagaagaaaaaaacaaatgctagtgtaaacattcttgttaacatcattcctagcttatttttattgaaacattgcattattatgtgtcttttgttgtggttttattcagtctataaaatagaattgtagaaatgactttgcactttctagtttgtctcaaatagacacccagatgtgaatgaaattctcttagttggtcctttgtgatacagtccgggctctcacttgttaagatacagaagatttaccaagagggcaggttaaaattctgactcagtaggtctgcacatttaataagcccccttccccaggtgagagaaaacaagtgatcccgaaggagggccacgaagggcagcatctggcactgcctataaccatggctgcttccttattaaaaaacaaagaggacagacttctcagattaagagagatgttatcagattacagtgtgaaacagaatgagtcagggatggaaagaaaatacagacacagctacatatgctactggtgctccagtaacagctgcttaaaatcaacagctgcattgtcaagcagggtctgaagatacttcttctccatgatgcagaatccctactgcagagatacagtctacttccttaatgccacctcttctctggtgtccacttatacgcacacacacacacacacacacacacacacacacacacccgcacaggctcaagagacagtggcctgttaaaaggccatataaaatcttagtctccactttactgtgggctctcaatagattctctatttgagtcaagcccttccctaatcaccccagagctctggattgtaccttccatgcttttccttcccatggctgactcttcattcagctatagtcatttcaagaggaagggaggaaaatcattagatctttctacatttcaatgtaagtatgagaacaatctctttcaaaaatatatccaggatcatatagtcaatgattccacactaattgagattttacctctggaaatgtcatcaccaatatgttattaaatatgaattaaactgtgcagttttccagtgggtcagcataaatgtcttctcttgcatacacgatatttcctttctctctccagtctcttctcctaccatcagcactatgttgtaatgaattccacatatcagtgagagccacggtattttgagaaccagtctagggcttaatgtttcagaaagttcagaaatagtgcaacatttgagtaagaattatgagtgaaatgggttctcagagaagtatcaatcatgtttaacttgcaagttaatatttccatagtctgacatgtttcaagtgtatgataagcttgtatagggagaaaatgaggctggggattttcccaaaaattggttatcactcattgaaattttttaatggtttaatattttcttagagttttacagtgcattcattgtgttctgttaaaaatattcattaataaatgatgcttaaggatagtaggttttaacacagtcagttttctgggcagtgataaaatagacttaggtaatagaactcatcattttcaactcactgaaagctaatggttttagtaaatgagttataagtttcactgaccaatttgcttcatttaaggaagaatctaagtaatagcacaaagagctgtgaagcaaaacttcaaagaaatacagaatgggtacaaaggattacatgaaaagacaatgaactaatactcaagcacaaaaagtggaattcaatgaacactaaaactcttaggtgtgaaaacaatcagctccaaacagaatgaagcagaaagagactccctttttctaaggccattttaaaaacactcgtgtgatattaactacccttgcaaattccaccaactcaggtaaacagttaggaaccagcaactgacaacatttatacatttctggagtaccatttagggaatataaatggagcctaatatgacattttaatatcttgtaaactattattatatgcaggaatcttccctttgatgcttgccatagtctagtcatttatatacacaataataatttacttttagtgactacggctttcctcatcctcatcttcattccatagactgatttcatgtcaatgaataccatggggctgtaaggtcactatcctagagttccaggagaacttcagagctgaaacagaaagtcgctagcatgttgtgacaagttcaacttccaggtggttgtggtacagtgggaggaatcttggactttgcagtcagaacttttgagttcaaatccaggttcttcaagtgtgcaatcttgagcaaatcacaccactctcctaccctgtttcctcactgtgaggtaatgatggtaactcctatcctgtagaattaaatatgacattatatgcaaaatatttgtgcttgtctaacacttgacatatagcaagtactcataattgtggcctaaatctaaatgttgcagaggttccagaaccttcacttaatttctactctcaatcaaacctaagaatttgtgtagacacaaatatagagagcaccactcttccactgcatacacagctttagtaaatgttctattcgttacacattgggggtccgcaaagacctggcatgtatttgatgtgcaggccacttattgctaggagaagtaattacataaatgttactgatttgaataacaataagaacaagcacaatgtgcaaggcactgttctaaatgtattacctgcattaatttatttaacccacacagtaagttcacaaaagaaaagaattaatttattttctgtgtctaaaggcacaagcaacaaaaagaatagaatcctttatgtcataaaaatgcttctacaataatgagaagcctgattctgtgcagctgttctttttgcatccccttcagctccagtttgttttaagaatacaggaatcactccaaatccaggatgcagagttccatagaaatggtccaggtggccagctgtttaaaagaggtgcatacagctagaactataagcttctcagctaaggaagaggaaacgtcaacctaatttaatcacaatatcattaatcaaaacaacttttccataaatcattggaaattataaacgaaaaaagaaaatttccttcctttcactttttactctttcttgattttatatatactgctaatacaggacttattttttacattgatgactggaatagtattttcttgaattctgccagatggttgaaaatattaagaagatctcagtctaagatatcagagaaagagacagaacaaagacaggctcatgttgagagcatttagtggcattcagcgatattttcaccctctaagtaactgtgattcttattattctttcttccccactaaactttcagctcttatataaaagtttcctgagattcaaaattttttgttttaagtataaagttttaaaaaatattattaaataatattccagcaagcagcagcattttctgtatttgtacattttgaaacataatgaaacaagaacttcataacagaaataagacattaaccaaaacatacaatgattttatagatcaacaaatttggaaaggcttatatattaaatattccaatatgataacaagacaatgcttctttctcataatactccttgtttcttcatatcaaaattttcagtgcatggttattctacttccgaaagtgcgaggttcattttttgttttctttttaattgtgataacttaatacaaattcaataactctgtaactatattgccactgcctacatttccacataaattggattctctttcattacataattaatttttagaagggaaattgtgtttccacatctcaaagtttatccattattgctaagaatattttgcatccatcaagttttaaatcattttagttaaatattattttagtttggaatgaagcaattcttagttgtttaagttattctgcattatatattaatacagttacaatttgaaatatacaatcaagagtttaaaggttatgctaaataagataaaactgagtcatattctaccttgctacatttggacatgcaattgtctttaaagccctgaattatagaaaatgattaagattaccctgatttaaaaatggatagtactgaagcataaaggaaaaatgtttaggcagaggaagatggggtggggtagtggcactaactactgggctctgcaaaggtccagtgacaagagagcttggggaaagaaaacatgatcccaaatagagggactgaaagtatttctggattaccaaagaaaagagttcaagtttcagagaaataaatgaaagattaggggagaggtaaacaaaagcagacttttagacactctgtaaccattcaaggacattgaacttcatcccaaatcagtggttctcaagcttgagtgtgcatcgaaatcaactgaaaggcctgttaaggcagtgtgggtacccgcctccagagttcctgatacagtaggctttgggtgggggcagagtatctgcaggtttaattgattcccaggaaatgttgatgctattgattcaaagacacgcactttgagaacctgttctaagagaaacctctgaagaactttcaagaggggagagacttgctctttggaaaactcacttttgctatggagtagaaaatagattcaggaagaggaaatgtggaggatgccaagaagcagttgctatagtaaagacaagacagcagagaaggaaaaaagcagagtccagaactcttgacaggtgaatgtcacagattgctctcaaggttctggcttgaacacctgagtgaatggttgacattatctgcgataacgctggcaaagggaccacttccagggagaggacagtgtgggacatgtaaaggttgagtgctggtggtattctggtaagggtttcatacctgttctctgtggggagaggaaagccctggtttgtagaccttgctaatttacatggggtaaacactccctctgtggccaatgtgatgtggcagaagacggaagagatgtgcagtaacacaccattatgtcgcattcccaccacaaagatgcaaagccaaattccggataggagtactgcataggagttgtgggtagactgaagagcacagtaagtcacagttacaatggcaattttcagtaaataagcaaaccacaggcaagggtctatttgtgacaccagatcacagtctaagtgagaccatgagtaaccaaggcggtaggagcatcagtctcaaaagatgtgcaaggagaggtgtggacaggggcagtcctcaaagaaaaggcagtcacaatggatatacaggagatcagtcatcagatagcaggctcctagcaacccgttatggttcgaggccagggttcttgtctccctagaaaagcagtagctagatttatgcagtgacttagtattaaggaatagagatattagctcacctaaaaaagagctatggtatgaggcaggagctgaagtaagataagaagggcattcaatgaatatgggttttaagaaaagtcgaaaacctagttgcccagactattgtccaagggatatcaccagcaaggacaaaaatgcccggatggataacactggtatgaatccaggcattggatcaggggtcatgctttccaggtaaggctaaaagaggtttttagaggctgggaatcaagcagaaagtaataattttacagctcatttaaactagtccatcttgattatcctgcagaacatctcgtcctcatgtattatcactgttcataggcaaacagtttttactcctaggacacagaagaagtgtgctttatttaaatgcagtttttgtatgtgttgcttatgctcactggttagtagatttcatgtataactaaaatataataaaccataggcaccatcaagtcctaaatacaaagagagagtctgagtgccctaatgtttttgaaactatttatttgagtagtcaaaaatcatcagtctaccttgcagatgccagagtaaataaattcaatgaaatcaattgcaaatttatctgaattgataggaaggaggaagcaggacaatgttgttttctatatattgcactcttttagactattttgcattaaaatcctgtatactcaactaaaaagcagaaaaatatcttggtctaattcatgtactgaaacaaatcattttactttcctattacttggatatttattgcacttacatcagtacaaattaatttaatttgtttcaaagcaataggaaatttcaaaaaccaactttatatatttccattaagaaaaaaactaatagaaggaactgtctatccaaaataacataacagactcaaggatttcagaacgcagcaataagcagaaaaaaaagttttgttttccctagcacttattttctttctttctctttctttctttcttttttaatttttaatttctggggtacatgcgtaggatgtgcacatttgttacataagtaaacgtgtgccacggtgctttgctgcacctatcaacccatcacttaagtattaagcccaacatgcattagctatttttcctgatgctctccctccctccactgcccccttccctgcagaggccccagtatgtgttgttcccctccctgtgtccatgtgttctcattgttcacctcccacttttgagtgagaacgtggtgtttcatcttctgttcctgcgttacttaccagcgcttattttctagcaccctttgttgtttttacctaattttggagaccatttctttaaaaagaaaaaaaaatcagttattccgtttggtttctatagtaacaaaaactaatttctgggtttctccatgatctatgatcatgttgaaaccaaagagcactcatgggtcttgcaaaattcataaagtcctgaacaaataggactgccatcttctggcatttgtctgaaatgactgataattgtaccaattctacattgtaatcataagatttttatcctcattttttcacctgctgttttttaacaaagcatgacatagtacctgatcagacagttcttgggtgacatcatcaacttgcaaataagccatttgtcccaaagggaacatgcagaagtgaggatgtcttaatataaatgtttattccagaaacttggaagagaaatacattgggttctgaaaggatcaaaatctttctgcttctttcaaggggttatttaatcgttttagaatcaaaataattcaaaacatgggttgtgcagttcaagggagatttcaccagtgattactattacagtgtttttctcttgtaggaacgaacagaaataggactaatggaagagggcatataggatctggagacttcctcccaccctttacagctgacagcagtgagttatgaggtgttacagagtaaaacagagttaccgtaagagctgtccaaataacttatgtccttgaatcacaacaccatcttcagaagataattcatgtcacaagtgaatgttcagtaatatggattttctccaaaacaccatatttaacaggcaacatcattgcgaggtgaatttaatggcagagtgcattatttaatagaattgaactatactctaacattcaacaagagctgattaaaatgtatgcatagttgataaagaaacttaaatactggatgtgaatagcaaataataatcagaataaaattttaagattcagccaaatcaaagattaaaaagagttaacattaatataattagaatttggatatatttcaacactatcttattattacagacataatattacattaaattttaaatgtataatgcagatgtttattctaccagaatagtttattgtagcaatatctattctttacaaaattaggcacacaaataattacttgaataaatgaaaggttttgtgaaaaccttaatttataaattaaagactatgtgtagcctgcccccaaaagtgagctagaatctgcttaataattgattaacttaaataactatgtaacattataatatgcaaagatagtagtaatacatcattattgattctatttcaacaatattaccactatttgtctcaaatctgaaaaagaccaaaatggatctttaaagtcttcttcccggattattgtctccacaagaggagagctggaatattataatcagccactgatcttggctttatgatcagtgtgacattctgtcctagtataaatccccaactctgatccattgttaagtgtatctggtttgtttaccttccatgtctaaagatatttctctgcaattggttatgttactatatttctctgtactctgttgatttcaagtttctctttctctgaaatttgagaattggtcagagtgcccttgctctctttccagctcaagtaattttccacctcacagattttctcaataaaagagttaattgtaccagccataaattttatagacaagcaatgattaaagtaaaaaataagcacctagtaaaattctatatatcatattgaatactctgtgtgttcaatttattgctaaactatcctttgcattcaccatcttcttcagttctcactccaataccctagttcaggttctcccagctatcatctgtattgttccaggcaataatctctaacttgttttcctcacaacttcttccttctacaaaccactgtacatgctactttcatagtagtcacctaaagaaacaattcttattaagtcaacaattgtacttaacttgcagcacagaaccttgtcttagtgtccctttcaaagcatgcattctgccaccaacttgccttctaagtcttatttcctcaattccatttgggaagtctatgctccagccaaaacggactcatcaccattcccaaggcttaacaattatatatctcccatatctccacttattaaattctaactatccttcaaggccctacttaaatacaaccagctcttcatgcctcttctgatcactcagcatcagggaaaactcaatccttgccctctcattatttatatatttcttgagatttctaatgcatttatcaaaatattacaactctctgtttaattcgagtcagctacctaatttattttatttaccctttcattcacaaattctataaacacttgagcagctactaaatctcggtccacatatcaggcactggtgatagagctatgcacatactagaacagatttgtgcccacacggaactcacattgcagaggaaaacagaccatagacaaggtaatagataaataaacaaaaagcctagatactgagacaagttttataaaggaaataaacttggttatataaatgtgaaagtttcttttaccttgggcagaagagatgattcatctgaggcttgaaaaatgaggatttaaagtggaggatggctctggattagatgctgtcagaaagtaaaagtaattgtatgattggatggacccagagtgggaggtggagcaagatggtggaataaaaagctccacccttccctctacaaggacgccaagttaacaattatctacacagaaaaaaacacctttataagaaccaaaaatcaggtgaacacttatagtatctggttttaacttcatatcactgaaaacatgcactgaagagatagaaaaaaacagtcttgagtcaccaacaccacctctcccccaccctcgtcagtggtggcatgatgcagagagcctctccgggtgctgcgggagggagaacgcaagaattatgaatcactgaactccgtgctgttctgtcagagcagaaaggaaaatcagaccaaactcagctgatgcgagcccacggagggagcatttaaatcagtcctagccaacgtgaattgccgatcccagtggtccgaactcgagtgctcacaaatgtcaccactcagggcaaaaaggcttttggtctctaagtaaacttgaaaggtagtctagattatatggactggaactctgagctaagcccagagacagtgaactgggaaggcaagaaatgtactgagacaccagctgggaaggctaagggagtgctggcatgaaccctcccctagccccaggctgcacagttaattactccagaaaagacctcttccctccacttgaggagaggagaggaaagagtgaggaggactttgttttggataccagctcagccacaccaggatagggcaagagtcagagtcataaggcccttttgcaggccgtaggtcccagatgacattttagacacaccctgggccagaaaggaatccactgccttaaaggaaaggacccagtccttccagcattcatcaccggctaactgaagagcccttggtccccgaatgccagcagtgatacccaggtactgcatcaagggcataggtgagcctctgagacttgctggctttaggtgacactcagcacattgccagctatggcggctacagggcaaaactccttctgcttgagaaaagcagagggaaagtaaaggagattagtcttgcaccttaggtaccaacaatgacactggggtatagagcaccaagtgggctcctggggtccctgattccagaacatgacattggatggcatttctggactaccctgggccagagagaggagctgccttgaaggatgagtcccaggccaggcagcattcacaacaagccgacttaaaagaccttggtccttaagagaacatttgtggtggtctggcagtactctcaaggccaggactggtagcagccttgggtaagtctcctctgcatttgaaaggggagggaagagtgggaaggactgcatcttgtggtttcagtaccatctcagccacaagataatacgataccaggtacacttgtacgttttttaactctagtaccagactcccgagtggcacttctgaacccacccagggcctagggaatcatgccacccagaaggaaaggacacacacctggttggctttgccacctgctgattgtagagcccagggctttgagtaaacatgggcattaaccagggagtggttacagcaggcattgggtgagacgcagcagtgttctggcttcagtctatcccagtgcagttgtagtggtggtggtcacaggggtatatgtgtcactcaacctccacctttagaggctcagaacagagacagatattttgtatgtttgggagaaaataagagatgagaacaaaagtctctgcctggtaattcagagaattcttctggatcttgcccaagaccatcaaggtggtacctctaggagtctgcaagaaccaaagtgttactgtgtttgcagtaccacctaaaccagaaaaaacttagatcataatacccaagtgctttcaaatatttggaagatcttcccataaaggacagctacaaataagcccagatagtgaatactacaataaatacctaactcttcaatgcccagacactaaagaacatctactagcatcaacaccatcaaggaagacatgacctcaacaaatgaactaaataagtcaccagggatcaatcttggagaaacagagttatgtgccctttcagacagagaattcaaaatagctgtgttgaggaaatgcaaagaaattcaagataacacagagaaggaattcagaatgctattgaataatacatttaagaaaaacagtttgaaataattaaaaagaatcaagcagaaattctggagctgaaaaatgcaataggcatgctgaagaatgtgtcagagtcctttaatagcagaatggattaagaagaagagagaattgatgagcttgaagacaagctatttcaatatacacagaagagaaaaaaaaaacaatgaagcacacccacaggatctaccaaatagcatccacagggcaaatctaagagttattggccttaaagaggaggtagagaaagagataggggtagagagtttattcaaagggataataactgagaacttcccaaacctagaaaaagatattaatctgcaagtactagaaggttatagaacaccaagcagatttaacccaaagagattacctcaaggcatttaataatcaaattcccaaaggtcaaggataaataaaggattataaaagcagcaagagaaaagaaacaaataacatacaatgaagctctaatacatctgacagtagactttttagtagaaaccttacaggccaggagattggcatgacatatttaaaggttgaaggaaaacaacttttaccctaaaatagtatgtctggcaaaaatgtccctcaaacatgaaagagaaataaagactttcccaaacaagcaaaaactgagggatttcatcaataccagacctgtccaacaggaaatactaaaggaaatacttcaatcagaaagaaaatgacattaatgagtaataaagaatcacctaaaagtacaaaacttactggtaatagtaagtacacagaaaaacagaatattataacactgcaactgtggtatgtaaactacccttttcctaagtagaaagactaaatgatgaaccaatcagaaatgacaactacaacttttcaagatgcagtcagtgcaataatatataagcaaaaacatcaaaaaagttaaaaaacagatgaagttgaggtgggtttttattagttttcatttggtttatttgtgcaaatagtgttaaattgttatcaggttaaaataatggatcacaagatagtatttgcaagccgcatggtaacctcaaaccaataaacatacaatggatacacaaaaaacaaaaaaagcaagaaactaagttatatcatcagagaaaatcatctttactagaggcagacaggaataaaagaaagaacagaaggccacaaaacaaccagaaaacaaacaataaaatggcaggagtaagtccttacttatcaatagtaacattaaatgtaaatggaataaactctccaatcaaaagagatagagtggctgaatagatgaaaaaaacaagacccattgatctgttgcctacaagaaacacacttcacatataaagacacagatagactgaaaataaagggatagaaaaacatatttcatgccaatggaaaccaaaaaagagtaggagtcactatacttatatcagacaaaatagatctcaatacaaaaactataaaaagaggcaatgatggtcactatataatgataaagaggtcaattcaacaagaggatatagcaattttcaatacatatgcacccaacactggagcatcagtaaaggaaatattattagagctaaagagagtgataggccctgatataataatagctagagacttcaacagactttaagcattggacagatcatccagaaagaaaataaaaaagaaaaaacatcagacttaatctgcactatagaccaaataaatctaatggatatttacagaatatttatccaagagctgcagaatacatagtcttttcctcagcacatggatcattctcaaggatagaccatatgttatgtcacaaaacaagtcttaaaacattcaaaaaattcaaataatatcagatatcttttctgaccacaatggaataaaaccagaaattaataacaagaggaattttggaaactatacaaatacaagaaaattaaacaatatgcttctgatgactagacagtcaatgaagaaattaaaaaggaaattaaaaattttcttgaaacaactgataatggaaacaattgagaaatgtctagatacataccatctaccaagattgaaccaggaagaaatccaaaacctgaacacaccaataacaagtaacaagatcaaagcttctcggtaaagaaaagccatcatgatggctttactgctgaattttaccaaacatttaaagaagaattaataccaatactactcaacacattctggagggaatacttccaaactcgttctacgaggccagtattactctgataccaaagccagaaaaaggcacatcaaataagaaaactataagccaatatctctgatgaatattgatgcagaaatcctcaaaaaataccagcaatcaaattcaacaatacaatggaaagatcattcatcatgaccaagtgggatttattcccaggatgcaaggatggttcaatatatgcaaatcaatcaatgtaatacatcatatcaaccaaatgaagggtaaaaaccatatgatctttcaatagatgctgaaaaagcagttaatgaaattcaacatcccttcatgataaaaatcctcaaaaaactgggaatagaaggaacataataaaaaccatgtatgacagacccagagctagtgtcacattgaatggggaaaaactgaaagccttccctctaaaatctggaacatgacagggatgcccactttcaccactattattcaacatagtactggaagtcttagctagagcagccagacaagagaaagaaataaagggacttcaaagggaaggaaagaagtaaaattatctttgtttacttatgataagatcttatatttggaaaaacctaaagactatctaaagactgttagaactgataaacaaatttaggaaatttgcaggatacaaaatcaacatacagaaatcagtaccatttttatatgccaacagtaagcaatctgaagaagaaatcaaggcaacctcatttacagtagtcatacatgaaactgaatacttaggaattaacttaaccaaaaaagagaaaaacctctataatggaaatttgaaaacattgatgaaagaaattgaaatggacaacaaaaaatggaaaaatattccatgtttatggtttggaaaaatcaatactgttaaaatgtccacactccccaaagcaatctacagattcaaagcaaaccctatctaaataccaatgacattaatcacagaaatagaaaacaattctaaaatttacatttacccacaaaagacccagaataaccaaagctatcttgagcaaaaagcacaaaactgaggaatcacattacctgacttcaaattatactatagagctatagtaaccaaaacagtatgatattggcataaaaagagacacatagaccaagagaacagaatagagtacccacaaacaaatctgcacacctatgaactcattttctgcacacctatgaattcacacacctgtgaactcattttcaacaaaagtgccaagaacatacattgggataaagaccatctcttcaataaatgatgctgggaaaactggatattcaaatgcagatgaatgaaactagacccctatctgtcactatatacaaaagtcaaataaaaatggattaaagacttaagtctaaggccacagtatataaaactactatccaaaaacattggggaaaatctctaggacattgttctgggcaaaacatttttgagtaatatctcataagcacaggcaaccaaagcaaaaacggacaaatgggatcacatcaagttaaaaaaacttcagcactgcaaaggaaacaatcagcaaagtgaagagacaacccacagaatgggagaaaatatttgcttatttcaaactacgcatctggcaagagactaatgaccaaaatatataaggaactcaaacaactccaaaagaaaaaaaaatcaaataatctgatcaaaaaatgcacaaatgatttagatagacatttctcaaaagaagacatacagatggcaaataggtatatgaaaaggtactcaacataattgattatcagagaaatgtaaattaaaactacagtgagatatcatttcatgacagttaaaatggcttatatccaaaagacaggtaataccaaatgaacagatgctggcaaggatgtgaagagaaaggacccctcacacactgttgacgaaatgtaaattagcacaaccactatggagaacagtttggaggttcctcaaaaaactaaaaatagagctaccataagatccagcaaacctactgctgggtatatacccaaaaataaacacatcagtatattgaagagatatgtgcactcctgtgtttgttgcagcactctttacaatagctaagatttggaagcaacctaaatatccatcaacagatgaatggataaagaaaatatagtacatatacacaatgaagtactattcagccataagaaaagaatgagatcctgtcatttgcaacaacttgtttggaactagacatcattatgttacatgaaataagccagggactgaaagcaaacattgcatgttctcacttatttctgggatctaaaaatcagaacaattgaactcatggacatagagagtagaaggatggttaccagaggctgggaagggtagcagggtgtgatgggggaggggggtggtggttaatgtatacaaaaaagagttagaatgaataagacctgctatttgatagtgcaacatggtaactatagtcaataataacttaattgtacattttttaaaagagtgtatttaggttttttgtcatgatgtgctcatttcacactgaatgcctgtatcaaaacatctcatgtatcccataaatatatatacctactatgtacccacaaaaattaaaaatcaaaaaaattaattaaaaaaataaactagaaccagacaaacactgtaattggtaaagaagaagcagctactcattttagcccggatagagggctttggagtaatttctgtggcttagacaatgcgcatgctttgtgttcagatatgactacaccgtggtattgttttctctctattcatcacagtcacagcactgccttctctgatgttaatgttctgccaaattgtttatgttcaacagaagaacactgaggtctagctaaggggcacctcctggatgtcaggcaatatttttgtctttctcacaggttattctatatagttgcagtggatttccatggcttaggtagttagtttgaatatacacaataagttttcccccacagctctgttaggacaacagcagctgctcccttagaggtaggtatacgcaccaagccttagacataatgtttaatcgctattgcataattgacacccaagaaggacttatcagagcccttctcagagaccatgtctgggtgagaaaatatctctcattcctctggtgtttttaacctagggctgcctgagattgtgtgaactgacacttgaaaaaaggatagaagtacatttttcttaaaagaaacagagataagaaattaatactaagttcagaagtcatctataggcttggatacagcttttcctaaagtcctaacccacccttagatttcccagtcatatgagacaatatgatttatgagtaaattctttatcaaattgcattttaattaaatttctgtcatttgtagtcaaacacatctagaataatgtataaatactgcatacataagtaaaagttccccattcaagaactgaaggttaactattaacactagtatgtaatccatcaacaagtcctggcatgtatactcccgtttatatcttatatttggccacttctccctgcatagcccccatgcagataaaagacattaatgatacatcattttcatgtgaaatagcagtaggttccttacttctctatttctttctactctattctccacactgcagtcaaaataatctttaataagtataaataataaaaatccattggcttggttaaaattcttcaaaacttccaacttcacctcaaatagattccaaagtctatcatgaccagaccactcttacctcccaaacctcatttcattttacccttcacctcttccactgtctcagccacactggcctccttttggcccatcaaatatatcctagtgttttttgccatcaagactttacatgaactacttcttctacctggaacattttcctagctactacagttccctcatccccatctctgactccctaggaatcagtcagatctccttaaggtgcaagtgatgaataaagcaatattgataataaaataattttcaaagcagccatactgtaagtcttcttctcatgcttcctctcaatttaaacaaaggcatttttcccatccccacacccacattgtcactctttctcagcactctattttttttaaaaaagcaccagtctcatgttataattataaatgatattttgggaattgtttcggtaatagtatctctcccacacttgtttataaggtctgtgaagactggactctttagctatttaacatttgcttctgtctatatttcttgcctagtgctccagtttccatttaatatagaaattcttaatgttgttccccaagattttccttctgcttcagcttgccagggtgtgttactgacaactaaagattcttataccaagtctatttttttacaccgtatactcaaactttaatagagcacctattgtagacttttcgttccataatatttgttaaaatgagatttttatgctgtttcttatagaaagtgtaaatctaagagctgttgctgtaatacttcaccaaaaaaaacctagaaaagtaatcaaatgaacatagttgaagacagactctatgcacaagttcaggcaaagaaactcattataagacttttttaaacctgaggcagagagagattttgaaatccaggaaactagtgattttgcatctagtcagacctcttatcatctggagattttgagattaaaatcaacatgatcaaatataagtagtcatagtaggccactgtgcagtgtaataattgattttcaagaatttcacaggcttaaattgtatggtttgtatatgctttccttattacttgagtctcctattacaatgtaaaaaatgttgtcttaagaaatttaaccttggagttccaaaatacagtgttcttaatctctaacatggatcacaacaaaagaaaaggaaggatgagctatcaagaaaaatgttctggcctgtaatcccagcactttgggaggccgaggcgggcggatcacgaggtcaggagatcgagaccatcccggctaaaatggtgaaactccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaagaaaaatgttctggacactgaagctgtacactacagcatattgctaagaaagctgtatggttgtttctcatggagacgttaagggtgagataccacagttctcctactagtggtttaggtgtcacctaacgctagataaagcctcacacagattatgattctagtaaactacagttgttgaaaacctaatgcaatgaatctgtaaggaaccactgggctcaaaattggtcatcaaagctacaatttaaatgccattttaccatgcaagatttagggatctgaagaggagaacctaagttaaacttgcaaaggacagctcctagttatcctgatgtgttctatttcacatttatcccaaggttgattatttctccccttactggtattttgccaatgtctacatctgggaaactttatttttgcttttttattacttgacataagaaagtaaaaaagaataacagaccagccatgtttatcttcaccttcattttctgtgagttaatgaaacagtctctccagatcaagaacacatctggtatccatctgttaaaaagcaagaattataattttagctgttctcactgctgtcgctttattatcccccagcatttttaggtaatatgcatcctaatgactaagagaaccacatttcagtgacaaaaagtggtaaatagtgcaaagtatgaaacttatagcattcagaatttcctagtttttcatacaagaactagatcggatagctaagtaatcacaacagcaaacgctacagctgatctaagtctctggcctatgtattctaatcagtcagcaatattcaaccataaaacatttgaattggaaaatatatgacaggttttttataaattttatatattactaagcagatttatcaattttgtgagtaccttaacactatctaagattatattgcatgctaactctttttttcctttttttttcactttgcgaaactatcagaagagaatacagtcattttttagttataaatccacagaaagggaaggaaaccttcatgcaggtataatgggaatcagtgaattgccttccagctacagtagaagcatggttcccacatcataaagtgactgctttaacctacaaaaagtattttcaggggcataaaaaattgcttcctgatgagcaactgtgagctttcttctcactataaaccacaaagtatttaagaataaggcaaatctaaaggcacaagcttctcatgtggctttcaggacaaagattccagttgcactttatgctcttattgtttctcctaaaagatatcatccaaatgatatattctaagaaactttaagctttgagaggccaaaaaaacaaatctgtcaaattctgtggattcctgacctggaggaatccatgtttatatctgtataacattgaagaggatataggcagagtataaaacaatgataaactcagtacttcatagaattggatcaattaaatctaatttctattcaaaagaagtgcttctgttttacatcaggtaagaaagaaggtcatagaataataccttgagacattccacaaaatgtttccatcttttattttcaggttctctctttatctcccaacccagtaccattcaacactttatttatattatttacaattacttggtgagcaccaactacattaaactacattccaggaactacgtaagccttggggatatagtatacacagacaacaccctgctcttataggatttatatttaagatgaaggagaaagaccatacaagtaagtaaagagactagataagtgctataagtacataaatcaggacaaaatactgtgatgaaataatctggttgggcacagtggctcacacctgtaatcctagcattttgggaagccaaagtggatagataacttgagcccagtagtttgagtccagcctgggcaatatggcaaaaccctgtctccacaaaaatcacaaaaattagccaagagtgatggcatgcacctgtagtcccaggtactcaggaagctgaggtgcgaggatcacctgagactggggtggtcaaggctgcactgagtcaagatcatgccactgcactccagcctgggtaacagaattagaccttgtctcaataaaatacacgtatatattttacaactgatctgagagtgctactataaattgatcatggatagccttttccgcaaaagttagccatgtgaatatctgagaaaacagagctacaggcacaagacacaagtgtaaaggcattgaagtgggaacctttttatgtgcttaaggaatataaaagagtgctggtgagactgcagtccagtgagctaagtaggaaatgaatttgaaaagagagtcagggatcaaaatgtgtagactaagcaaacagttttcactttattctaagtgtattgagaagcaaagatgtgacatgctctaatttaggcttatcatgatttctgtttgcagtgtggaatgtggatttaatttgggactgggtgaaagcagggagattagttaaaatgttgttgcattgatctaggccaaaaaaaaaaaaatggtcacttgtgtgtgacaaccatggcaatgaggagatagtgaaaatctcaggatatgcatactttggaagtagagtcaatcaacaggacttgctgataaattagatgtggagaggcagaaaatgaggaactaaaaatgacacttttgaactgagtttgtgttccttcagtaaagggtagaagtcatgacatttactaaaatacagaagaaaggatcaagtttgagaacaatgagttagctgcagacacattaactttgagatgactgaaatattcagagcagatgtcccagtagacagaggaatttgcgggtctaaaccatagctgtgccctcttcaagcctccagccaacacccttgcccattgcctcttgggcaaatcagactctgagctataatttgaaaatgagtgttacaataactcaacaactgcaacccttttttctcttctattttcttaccctttagtggaaatcctcctttccttactccaaaagagttggactgttcagctcaggacactagaacgtatttcagcatagctttgagacttcaaatgattcattagttgatcctaaacataccaacactatgaaaaagagttcactcctatctctgttgtcttgataatgactgatggtgagtgcacttccattggactcccttagtttatacactgattttgagagacccaaacacaactcatctctagttggttaattctacttaagtcttacgttcctcttcaaagtcttcactacaaataaaaacagtaaacaatgtcacgtttatttgtttcataagttttgagccattttatgaaacaacttattgactgcaatgataaagaacggtttctagagttctctacaaccttcataaaagaatgcatcaaacacagctaacagtctatattaaaaaaagagaatgctctttgaaatatgtaaaagctatcatatataacattttgcatatacttccctgataaagaaaaacacccaataaaataagctctcattagttacatttctgattttttactctatgatttttttttgcttaaaaaagccaatttctgccttttcacaaggaattgtatatatagaggcaattcctttgctatacctgttcttgtttttgtctcttaccttctatatctaattagcagatctacaaaagcttcactgattattatttgcagtggttattattattcctaggagctcagtgcagaaatcttaattatttatatttttaaaaatatattctttatttttctttaatgattattagcaagtgacagagacactaagaaaaatattgatttcatatactttcaggtaactgactcaattaagaaaagaatataaaacctgtactaataaaataatttatttgtatttaacctagccactaggatctaataggagattttaacctgtatcaacaagaaaatattcagataagatgaaagtttcaactaaccatatagtggtttcatatgaacaccaaatattaagaaacagatgatacgtgaatattttgttttctatgcaagtgttttgacactccgtcaaaatactattgtttttaagtctctagagaacaagaatgctatcctaccataaagtatgtttgcaaaaaggaatgaaatattgtctttaaagatcaatcaagtgcagcaatttttgcttcaagattccagacccatcttttactttgccaagcaataattacatcatgaaacttgagttaagacacatttgtcaccacttttgcagcctttctattagaatagcttgagagtgattatactaatatatattaaatcctataatacagtttttaaaaattacgctccaagaaacaccttatctaacaatagtttaatcatttcagaagacagttacatcaacataaaatcatgcaagtaattcctataatcgacaaaacatgatacatcaattaaactgttaaagcagagtagacttcacacattgaattaaaactctctcaaaaaagtaggctgaaaggacaagattttctgttttcataaaataagcagttgaaatcaaaccgaggattttttcagtcaaaacatttgtgtctgaaaagagcatcttcaatttatttcatttctctctaatctttacagatttcaagtttcctaaatgtgacttttctcccgtttgtaaacaaataaaaatttacattcaaatacaattatcaacatccttcatagtgaagacctaggaaaggatgttgaatttgaagttgttggtgatgccccagaaaaagtggggcccaaacaagctgaagatgctgccaaaagcataaccaaaggcagtgatgatggagctcagccctccacctccacagctcaagagcaagatgatgttctcatagttgattaggatgaagaagattcttcaaataatgccgacgtcagtgaggaagagagaagccgcaagaagaaattagatgagaaagagaatctcagtgcaaagaggtcacgtatagaacagaaggaagagcttgatgatgtcatagcattagattgaacagaaatgcctctaaacagaaccctcttcctatttaggttatctgggcagaaccagattgttaggtcctttgttgcaaagagaaaaaattgacaccagtgacttgaaaatgattctgctccctttcaaagcattcattttgctagaactgttagacacattgcagtatgctgtattgaaagtgggaatatagttttaaaaaccctttgaacaaagtgtgtgcataaccagtcatgagataaaacaacacaatgcatgttgcctttttaatgtaaatacccttaggtatcattaatagtttcaaaatattgtggtttagtaaagttgatacctggttataaatattatgcctttatttttggctagaagaataattatttttagcctagatttaaccattttcatactcttagatgattgaaacagattcaaagaagtatcgagtgctatgcattaaaacttgtttttaaatgttaaatggcactatgtatattaatgtaaaacaatgttaatttactcaagttttcagtttgtactgcctggtatgtctgtgtaataagccaatttttgtgtattgttacagtttcaggttatttatattcgatgttttgtaaaactcaaataacgactatacttacggaccaaataaatggcacctgcattcttgttttaaaaaaatacaattttttgtaggtgcttctcagattttacgcctgtaatgcagttttataaactaatacttataaactaatgtttattacaagaaaaaaattattcatgctgcactgattttttatttattaaattaagaagtacaaaatacatgtgatttaaataaatagaataagtgcaatcaataacttctattttatcagtgaggattcactcattaaaaggcacaacgccaaaataaattcaagaatattcattttataaattttgggatggaaaggaaaacgtgattccgagatagaaagggggaaaaaatcctgttggaattgcttctaattttatttgaattaaacatattatttctttaaaataagaggagacagcaatgccaatacatcaagtacaattattaattccacagtttcacacaatcctacaatccatgtgttgccaaatattgtcaaagatttaaagaaatttatcatcaagtcccatacttataaaatctaattatttaaggtttaaaataatggaatgaatattaattaaaaacagaaaaaattaaaatcatgttagttttaaaaattgtaacaatcacaacatgggtttggttattatttatggtattgttttccctcatacatacttcagttggcattcatctaccactatcaacttgaaaaacatacaataaaggaagagctaccattttagaaccaaaggctcaagtctggcaaactgttctcatgcgtactttagaaatctaattggcagaatatagttgagacgataatattaatgctctaaataattctacgataggatggtatgtcactgaatcgaaatacacctgactttgtaaatttgaaaacttgttttctaataaaagaaaattattctatttttatttttagtttttgtgggtacatattaggagtatacatttatgggatacatgagatagtatgatataatcatacaatgtttaataatcacatcaggttatatggggtgtctatcacctcaagcatttatcctttctttgttttgcaaacaatccgattatactcttttagccatttttaaatgtacaacaagttatcatttactgtagtcaccctgtaatgctatcaaataacagatccctttcattctaattttattttgtacctattaatcatcctcacttccccctccccttctgctacccttcccagtctctggtaaccaacattctactctctaactccatgagttcaaatattttaacttttagctcccacagataattaagaacatgtgaagtttgtctttctgtgcctggcttatttcatgtaacataatgacctccagttccacccatgttgttagaaatgacagaatctcattcttttgtaaggctgaatagtactccattgtgtacatgtaccacattttgtttatccatttcatctgtcgatggacacttaggttgcttccaaatcttagctattgtgaacagtgctgcaataaacatgacagagcaggtatctcttcaacacactgattgcctttctttagggtatataccaagaagtgggattgctggatcatatagtagctccagttttagttttttgaggaccctccaaactgttttccatactagttgtgctaatttacattcccaccaatagtgtaccagggttccctttctccacattcttgccggcatttgcctgtcttttggatataagccattttaactggagtgagatgataccttgttacagttttgatttacatttctctgatgatcattgatgttgagcaccttttcatatgcctgtttgccatttgtatgtcttcatttgagaaatgtgtattcatatattttgctcatttttaatcagatttctaattttttttcctctggagttgtttgaactccttatatatattctgcttattaataccttgtcagatgagtagtttgcaaatattttctcccattctgtgggttgcctcttcactttgtgcattgtatcctttgctgtgcagaagctttttaacttgatgtgatactttttccatttttgctttggttgcttgtgcttgtggggtattactcaagaaatctttgcccactccaatgtcctagagtttccccaatgttttcttatagtagttccatagtttgaggtcttacatttaagtctgtaatccatttttatttgatttttatatatagtaagagatatttgatttttatatgtggtgagagtctagtttcattcttctgcatatggatattcagttttcccatcaccatttattgaagagactatcttttccccaatgtatgttcttggcacctttgtcaaaaatgaactcactatagatgtatgaattctgggttctgtattctgttccattaggctaagtgtctgtttttatggaagtaccatgctgtttcggtttctatagctctgtagtacaatttgaagccaggtgatgtgattcttccagttttgttttttctacacaggacagctttggctattgtggttccatataaattttaggatttttttctgtttctgtgaataatgtcattggtattttgatagggattgcattgaatgtatagattgctttggttaagttgaacattttgataatattgattctttcaatctatgaatgtggaatatctttccattttgtgtgtgtgttctcttcaatttcatcaatgttttatagttttcattgtagaggtcatttattttgttaatttctaggtattctattataactgtagctattgtaaatggaattactttcctgatttctttctctgctagttcattactggtatacagaaatgctactgatttttgtatgttgattttgtatcctgcaaattaactgaatttgttcatcagttctcatagttttttggtggtgtctttaggtttatccaaatataagatcatcatctgtaaacaaggataattcgacttcttcccttccaatttggggatttctttctttctttctttctttctttttttctttctttctttctttctttctttctttctttctttctttctttctttctttctttcttccttccttccttccttccttccttccttccttcctttctttctttctttctttctttctctctttctttctcttttctgatttctctagctagggcttacagtactatactgaataacagtggtgaaaatgggcatccttgtagtgttccaaatctaagagaagggttttcatttttcttcattcagtataatactagctgtgagtctgtcatatatggcgaaaattgttctttatttgaagctaaaaaagaaaaaggtgggcttgagggtagtaaaattgggtcatctgtgactttattgctgatttggtattttgaatcattgcacaggtgaaataaaatattcctcacaaatatttagtgggattctagcttagactaaaaaaaattatataattactttgtgttagtaaatggaaaggatgtaattatgagataatttaaatagaagcttttctacttgacaccaaaatggtgctctaagagtactgtagaacttgcctccagaattttgtgatttttggcctctagtgtgttgctttccacgctgattttattaagtaatattttattaattaaaaagaagccaatgtagtatactaaaactgagttcaatgtaaagtgaataaaaatcatttaaagtgttcaaacatttatctctgttttctatttcttgaattcattctctaataataaattctcttgggataaaatgtattctcttgtcctgtgcaatgagttatgtcaaaccattctattcaaacagtactacattttattaatatgcttctaggcaaactgccaaagaagaaaaacaagttctaatttttaaatactctagacagcttattatagcttaggctgaaatacaaaactaaggcaggcagatcaagcacacctacattccagtgtgcacttttatatggcctttcttaattccaagagatgtatttgattaaacacattagcagaaataataacactgctattagtaatttgctatttggataaatctgcctttaaaataagttagacatgcacactaaattcaatttgtcattgcatttggttatttatatacctaatgccatatggctgtttgaccaggctctttctgctttgcaaaggagaatctttacccgtcgaaaaacatgaacttacgaggataagaaagtctaacggaggcaacaaggtcatattaaaatgacttgtgggtttttttctcctgcttctttactctcataggaccatgattatatagtcttccttttaattcatgcacataaataaacatattccaaatggtataagatggattatactgctgagaactttcttacactttttagcttgaagaatccaggagaataccacacacgagatgcaaatagatagatttctaacacccagcagaaaactaaaagttttaagatacccatgtttctcaattaaattttatcagcatatgaaaaaaaacaatttgaagattctcatacttgttttttcagatttgattatctacaacaccaagatacctcaaatggttatgaatttcccctttcaaatagttctgttaagtatcattaaatattttgtaaaatatgttttaggttcctaagtgggttaaatttacattattcatccaccatgaagaataatgagtaattataatctctttcttgcccaaaaggagagttagttcccagaaatgaaatcctggttaagttttgctgtataccacttccaacacaaattgcccaccacagattaaaacttggctctgtatgtaagaatatgtcctgtttgaaattgcagtaagatacaacatatgggaaaaaatggagcacttggaataacttggcaaaataatttagaaaatgaaatgttataaaatgcaatgtataagtaatgttttctctaatgatcatttaaagatgcagttataacaagacaatcttttgctctcttctttttattctgttatagctttacaaaaatgactttctgcacggaagctgatctatttgctcacgcctttcccacttgttttgaaaaagtctaagaaaaacgtacttatatatatattattttactcaaagttgaaatacacatgcttactctttcttaagagaggcctaattgttgaaatatttcatttctcagaaacttagtgtaaatattttctgagtgagcaatgaagccagtaaaaaatattcataaatggaaatattatacttatttaaaactcattaatgattttaaagctgtataggatgatataaacatttaaaacttgttctaacaagcaaatagtcaaatgaaatatgtttcaatatctaaaaagttccattaatttttattatcttcctccttttttaatatagcatgcacaaaagggagaaagaaatttaggagcaaaaattatgctcccaccttttatatatgaaatttatttttatacaggtattcacatgacctagaatttaagctgctatctttccctaggaaagacaaaggcaaactgagagaaccattcctttttgtcctccactgtcaggtaacctgtgcatttcagtgaggaaaatgttgacatgcatactcctgtcttttaatgaattacttgaattccagactcctgggagtattgactgtagataaaatatatgaatttaaagtcaaacagataaaagttcaatagcaagttcttccatccttatctgcctcaaatataggatgggaaccagaatagcttctgccttataagctattatgatgcatccctataaaataatatggcacaggtctgccacataggacatgtttaatcaatgtttattattactttgttacatgagaacaataactttaaaatataatgataaatgctatcttcactgaacacttacttcaggctttgggtaagtaccttacatgtgttgcataatttaattctacaatgttattaatccattttacaaatgccatgattgacaggtatcggttcctgattcaaagtattccaaggttacttttttttgtatttttttaacaactcctggtttaaagaggagattcacataaaagggcatatatatcttgcatatacattaaaaataatattttgtggatatttctctgttatggcagatattaccacgttagacattttttctgaaatattttcttggattaagatattactagattgagttacaaaaatcaataaattaattacatttttcaaaaggctatttcaatttatgtatgtttattttaacagatctgatatttggcatttttgttctacttctgactaataggcatcatcagtttgattcatttctgtagtgtgatttcataaataaatgttgagatttatttcttttaataataatattattattattagttttgagacagagtctcgctctgtcgccaggctggagtgcagtggtgcgatctcggctcactgcaacctccacctcccaggttcaagcgattcccctacatcagcctcctaagtagctgggactataggtgtgcaccaccatgctgggctaattttttttttttgtaaatttgtagagaccaggtttcaccatgttggccaggatggtctcaatctcctgacctcgcgatctgcctgcctcagcctcccaaagtgctgggattacaggcatgagccaccatgtccagccttaatattatcatttgataataagaacaatgaaatcttcaaatacccagaaacaaatataaatatttataaatataaaagtgtaaaacaagtgtatacaaattaaatatatgaaaaattcaacaaatgcagaagtttaaaatctaattttaatatgaaccaaatatcatactgtgtgtgtgtgggtatgtgataatttgcacacaaaatgactaatgatatggtttggctgtgccccacccaaatctcatctagaagtcccatgtattgtgggaggtaccaggtgagaggaaattgaatcatgggggcaggtctttcccatactgttcacatggtagtgaataagtctcataacatctgatggtttcataagggggagtttccctgcacatgctctcttctcttgtctgccaccatttgagacatgcctttcaccttccacatgattgtgagggctcaccagccaggtagaattataagtccattaaacctctttcttttgtaaattgcccagtcttgagtatgtctttatcagcattgtaaaaatggattaatacagtaaattggtaccagtagagtggggtagtgctgaaaagatacctgaaaatgtggaagcaactttggaactgggtaataggcagaggttggaacaatttggagggctcagaagaaaacaggaaaatgtgggaaagtttggaactccctagagacttgttgaatggctttgacaaaaatgctgataatgatatatatggacaatgaaatccaggctgaggtggtctcagatggagatgaggaactagttgggaactggagcaaagatgacttttgttatgttttagcaaagagactggtggcattttgcccctgccctagagatttgtggaactttgaacttgagagagatgatttagggtgtctagtggaagaaatttctaagcagcaaagcattcaagaggtgacttgggtgctgttaaaggcactcagttttaaaaaggtaacagagcataaaagttgggaaaatttgcagcctgacaatgtgatagaacagataatcccattttctgaggagaaattcaatttggcagcagaaatttgcataggtaacaaggtgccgaatgttagtcactaagacagtgggcaaaatgtccccagggcatgtcagagacttctgaggcagcccttcccacgacagaccagaggcttaggtggaaaaaatggttttgtgggccaggcccagggtccctctgctgtgtacagtctagggacttggtgccctgcatcctagatgctccagccatgactaaaaggggccaaggtacagctcaggctgttgcttcagagggtgggagcctaaagccttggctttggtgttgagcctgtgggtgcacagaagtcaagaattgaggtttgggaacctccacctagacttcagatgatgtatggatatgcctggatgctcaggcaaaagtttgctggaggggtgagaccctcatggagtacttctgctagggcagtgcagaaaggaaatgtggggtcagagccccacacagaatccctactggagcaccacctagtggagctgtgagaagagggccaccatcctccagactccagaatggtagatctacaaatagcttgcaacatgcacctggaaaagccacagatacttaacaccagcccatgaaagcagccagtagagggctatactcgcaaagccacagacgcagagctgcccaaggctgtgtaagcacacctctggtatcggcatgacctggatgggagacatggagtcaaaagagatcattttggagctttaagttttgactgctctgctggattttggacttgcatggggcctgtagcccaccactttgttttggtcaatttctcccatctggaatagctatatttacccaatgcctgatccccattgtatctaggaagtaactaacttacttttaattttacaggctcataagcagaaggcactcgccttgtctcagatgagactttggactgtggacttttgagttaatgctgaaatgagttaagactttgggggactgttgggaaggcatgattggttttgaaatgtgaggacatgagatttgggaggggctggggcagaatgatatggtttggctgtgtccccactgaaatctcatcttgaattcccacgtgctgtgggagggacctggtgggaagtaattgaatcgtgagggcaggtctttcccatgctattctcatgatagtgaataagtctcatgagatctgttggttttataagggggaatttccctgcacaagttctcttcttgtctgccaccatgtgagatgtgtctttcactttacatgtgattgtgaggcctccccagctacctggaattgtaagtccattaaacctctttcttttgtaaatcgtccagtctcagatatatctttatcaacagtgtgaaaacagactaatacaactaatatgcagaatctataaggaacttaaacaaatcaataagaagaaaacaaccccattaaaaaagtgggcaaagacatgaacagacatttctcaaaaaaagacatacaggtaaccaacaaacacgagcaaatgttcaacatcactaatcatcagagagaggcaaatcaaaaccgtaatgagataccatctcacaccagtcagaacggctattatttaaaaagtcagaacacaacatgtcagagaggttgcagagaaagggaacgcttatagactattgttgggaatgcaaattagttcagccactatggaaagcagtttacagatttcccaaagaactgaaaataaaattgccacttgacactgcaatctcattactagggatatagctaaaggaaactaaattgttctaacaaaaagatacctgcaatcatatgtttatcacaacaatgttcacaataacaaagacatagaatcaacccaggtacccatctatggtggactaatgacattgtggtacatatacaccatggaatactacacagccatgaagaaagaatgaaataacatccttttgtagcaacatggatgcagctggggccattatcttaagcaaattaatgtagaaacagaaaaataattcatgttctcacttacaagtgggaactcaacattgggtccacatgaacacaaccatgggaaaaacagacactggggactccaacagtggggaagggggtggacaagagttgaaaaactacctgttgggtactatgttcactacttgggtgatgagatcattatgagcccaaacccagcattatgcagtatactgatgtaacaagcctacacatgtaccctctgaatctaaaatttaaaaaaataataataattttcacagataatcctctacctgcttagtttgttaacagagctattaagtgttgactggatctccaaaaagaaaagctcgatatttttaagttagttaatatctctgagcctcaatttcctaatctatagagataataacagaccttcttcagaggtaaatttacaatgaaattaataaagcctaagttcagggttctaacaatgtgttcacatgatctgttgtttctgcaaagttttcaaaatcgtgtactctttcaaataaagatgccttacccacaatcgcataacttcataccttgccaaattagatccttctcttgttcacctcagtgattatattgatgattaaattagatagtaaatgtaaagctttaggactatgcctataacatagaaaatacatgattagtgttcactattattattattatcaaatattttagtttgtatttattcttctaattgttatatacaattgaatatgttacatcttaaatagcatgagttatgggtgtttaaggaaaagcttagtatactaatagagtcttctcaaatctggagaaagaaatagtatgaaatatattgatttaaatgttagatttattgatacatgcttttaaaaatggtagcttttaaactgtaatcaatacatttgcattttcctaaaaaaagaagacatttgttcagagaaaactgtggtatcatgcaggaaaagcagaaaaaaattgcctaagtgtgatcccacatacttgtcagttgggtattgcaagagaggatgagtaaatggttgaactcactggaattacacaaatcttatcacatctatacacaatcatccaaatattcgaggatttagcaatgtatactaagatggccatgcaaacttgtgagttgtagctttgcaatttgggacatatgatacctattttacattcataatgtaaatcatattcatatgatacctattttacattcataatataaattatattcatatcatatctattttataattcataatattaatttcattatatctgttaatcacatacttagaattacagatatgaattatttctataaattatgattaatcacagaatcacaataaataccaatttgattaagctccacctttgaattttttcttattttcttaaaatgaaggacgtgtgtgtgtgtacatatatacatatacatatatatatacacacacacacacactcatgcaatagttgtgaattgaatgaaattcaccaggacaatctgacttgtatttcaaataataggagtttgaatattaccctcactgaatcattgagtcaatatagaaatttatttcatgcttcaagataaaacaaaacctaagacaaatatgctagaactggctttagcaacagcctaaatactaaagcaatgttaaattatacatattgcattggtttggggatcatcttaaatgtgaaatatatataatgtacatgtgtgtacatgtgtgtgtgcaaatacatatatatacatatatgtattatatgtagtgatttaaagtcttttctcatattctaattattaggaaatgaaaagagaaaaaataaagtctagtgtagagaaaaaatgtcttgcattttctgagtcaatcatgcaattgcctaataaattagctaagcaacagcaagttctgatctgccgaataggaattttaacagttactaagttctctccaggtagtgagttgaatggccaaaatcacagtgccatttcctgcttcatgctgtgcccatttagtaaaacagaattggtcaccatgttcttagcattgcttttcagagatgtcatacgcaccgctgaagagctgagtaggtagctggttcctctctcttgataggacttcctcccacagcagagttggctgttgaaatgcctcctgaagctttcactgagtaggtaaagagcaaatgggttgacacaagaattgccaaaactgagaacccgggcaactaaggtgacaatcatgtggcctagagatggatcaatctcattatagttgaaagaccgatacatgtaaaggatgtggtttggaaaccaacagaagatgaaacagcccacaaagacaagcacaattttagccaggcgtttccgtgtttccatctgcaaatataagaaattgatcccattggttaaagtgaaaatggaaccagccacataccaactttatcaagtcaggaaagagcaaaatttacagcatgataatacatccaaaatacataaattatttattttcctcaccaaagtgatgatggattttaacagtttgataagcttattttggtctctacattatttgcattaataaatatttgacagcttatacaaaactaagtggtaaattactaaatgctgtcttcatattatttatttattttctttttgcttaatgtctcattgtgtgtaacataaatataagtcatttctgtttgtattaaatccactaaattaataaaccatagaatatattcaagcttaggtgttttaaaaaaatcagggtgttttaaataggaaaaactgatctgatgaagcagggcttgctgtttaaaactaccactccacaggaaaacaaaatagcaacttgaaatttaaactcctgacttacacaaatcaaaagcatctgatataaccgtgaatcctgtaaacattattatattgtcacattcacaaataaaaataaattttccttctccataaaatttacatattatgtttactgtttctaagagggtattcaagagtgtaataaataggcaaaattcaaatattggacatcaatactttttaatctaaaaacaatttcctaacatcagtagttcaaggggtaccttacatttgtctaatttgtttaaatacttaattaaaccaacatggacatggaataccaatttattgaaagacattggtagtaggtatcataatattttctgagtgaatactactggtcgtcaactagaatattccaaagaagactggaaaggtttgggattggaacatatctgatggtaggtagcaatagagtggtaatggaggaagcgaagaaaggtaaaactgaagaggaacccaggccaggaagcagaatgtgatgttccacatggatcccagtggcataagttaggcaacccaacaatcaatcctaagaaagtcaaatgtgaaatttatctttctaagcagtgtcatgccttccaggtggaccatgagtgcaagaatgtcacagcagtctatacttggagattcaagtgcacaggcaggctgttggcattgagattatttctcagcagatgtcaagacccagttgccctgccagagtctataggtcccaatagggaaattcacaaaaacaaggcaggcagaccaaggccaataaaaatttaaaaagtgaagcaagggctctgtatatgagaaaaactcaactttagaaaccaaaagcaaatactcaaatacctaattgagatacacagggctcaaattgggtcacagggctcaagtaaaagaactaattatataaaatagaaagcacagtgagccaatgatctgaacacattgcctcactgatgccaaatatttagagaaagtctatgaattaatctaacaatgccttcaataattgggtgattttttaagtctttaaagccgatgtggatctttgatgttgatggccaccaattcataaaggttaccttccatgcaagaaaactttactagtttctgctgttgctaacatgcccaaggccccagcctaatgctccatctatgttctagtaaattttaaatgatctgcgattcaatttctttgcctttaatttggaaacaagcatcggtaactactctgtacctgcaaaacccgttagaagttcttttctagctgtacacaaatgtacaaccagaaactctttgtcacaagaacactatttctctttgtgtattaacacagtagatttttaccttaaattagtactgcatattcttgaaggaagaaaaagtacataaggtgcatgatgtaatttttaaatgagcgtattatctttgtagggaaagttacaaatttgagttgggtcacgtactgcttcagcaccagcccacctttggattgcacctttgggttccttttctgctgctcttgctattcccctcatctctcattctgacttccacccaaatcccatcccaagatcccaggcagtgtcctatagtcctttcctgatgcatccttcttctagactccctgccatccttagtgggttaatgggagaagagacaataatcaaattaatgtatgctcatatgtgaaatttttctggtttattatgttgtttgttaaataaaaatctgcatgtaaaacaggcctttcaatacattaatttctaatggtggaatgtcaggccttatcacagatccagataaatgataaactgaacctaagcaggcctttgcagggctctgatatgaccatatattagagatccccacatatcccttctagttaaggcctgtgaaggcccaactctgttctcctcagtcataggattaaaagcccacaaaataaaacaataaatagcagttacttgttctgaccacacaccaccaacccacgcctactaagcttacctgttttttggtatgttcattgtattctccaggaagattgtgtgcgcttttaattaaggtctttgcaatatgataataataaatgctaataatagcaagtggtatgaggaaatagaccaagaaaatgagcactgaatgaatctttggatgtaattcatctgtttgagggtatgggatacatgctgtgaagctgctattatccaagctactgatgcgagccacttctgaaaacaccgcttcgggaactgccagcaacacggagaccacccagatacccatggccttcacacaggtccgcagcaatgcccctgacgtctgcatgtccatggggttaacgatggctctgtacctgggaaaatgatacatctcaagttattccagaaagaaaggaaagaaaaaagagaaagaaaagaaagaaagaaaaagaaaggaagaaagggagagagagagaaaggaagaaagggagagagagagaaagaaagaaagagagaaagaaagagagaaagagagagagaaagagagaaagaaagaaagagagaaagagagagagagaaagaaagaaagaaagaaagaagaaagaaagaaagaaaaagaagagaggagaggagaggaaaggaaaggaaagggaaggagaaaagaaaagggaaggaaggaaggaaggaaagaagggagaagagaaaaacattctgcttagtaagagagatgccaacaatattctgtctttatagctcaaatttatttattccctggctgcttaaaagtgtatggaagacctaaggttcctggtgtctctcagtctacaagtcattccactacttattagcacagaaaacaaaaagagagagaaaaatattttaaatttgcatttcctaaatcctagtcatttcatttccaaaatcctggacattagtttacctcttaaattcttctaaatctatatatgttacatctatcataatgtattgaataccaaatataagatattcacaaaataatattattcaattcttccttgatacttttccatagcttctgagcatgagccccttcactctttttctaaggacattaatgaattttagaaactaatctagattggtcatactacattttgacaaaataaaataaataaaagactcatctagattgggattttctccataatccaataataaggactgaaaaacttgaaagcagaacaatattctgtctttatagctcaaatttatttcatgtcaagatcccataaaattcttttctcctccaacctaaaatattaatggcaatatactagcagtgtactagtgataaaggaatcacactccaggacacagtaaacaatccaaaactttctacagctaactcaaacacacatattaagtaaggcaatgatgatgcaaacaattcaaaatggtatgtaaacctcaaattttttatatttctctttaaagtatttcaggtgacaatatacctagcaaataagatgcagtatcacaggattttagttagacaaatctgaattattaccccatctctgatatattttggaaaatcacatttatcaagcacatctccaccttcttcttgattttaatttctaagatattctgttagctttactttccatcattttttttctgaattttaaaatttctgctatcatcttttgtttcctataagttttttatgttttcaaattatttcttttttatagtgtcctattcctatgttatatgtgcacattcttgccctatatctttttttttttttttttttgacagggtctcactctgtcacccaggctggagtacagttgcctgatcacagctcactgcaatctccacctcccaggttcaagcaatcctcccaccttagcctcccaagtagctaggactacaggtgtatgccaccaagcctagctaatttttgtatttttgtagacaggaggttttgccatgctgctcaggctggtctcatactcctcctgggctcaagtgatctgccgacctcagcctcccaaagtgctggggttataggtatgagctactgcagccagctcttgctatgtacctataaaactaatacaaaaataaaaatttaatctctttccaggttgtttggtctctttgtgctgtaatctctcccaataaatttgcataattattgactgacaattcatatttaagagcaaagtaccaaaaagttgactgtaattttttttctgtggaagaagacaaggaaagggcagagaggttatcactacaaaaagatcaagccttctttttagattatcaaaaaccacaaagggtattctgaactttcctccacgtatttaaaaaggagaagaaaatgtcacttctctacctcatatctaagcacatatactattgtagaagtactgttgtagtttacttgagctgctataataaagtaccatatactgggcagcttataaacaacataaatttgtcacaattctgaagactaggaaatctaagataaagacattgagagattcagtgtctggtgagagtcccccttttttacatagatagatcttcttgctgtttattcaaatggtggaagggtcaagggtctctttggagtcttttataagggtatgaatcccattcatgtgggccccactctcatgacctaatcacctcccaaaggcccacctcttaatgccatcatcttggggagtaggatttcaacatatgaattttggccaacataaacattatatcatagcatgcattataactataaaagatatagagaaactttaaatagaaattaaaacaaaaagtctctcattttgataagattgctagaaacagatacagaaatctcggtttagagaaagcaagaaacctagcagaaatgttggcctttccagcaaggaggattatgagccacctcctgcaagaaaagatagaccccaatgatattctctgaatgatacacatttgaataaaaggggagaattgaaaatcctacaaaaacagaattagagttgaaaatacagattactgaagtgttattagtgctgagacatagcttacaattgtcgaagaaaaatgttgtataccaactgtgtgtatctttgaaaggataaaaagcaaaaaataaaatgagatagtgcaaattaatgtggacatgttttattatgcttccttcaaatatttatagacatgtggggaaaagtatctcttagtataaaaagtgtttcactgtgtatattagcatagcaggtatgtgtaaaaaggtatattttcccttataaatggtctcaggaggatatccctaactgaaaactaaatactagagaatgttgatcaaaaggcatataaagagaaaaataatcactattcatgtattaaacctcaataaataaatagatttcttcatcaattcttattttggatctcgcttgtaacatctgtgtagtttaaattttaatgtaaagagataattaagtttaatcataaaacaaaatacataataaaaatgggatattttttacctcttacagagtcatcatagcatctcaaaaatctccatctacactaatctttctaatgacactacccaaaatttctttctttctttttttcttattaaactttcatttttcaggcaaagaataggtccacaaaaagtctgagtgtgaaccgcatgataagagaaaggtcttgctcactgttatatctctaatacacaacacaatgcctggcctggccagtagagtctatagggtctcaataaatggttgaaactatagcctgagcaacaaggagatccttattaggagcaattgtggtaaagtgggtgggagttgttgggtattatgttgaagtgggaatggtgatgacaaacggagactgagtctaatctaatgatgcctaagacgcatcaatattcagaaacacatagagaagtaaaaaaaagagagaatatgattaggcttctctgtagagttactaatgcagaatccctagaatgtgaaatgtgggattctgcatattactaacatttccaggtgattctgatgataagccgggtttagaaaccatgttttaagagagttgtgtgcagcagtgagcatctttgccacaggcttcctgcaaggtgcagtgcaatgggtgcacattcagcaacagaatggatagtatccagaatccagcagaaattcagcatttgaagaatcagatgcctgctctttaattatgatatgtcacatcatgaggaagacatcattcttcttttgcaaataaggaaagcaccaccttatggccatgagttttgtgctgttttatcctttttctccaagaaaaacatttggatgtaatggatacatggttagcagcacccagaaaccataaacccaagcctgatgcaatccctccttatttatagtgtgtcccaaaagtttcagatcaaggtagatgaataatcttcaaaagctataagcaacatataaattatggcaatattatgaatcttgtgagaattatacagtgcctttctaattcaatgtgtgaaattacttctaagtataaaagaaagagataaactagaagtgttcaagatcagtgaataaaagatatctaatttattggagtcaaataacatttatttaacaataagccccataaattcaaattaaaaactaataaattatgtgcagaaactacaattgattctgtttctatggttatataaaaataacagagaattggttatggaaagcaaatttttctttttgaaaaggctacgagaaagctctcagaaaaacctatgactcacattttgtgaaagtatgggtcattttatattttccaacttttcttttccctgcccttggtttcctccctttttagtcctgtggtgtgttgtttgtatccttatttttaagctgccttacattctcctgtcgcaggtctgatatggtttggctctgcatccccaacaaaatctcatgtagaattgtaatccccagtggttgagagagggacctgatgggaggtgactggatcatgagggcaaatttccccttcctgttctcatggtagtgagtgagttctcatgagatctggttgtttgaaagcgtgtagcacttcccccttagctctctctctcctgccaccatgtgaagacatgcttgcttccccttcacccttctgccatgtttctaagtctcctgaggcctccccagccatgcctcctgtacagcctgtggaactgtgagtcaattaaacctcttttctttataagttaccaaatttcaggtagttctttatagcagcgtgagtaatacaaagctgaacaaaaataagttgaacataaataagtcatcactctagcattatagggtaagtgtggactattgttctaaagagaagcacactcttggtgccaatctcactaccaattaacagactgagaggcaagggctatggagcaaaaaagaaagcatcatctccagtcaggggcagctggctaacatgaacctgagcttcagtcaggagttttgatgagaaaacagcaaacagttaacagcactccctcccaccactgaacaaagactgatggaaaagtcctatgaagcctagtgagtgttagacccagggcctgtatccaatctatttcagtatcttaacaaataattacactcaataaaatatctgtttgcattgatgtaatatacaaataatattaatgattcaagactttgtctactgacctagttatggaatgaaatctgattatcctaaccagcactcaaaaacttggattttgtattaataactattaatgcattagaaacttaatcagatttggtacaacattatttttgcatttaatccaacattggctatttggtatcagaagaaagtatcacccaatacattaaactaatattagtttatttttatggtttttatagttttattttttaaatttaatttataaatgcgttttggttaacagttatataagaagccacaataaagaattgatatctagttttatatttgttaatacatgaaattatgaagtttacagtttagcactaggaatctgtgagaatttttcctatgaaggaaaaaggaaaactccattcctaagagttatttgcattttaataatgtgccatcagaggccaaaagatcttcaagaatcaaagaaataacattccaaatttggaaacgcagctactcatatacagagaaagagataactataacgccaaccaggagcaaaatatggcttatggggcgccaccaacctgatgtcacagcacacacgtcccaatactccacggggggaggtgagaatatgtgtgtgtttgtgtgtatgtgtgtatgtataaaagtgttagaaacatgacagaatatagaaatacttttaatcaactactttatgtaagcaagcaagcaatatacattttcaaaattgtaacaaaactgtctatcaagataacagtttaaaaaataataaaaaattgagactaccactatcaccacttcataccatgcactgtctctcctccagccatactggttatgatgatgtgcctctgaggcatgactgcagtgggcacaaaagctgttgcctagggatgtgtctgctgaaactcctcggaagagtttggaaagttgaggattaataatcacagacaccagctaggagcagtggctcacacttgtaatcccaacactttgagaagccgaggtgggcagatcgcttgaggtcagcagttcgagaccagcctggccaacatggtgaaaccctgtctctactaaaaatacaaaaattagccaggcatagtggcgtgtgcctgtaatctcagctactcaggaggttgaggcaggagatttgcttgaacctgggaggcagaggttgcagtgagccgagatcgcacccctacactccagcctgagtgacagagcaagattctgtctcaaaaaaataaaatataataataatcacagataccagtgtcatctgaccaccctttggccatatcagacaaggtgttttaggcctcaaggtggattcaaaatatttgtgtttttcattttagtctctgcaatctaatgatgctgacatcaatgaagtgtagaatatgagtctccacttcacattggaatatgctttctgaaatctaattatcttcctgggtttttttctatgtactgtgatctctataggcaaagagatcttaggcaaagatcttgttaggcaaagacacttaggccatctgtgaagacaggatatatgatacaaataattgaatttgttgtttaaagactctaataacataatttttatttgtttattatagtttttattgctgcaactactacttaaaattgaattcaaggtgcttcttttattttgcagttacattttatgatgttttttcactgtaataaatctaatgaatcagctcctgtactctttttttttttttttaatgcttgggtgttttgttttaaactcagcttttaagtctgctggtaaataaaaaatactattagtaatttcttataccaagaattgtaataatgtggattaatggtgaagagttcagactttaaatggcgttcaaacatgttggcaccatcagtggctagctgtgagatcataaaaatgttgctgaatttctaatctgttttcttagctttaaagtttttaatttaaataaaataatgcctatctaacagcattgtgagggttgaaaaattacacaaaaaaagttagcactgtgctaagcacaattaatcctacaattgattccacatccacaagaaatcatagcttttggtgagatatagtaagaagtcatcaagtactagtcaactattgattgctatgctctagaagaaaaatagaagtgtagacaatatataacaaaccatttccaacccattttaagtgaatcatggaatatattgcataacttcatcaacagttactcaggtttcctagtttatatttcctaaacacacactggtagacaagggtagcctacggaccaagtagaagaggcatctcacctttccttattgttattactaaagtattcatcctgtattcacagaatatatgatgcacaaatgaaacaaagaaagtcagtaaatatataaggattattattttctctgatctaggccagggcaaatttacctgtgtaaatggtcatgtgtcgccatgacaatagattgtaaaaactggtgtgaaataaactccaaccctgggtcttgctaccaatgccatgtctttagaataaaagcacaatgatagtaatttaaactactgtggttgctaatcattaagttttattctaatcactaagtaggttttttaaactttctaggtaaaataagattgcataaagaggggcagctaaactagtcatatttttgctttggaattcagagaaagtattttaaaagataatagaaatgctgccacataaacaaaattaggtacataatttatacaaaaggcacctaagtttccaggagtgtggtttttaagaaagtgaatcattttcagtttctcaagtctctgttgaatgctgtgtttccctcagtcaggattaactcttcaatgccaaagtagtattccagtattcttgcaaataccaggaaattcagatacagacttatttttcattagcaattgaatatgtaaattaaagaggagagggcataccaccttaattatccaagttaattgtttatctaaatagcttaagtcagtcctccattcccaccaagggaattaaaccacagctccatgaaaaggtacctaattttgcatttttccccacccctatccaaacattcccttctgcttaaatggaccctgagtcaggagacttggattttcctccctggtcttccattagaaattacattccctgggcctcaatatgcacatctgaaaaatgacagagttgaactagttgatgtgcaaaatagaataatggacacttcacacccttaacatatgtcaaaagcagatttaatatcaaagatgtattttgggtacctatctgtggaaaaaaaaagtctcttagcttcaggtattaaacaagaagaatgtgaaaagtcatctgcccaaagaacatttattaatctaattggttttacttctaagaaatagtaaaattcagttaataaatttaagtaagttctcctcttacttgaaagaaataaaaattaaatatttgcctaatattaagcagacattcttacctattagattcttactctactgcataaaggaaagaacactaataagattttaagcacacacagaaagcttcaacaagatactcgctcttttgcatgtttattctatagcttttctatgaaataatattccctaagtgtcggaggtgggactaggagatgcaattttaaatgcaattttaattgttttttttaaaacatagtaattttcttatatttttccaagcctcacatgtcagtccgttttaactctgtttactctacttcccaggtacacactctctccctctcttcctctccacacccaacctttccttgcgtccttctgccagtaggtgcactccgggtgagtcttctctactcgcccctctccacgacttttccaagccactcacagctacctgtgctcttacctgtcggcgctgagggcagtgagagtgaacacggaaacccccacggaagtgagctggatgacagggatcagtttgcagcccaccttgccaaacatccactcgtcgaagaagtagcgcgaggcgtccaccgggacgcaggtgagcagcagcagcaagtccccggccgccaggttagagatgaagatgttggggacgctcctcatggcgctgttggtgatgaagatcttcaccagcatgatgttgcccagcaagcccacggtgatgatgagcaggtagagggacgggatcacacagcggatcaccaactccgtggtggtcccgtccgaggccggcaggaaatccctttcccacccctcgggaacggaaccgctctcattcgcgccggtggtcaccgagaggttggaaagagacttagagggcatgatctcctttccagcagagtccgctggagttttcacgcgctccggtgccctgaggactgaacgcccacgatttaggtttaatcgatgtccctccctctcgcccctgcaagtttactgtccgcggggcaagcctcacagcaccacgtccctaagagttcaggacctggggaggggtctgtccacacactcgggcgctccgcttctagaggggggaaatggctccggctaactctgaatttaaattaaaaaaaaaaaaaaagcaaagcggttgcgtctttgttccgtattcagtggtttgttctcgcggttatctagcggaaaacagcctttcaggaacaaggagctgtcccttggggatcagtagaagcacctgccggactcttcgcccagagaagcagaagtcatcctggcgctgtccagcgggccgcagctgaaatcccgggaactaggcggggccacctgcaacctgcttttcccacagctttgctcttgtttgtgaagttcctgttgtattgtgtggaactggaggggaggtcagtcctccatgcatgtgtgtgtgcccctatatacatccatccttacccgcctccaagcaggaggagctccaggcaagaactttggaatctctgaggattaaagggctgagttggcaagtccctaatgctgaaacacagaatttaggggaaaaaaatgagtgccaaagaatgaagctcataaatgaaatcctctcgctactcttcttctgatcatctactgttcttaccttaaatgtgaaaattatttcctattgttggcatattatttttaaatttatattttattgaattataacgtgtataacgtacacatttcttaatcgttctgcttaatctaaccatcattcagagcccacaatctagccaccatctcccaaaataaccaccatttggcttgttattgaataagtgtgcctcctattgagcatcgtataaatggaatcattcagcatacactcttgtgtctaggttctttcactcgacaccatatctgtgagatccactcatgttttttctcaggtggcatttttcattactgtatactacatcattttataaatataccacagtttgtttatccattctatattgattaacatttgggttccttacaattttagtcaacctgagtaacgtttctatgaacattcttttacatgtgttcaggtgcacatttgaataaatcccaggtgtggatttgccaggtcatagtacttgagtatgttcagctttactggaaactgacaattttttaaaataaattactaacttattttttcttttggaacctggctcgacaattttatttgttaattctatctattaaggcagagtatatgtatgcttatgattgagtaatgccactcgtagatatatattcaataaacatctgatatgctgttttaaataggttgtccctaagcacaaaacagtttcccaaatcaccaccatctgagtctaatgtaaactgatcagaaatggtggctcagttctggagttagctaaataacactcttcattagggaaaacatttgactagttctttgttattaaaggataaaattgaacaattgaataataacaatgtaactagccaaggactacctatgatgatctagccataaactgataagatgtgtatatatgcaatgtcacttataaattaagcaacttttccagatattgcccaccaagagcactgtcacatcataattgaattagacaaggtaaacatttgcattgtaatcaattttaagttttatgttttctaactcaaaagtccttattgtactcttctggaatttcactacttaaaataattcattataaaattaagattagttaaatagaatatttatgtataaatatatttgaatatataaatattctatttatatttataaaaattatacacatatatagagggagagggagcaagagaaagaggaaaagagagcaaggaaattaatattacatgtaagttgagaaatgtctctaggaattttatctccaaagttatttgttttctttttaacatccaatattactatacagaataaattactaaagcaatcttctaattatgaagtgtctaaaattcaaactgcaactatgccattttaacatattttatataaaaatatattgaaatcgaaattactgtatgaatttttatattctcctccttgtgtctgtgtgttcctaatcatttagaagagaaaaaaatgtttagtctaaaagctggattaataaatatccaattgacaggcattgtagaaacaagccatctggattgaattttcttcattttaagtaaatttatatgtatttacttaaagatttgtgttcattgtagtgaagaatataatgaatattttaataatttttttggtattttattaaaatgttataaagttataataatgtgttatttagattcatcacaaaattacatataagaacacagtattgtctcatattaatagaatgcacacacatcaaaggtaaacatctactggaatgaaacactatttgtttatttatgttttgagacagggtcttgctctgtcactcaggcatatgcagtggcatgaagatggctcactatagcctcaacctccttcattcaaacaattctcctgcctcaccttccccatgtagctgggaccgcaagtgtgccccaccatgcctggctaacttttttaattttttgtagacatggggtctcactttgttgccccagctggtctcaaattcttgggctcaagcaatcctcttgcctcagcctcccaaatgtctataattataggcatgagccatagcacccagccatacaaactttattattgtattcaatatgtcatataccatattaggtttcttagactcatatacttaatgtttatcaatattcctggataaaaatacttgagtcttaacatgattcacagagacaagataaattgtctaatttgaaagagacctcatgaaactgcattttgaaatttattgtatttgaaatcagtgtctgttatgtctctttgtttctggagaaagcaattatgtcaaaaaaatgtgatttctatataaatgaagtatacatttttaatcctgagtatttgatgtttataaatacacattgtatattttattgccctagtacagaactgttcagaaccatattgatgctgtttcaaattcgttgacatgagtattattgttgtaagtgaatatgaagaatttgaaatttaaaccaattttgtaatcctcatctgcttcaatgtatctatccttcagtgtattatgaaaaaatataaaatactatacttatggagacattttataggtttttcttaagatcatgacaaaggcaagtatactcgctattatcattgttatttaacacactggaggagattccaagcaatgctattgcaacagaaatggaaatgaaaagcatagaatttgagagaaaggagatactaatacaaatatataatattaaaattaaaatggaactggcgaaagaacagaaaaaaacattaatggaagagaatacaaagttcaaagtcagctgcatgtagataaggaaacaacactcaaatgtgtattgcaacaaataaaaacttagtagataatactgggaaaactgttgcacaggcaagaagaataaaacagagtctctatgtaatactatatgtagtattataattctagtgcattaaaggtcacagtatgaaaaagtaatttggggaagataatagaagaaaatattaaagaatatatatgagaccacgggggtgggaagtgattcctacttcaagtcaagatggagtaacagagaatacactgaaaacataaaaaccagacaaaacatattaaacagtagtttttagacactggcagcacaaaagaggcagcacaaaacagtgatccctaagacaggtttaacagatgagatgagctctaccatcgctctatcttactgcctagagaaagagttttcagcccatgcacaaggataaggaatccacagtgagcctggaagtctctcttacttgagaagatggaattggaatcagcagaacagagaaaagtgagtcatacagagaaagaactctggagattcacagaatttccccttgggttttcagctaaatacgtgtttctatctgcatgtgggaaaattaaccaattctcaggaaaacacttacccaaaaagggtaaattagtgatttaaagaagctaagttcctaccagccacagtataacaaccttgtaaacacatagttttaggtacattacttagaagtgtattgtgtttgtagttaggaaaaattaaccatagaccaaaggcttctctggtcttgccctcaaagcttaaaagcaaggattaaaatggtaaaactagttctaagaaacctgatggtatcttagaacaaaacttaagaattttttttctttttttttaattattctttaagttttagggtacatgtgcacaacatgcaggtttgttacaaatgtatacatgtgccatgttggtgtgctgcacacattaactcatcatttagcattaggtatatctcctaatgctatccctcccccctccccccaccccacaacagtccctggtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacaggaactcatcattttttatggctgcatagtattccatggtgtatatgtgccacattttcttaatccagtctatcattgttggacatttgggttggttccaagtctttgccattgtgaatagtgccacaataaacatatgtgtgcatgtgtttttatagcagcatgatttataatcctttgggtatatacccagtaatgggattgctgggtcaaatggtaattctagttctagatccctgaggaattgccacactgacttccataatggttgaactagtttacagtcccaccaacagtgtaaaagcattcctatttttccacatcctctccgacacctgttgtttcctgactttttaatgactgccattctaactggtgtgagatggtatctccttgtggttttgatttgcatttctctgatggccagtgatggtgagcattttttcatgtgttttttggctgcataaatgtgttcttttgagaagtgtctgttcatatccttcgcccactctttgatggggttgttttttttcttgtaaatttgtttgagttcattgtagattctggatattagccctttgtcaggtgagtagattgcaaaaattttatcccattctgtaggttgcctgttcactctgatggtagtttcttttgctgtgccgaagctctttagtttaattagatcccatttgtcaattttggcttttgttgccattgcttttggtgttttagacatgaagtccttgcccatgcctatgtcctgaatggtattgcctaggttttcttctagggtttttattgttttaggtctaacatttaagtctttaatccatcttgaattaatttttgtataagttgtaaggaagggatccagtttcagctttctacatatggctgaccagttttcccagcaccatttattaaatagggaatcctttccccatttcttgtttttgtcaggtttgtcaaagatcagatagttatagacatgtggcattatttctgaaggctctgtactgttccattggtctagatctctgttttggtaccagtaccatgctgttttggctactgtagccttgcagtacagtttgaagtcaggtaaggtgatgcctgcagctttgttcttttggcttaggattgacttggctatgcgggctcttttttggttccatatgaactttaaaggagtttttttccaattctttgaagaaagtcattggtagcttgatggggatggcattgaatctataaattaccttgggcagtatgtccatttccacgatattgattcttcctacccatgagcatggaatgttcttccatttctttgtatcctcttttatttcattgagcagtggtttgtagttctccttgaagaggtccttcacgtcccttgtaagctggattcctaggtattttattctctttgaagcaattgtgaatgggaattcactcatgatttggttctctgtttgtctgttattggtgtataagaatgcttgtgatttttgcacattgattttgtatcctgagaatttgctggagttgcctatccgcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagtttttaaagggaatgcttccggtttttgcccattcagtatgatattggctgtgggtttgtcatagatagctctgattatttggagatacgtcccatcaatacctaatttattgagagattttagcatgaagtgttgttgaattttgtccaaggccttttctgcatctattgagataatcatgtggtttttgtcattggttctgtttatatactggattatgtttattgatttgcatatgttgaaccagccttgcatcccagggatgaagcccacttgatcatggtggataagctttttgatgtgctgctggattcggtttgctagtatttcattgaggatttttgcattgatgttcctcagggatattggtctaaaattctcttttttcttgtgtctctgccaggctttggtatcaggatgatgctggcctcataaaatgagttagggaggattccctctttttctattgattggaatagtttcagaagggatggtatcagttcctccttgtacctctggtagaattcggctgtgaatccatctggtcctggactttttttggttggtaagctattaattattgcctcaatttcagagcctgttattggtctattcagagatccaacttcttcctggtttagtcttgggagggtgtatgtgtcaaggaatttatccatttcttctagattttctagtttatttgcatagaggtgtttacagtattctctgatggtagtttgtatttctgtggggttggtggtgatatcccctttatcattttttattgcatctatttgattcttctctcttttcttctttattagtcttgctagcagtctatcaattttgttgatcttttcaaaaaaccagctcctggattcattgattttttgaagggttttttgtgtctttatttccttcagttctgctctgattttagttatttcttgccttctgctagcttttaaatgtgtttgctcttgtttctctagttcttttaattgtgatgttagggtgtcaattttagatctttcctgctttctctagtgggcatttactgctataaatttccctctacacactgctttaaatgtgtcccagagattctggtatgctgtgtctttgttctcattggtttcaaagaacatctttatttctgccttcatttcgttatgtacccagtagtcattcaggagtaggttgttcagtttccatgtagttgttcagtttccatgtagttgagtggttttgagtgagtttcttaatcctgagttctagtttgattgcactgtggtctgagagacagtttgttataatttctgttcttttacatttgctgaggagggctttacttccaactatgtggtcaattttggaataggtgtggtgtggtgctgaaaagaatgtatattctgttgatttggggtggagagttctgtatatgtctattaggtctgcttggtgcagagccgagttcaattcctggatatccttgttgactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttgttgttgaattgatccctttaccattatgtaatggccttctttgtctctattgatctttgttggtttaaagtctgttttatcagagactaggattgcaacccctgcctttttttgttttccatttgcttggtagatcttccaccatccctttattttgagcgtatgtgtgtctttgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggtgattttgctcgttagttgatgcagtttcttcctagcctcgatggtctttacaattttgcatgtttttgcagtggctggtaccagttgttcctttccatgtttagtgcttccttcaggagatcttttagggtaggcctggtggtgcttctctatttatatctggtctacatctcagtaaacgcatcataagttgaaaatatcataagtggaaaatgcatttaatactctaacaaatccatcataaataaagtcaaaaaatcataagtcaaatcattgtaagtgaaaatgctcctcgacttaggatggggctacgtcctgataaacccattgttaaagtcaaaatattgtaagttgcactattgtaaactgggggctgtctgtgatgtttaaactatgtagaacgcaacaaggtaaaattaaaatatctggctgacatgcacttggaaattaccaaccatgaaaatcagcaagtaattatatctaaaaataaggacaaaaatcagttaattgaaactaaaccaataatggcacagatgatagatgtataaaagaacatgaaaaatgttaacaaggctctattccatgtgttgaagaaggaagttgcatattaaggagagacatgaaaaacataaaaagacatacattaaattttacagaagaaaaaagtcataaaaataaacttcataaaattagcagcagaaaaaaacactgcaggagaaaaggtaaggtaatttctcaatgtagtagtagaaagtatccaaaacaaaatatacagagaaaatgactggggaaaaaaatgaataaagtgtgcactctggaaaactttaagtggcccaatgtgactacagttggatctccaaaggacagaagaaaaaaagaacagaagaaaaaatacttgaagaaaaaacagccccaattttttcatagttaatgaaagctaaacccttcacatccaagaggctcagcaaaccccaggcagaagaaacacaaagaaaaatttgccaagatgagaaactcgaaactatcttgctaacatcggggatgaagaaaaatgtgtactctcaccattccttttcaattttgtactggaagttctcatcaatgcaataagacaagaaaaagacatagggtgatattgattgtgaaggaagaaataaaactgtctttgttaacaaataacatgattatctattagaaaatctgaaagaatcaacaaaagactcttgcaactaataagtaaccatggagaggttgccaaataaaaattaatatacaaaagtaaatcactttcctatataccgtcaattactaagtggaatttgacactgaaaacattaaaaaatttacagtcaccctgaaatatgaagtacttagactaaatctaacaaaatttgcatgatccataaaaggaaaattacaaaactgaagaaaattggagaactaaataaataaaaagatattccatattcatggattggaaaactcaagttttccttgtcaagttgtaagttcttttcaccttcatctataaattcaatgctatcttaatcataatcccagaaaggtaatctgtggatatcagcaaagcgatgataacaggcacaagattcagaatagtcaacacaattttgaaggagaacaaagttggaagactgacactaccttatttcaagacttattataaagctacagtaatcaaaacagtatggatattaatgaaagaatagacaaatagatcaatggaagagaccagagagcccagaaatggacccacataaatacagccaactgctctttgacaaggaaccaaagggtaaacattggaaccaagattagtcctttcaacacatggtgctggaacaacaggatgttctcatgcgaaagaaatgaacctagacatagagtttacaccctccacaaaaattcacgaaaagtagatcacagacctatatgtaaaccacaaaaattataaaattcctggaagatcacatagaagaaaatctagatgaacttgtgtattcgttcgttttcacactgctataaagaactaactgagactgggtaatttataaagaaaagatgtttaattgactcatagttccacaggcttaacaggaagcatgactgggaggcctcaggaaacttacaatcatgtcataaggagaaggcaaggcaaagaccttcttcacatggtggccgaaaagagacagagtgtgaaggggaagtgccacacactttcaaacgagcagatcttttgagagctcactcactatcatgaaaacaacaagggggaagtatcccccttgattcaatcatctcccaccaggcccctcccccgacatgtgcagattgcaattggagatgggattttgctggggacacagagacaaaccatatcaacttgggtatatcgatgactcttaagatacaaaactgaagagataatccaagaaaaaaataattgatcagctatacttaataacttattcaaaactaaaaattctgctttgcaaatgacactgtcaagacaataagcaggctaaagactaggatttatgatccaacacatacaagtatcacgtagaactcttacagctcaagatatcaaaaatacacaaataatttttaaaattcatcagtaaaaaaataaaaaatccaatgaaaaagaggacaaaacaccttaatagacatctcaccaaagaagatacacaagtgtaaataagcatataaaaagttgcttacatcatgccattaagcaattgcaaattaagacaacaagatacccctatacatttattaaaatggcacaacattacaactttattcaaaacactgccaactttaaatgctgagcaggatgtggaacaataggaattctcattcactaatggtgaaaacgcaaaatttggaagacagtttggcagtttcatacaaaattaaacatactcttactatgttattcatccatcacactccttcctgtttacccaaaatatttgaaaacatatgtccacacaaaaaccaacacatggatgtttataacagctttattcataattgctaaaagttggaagaaagatgtcctttagtaggtgaatgaataaataaacggtggtacaaccagatgattggatgttattcagccctaagaaaaatgagatatccagccataaaaagacattgaagaaacttaaatatattttgctgattgaactaagtcaatctgaaaaggctgtgtactgtatgatttcaactatatgacatcctgggaaatgtcaaactacagagacagtaaaatgtgcttcccaggggactggaggaggaaaggacaaatgtgtggatcgcagaggattttgcagtagtaaaactactctgtatgataatgtaattgtagaaatgtgtaattataggtgggttcacacccagagaatgtacaacaggaaaattgaactctaatgtaatctatgactgagtaatcatgatgtctcaatataggttcaaataattgtaacaaatgtgccactttgatgaggaaaattgataatgggagactatgtacgtgtgttggtagagggtataggagacataactatactttcttcttaattttgccatttcaaagcagattttactgtcttagtctgttcagactgctataataaaatactataaattgggtagcttataaaaagagaattgtattttccacatgtctgttaaaagagaattattagccaaattaaattttacaaagtttaaatgagcagagaacaattcacaaatcaggtagcctcctgagccagagtaggctcaaagagactccagtgcagccatgtggtagaaggagatttacggacagaaaaagaaaagtgatatacagaaaacagaagtgaaggaaagaaacaaccagattggttatagatcagcatttgccttatttgaacatggtttgaataattgggcctctttgattggaccagtctcaatgattagcacaagagcaggttccagtctgtttacacttctattcaggtgatagttcactaggtacagagaaacctttatgtcaaccttaaaatatataaggaaacagcttttggctaaacttgatttcacaattccctgttttgggtcatcctctgaaaattgatcattgatcaaaattttatcattgatgtcactagcaccatgataaatgtacttatttggtctcaaaacccattgggaaatagcagaacagtgggttttttaaggttagaacaaggacttcagattattttctttgtaggggttaggttacagggtagctctttatggtggaatctcctgtttacaggagaaaaacaaaacttggtttgttctaggatcgatctttttctttaaggtcttagtttgattatgtcagatttagcataagtgactctaatttggtttaaaatggtctgttggggcctagggcatgagctcaatccaaaacaatggcatctcataattttgcttaaaaataaccctatttggtcacgttctcacttagatgagagaatgaccaaaacttcaggccttagcaccactctcagttaccatcactttgggtttctggtctcagcacgtcatttataggctacagtgccctcatggtcacagatttttttcagctcttgtcaatccagttgaagacagaccattcgacactctaaagatggctgcatgcaaacatttaaaacttttaagagaatatagcacaccagggagactactattaagactatcaggaggataataccaagagcttggagtgtgctccttagccagggttgtcatgaaccaaaccaactacaatcaaacagatcacagaatgagctaaagagtctacttgcagctgggcgcggtggctcacgcctgtaatcccagtactttgggaggctgaggcaggcggatcacgaggtcagaagatcaagaccatcctggctaacacggtgaatccccgtctctactaaaaaaatacaaaaaattagccaggcatggtggcgggcacctgtagtcccagctactcaggagactgaggcaggagaatggcatgaacccggaaggtggagcttgcaaggagccaagattgggccactgcactccagcctgggtgacagagcaacactctgtctcaaaaaaaaaaaaaaaaaaagtctacttgctttaacaaagcagcctgttcattgatcccctacaactgaatatctataatacccaatgtatttctccatgggaaacaagaagtacaagcaactgcacagatacttctgtttagccagtaagtaatttagagcaattctattatgtagtataactttcacaagagaatttaaagtctgttgtgcaaccattaaagcctcctaacaatgttctctttaacctgtgatgtaggttaagaggagtggaacctataatgtaggttaagaggagtgaatcagtgtttgcttctcactaattatgaggcaacaaatgtaccattaaaatttctcacctgcactggcccttcatcttccatttatcaaggcataaagttgtccgtgtataaggctggctgcaaaattcttcacaaataaaaatagaccccatgagtgtacacaacagatgcccttttcaattctattgttcaaagagacataagcaaggggaaaatggaaagataagagtctcatgatagcagagaaatcttgatccatgatcttggggaagagctgtccatatcaaagatgccatctgcttctggggaggaacttccttggttagctttaccttaaggttgtaaatgggtgtacagttccaagagtgcagggggcctatgtgagttgtgagataatgaacccaaggttcaaggtgccaaagttttgctgcaatgtggatggcacaatggcagcctttctctgatactctgagaagaccatggagtctaatccttgggttctagattatgaaagggttgattgtccccagtcagtagaccatgaaatgcattcattacctggtgaaaatatactttggtaaaatgagctactattataacaacagcccttttgtatgttaaagcttttatacaaccagaaagcatgcattaaaaattacaattgaatgaaatccttttataaatgtttaaatggcccatcaggtagcagaaatgtacataaagttttaaaacccaggaatgagtttgataaccaaacattggtcaaaaactatttgagcaatttagaacagccaccaaaataatatattttttaatttggataattttatttattccatgatgggtcatggaatgcagagcttctagtaacaaacactttaaggactcaggatgaggtggctgtccagaatctccatgagtccattcttaacactagatttacattttttaaaataccagttgtttctccaatttatatgcatagcactgatactgatgggttataagcaatttgacttgcaccatggagtttattcaaattgtatatctaaatatttcagtactgcctgatttatcatgaaaatctcacaaagtattttcttggtattcagttaattttttgccctgcttgggttagcagttttataaaccaattaatcaatcttttcattaaagtgttgaaaattcttacccagtccaaatcatataagcctaaagttatcagaaacttgtattcaagagtgcttgtcagggttctttctatactttcacaaacctccttaaagataccatactctaggattttgtatgcttgtaaagctttcagaaactgcattagaattaggcaattaactgtggaaataactgacatgtggaaataactgactatgtcggccatactggtttgaactactggccttaaggtattctcctgtccttgcctcccaaaatgctgggtttagaggcatgagccaccacacccagcataaatggtcatagttaaagacacaactgacaaggaaatgtggtcatttctgtggcctacaataactaaatgataattatggttgatagcacatagctaaacatattagaattttagaaattttataccattttggaacatctattaataatatatgcattaagatataacttgaagaaggttgaaaatcattttttatttggcagtggtttccacgtaatttaacatgtcaaaacatcggcttctctcgcctttggatgctttaggggctttctgcagaatcccaaagttagagatcaaaaaagacttaactttgaagctgaaatttgattttggaaagcttgtcaaatatttcaaagtattaaaacacttgaccaaaataggatcacaggtcaccataaaataatagtcattcatttagccaaagtgataattaaaagatttttaaaaataaaaaacctgtactctttaatggagaaggctgttttccaaataaggaaaagacttaagacagtatgagacagaatctatctcttcttctctcctctctccctctctttttttgttacagtttactcagaaagtgaggaaaaatgtttgaatgtgtctgattaatgtcacatgcatggatgtgaagagaccaccaaacaggctttgtgtgagtaataaagctttttaatcacctgggtgaaggcgggctgagtccaaaaagagagtcagcaaagggtggtgggattatcattagttcttataggtttgggataggcagtggagttaggagcaatttttgtggcagggggtggatcttacaaagtacattctcaagggcgggaagaatattacaaagcaccttcttaagggtgggggaggatattacaaagtaccttctcaagggtggagggtgtactgtacaaagtacattaacaagggcgggggaatatcacaaagtacattatcgaaagggcggggagggggtattttcacaaagtcagttggtcagttagggtggggcaggaacagatcacaatggtggaatgtcatcagttaaggcaggaactggctattttcacttcttttgtggatcttcagttgcttccggccatctggatgtatacgtgcaggtcacaggcgatatgatggcttagcttgggctcagaggcctgacaattaatactatgtaaaatttttgttcaaaagagaaaaccaaattctagttttatgttgtgtattatcaatgttaaagcttattttaataaaacctgtaaataaatttataaaatctgtcatctttaaccacacaagatttccataaaccttttgttttacattttctccaactttatatattcatctagatttatctattttttactccttcaatttgaaacctgtaacttcaaactagacaaaatttttaaacatgcacacatttttatgcctttatatattttctcattaaaagcacatttttgtttatacttttgtttatatgttctgtatacagaattgtttctctcatatttagtagttttagttacatacattaactacaattttaacttttagtaatcccaatttgtagtgaaaactctagaaagcaattttgaactgtttgttttatatcaccatttgtagataaaaaacattttataatttttttagaaggatggttcttcaaattagtgcttattaacaccttttctatagcatttaaaagtagcatgtcattatatagacttaagttcatgtttaataatttatatttcagtattttaacttacaaatgatgtagacattttatgattatctattacttaatctaacataatatgactttaagattttaaattactgaaaataatttggaactaaacacaagaaccctccctaatgtcttccccagtcatcctgggtcccaagtagccatgtggcacccaggaaggtcaggactatgaaggttatgacctgtctgagtcctgaatttacatgctaggtctaaaggggtcagaacagaagacagagctgtgaagactgcaactggacaatctaactcttcccaaaatagcaaggaggcaaaacagggagagcagggaagaaggggctctattgggcttgattctggcttgcagttgctagtctgggtactgagaacttgtcttgtctctagacctcatcatgtccacctatccagacccccaaatcccgaggctctaatctaaaaacataaactcacagttaaatcaagcaagtttctaattatatttaactgataattttgaaaccattcctgttttaccaaaaactttttaagcagctttatttactaaataatatcacatacacataacacatacagacatacaaacacagagaagcaattcttacagcttttataaaggattgtcatttgctggcttttaaatagcttttcttttccccattcagactatcaatcttccaattacttgtttcattgccctaagcaattgttaactagacaacaaatttgcatttctaaaaagacaactcttaggtgaaacaaaaagaattgtattttgtaagcacagagctaaaattttaggcctaaatattgtattgccatttgctcaaactaagggaaaaatacagtgcccaagtaaaagttaagtcaagacaagatggccagaaaagcaccttaaacaaaggtatggcttgtgatgtaaatttaaaacaatggtaagagtttctaaagtataccaacacacatccttaaaaatggagacttcctttatagaagtaaatttcttttacaaaagtgtttcaagattgccagttaaattccagaaaggtgcattttaggttcataagtgttcttgttaacttagctactgtttcttagctagaattacgagttcagggcagagctcatcatgaatagggcaaagtattctctgcctgaactcagcatggatagatctgaaaaagaagaaagcctagtttacctgagggcctatattttataaacactatctaggagaccagccaaagtctatggcatttgagacttgacccactctctttattccacaataaaaaaacaaatgtcaaagaaaggcctcaaaaaccagtcttgcaaagggggctgaatttaattggattacactgtggaacaattaatgcccccaaggcactactaaaaactataaagcaatcagccagcaattcaaggaggctaacaactggatgtaatacttacagtggcagacaaattaataattaaatcagagaaagaaagaatcaaagagaatattgctaaaaccacttcatcccagggtgatgatgcacatactcaaggcttcaccctctgagtagtgacatcagaggttgaacattgtgggaaaaaatagacattattgaaatggtacaccttgttactaaaaaatccaacaagttccatatacagatttactacagtatattttctaaaatgtctagttttcaacaaaaaattatgaaacatacaatgaaactgagtgtgacccttataccggaaaaatgtaggcaacaaaaactgcctttcagagaatccaaatgtcaaacttagcagaaaaagacctcaaagcatctaatataaatatatttaaaaaactaaagaacaccataaagaagggaagaaaggtatgaggacaatgtctcaacaaatagagactatcaaaaaaaaagtaaaagttattttaaaaaacaaatggaaattctgcagtttaaaagtacagtacttggaatgaaacatttactagagtgctcagcagtagatttgaactggcagaagaatcagtgaaattaaagatagattgacagagattatataatctgaaaaacagagaaggaaaaagaaaagaaagaaaaataaacagagcctcatagacatgtagaacataattaagcaaaccaaaatatgcataatgaaagtaacagaagtagaggacaaaaaggaatgagcacaaaagttattcaaaaaagtaatgactgaaaaccttccaaatttgacttaaaaccatctatacatcaaagaaactcaataaattccaaataggacaaacacaaagaaacctacacttagacatatcaaagtaaaaatattcacaggcaatgataaaataataaaagcagcatgataaaaatgacatttacataaaaggaaacaccagtaaggttatgtactagtctgttctcacactgctataaagaaatacctgagattaggtaatttataaaggaaagaagtttaattgactcacagttgtgcatggctagggaggcctcaggaaacttacaatcatgagagaaaaggaagcaaacacatccttcttcacctaactgcagaagagagaagtgccgagcaaaggaggaaaagccccttataaaaccatcagatctcgtgagaacaattacaagaacagcatggaggtaaccgctccatgattcaattacctcccacctggtccctcccacaacatgtggaaattatgggaactacaattcaagatgagatctggatggggacagagccacaccatatcattctgcccctggccccttccaaatatcatgtccgcacatttcaaaaccaatcacgcctttccaatagtcccccaaattcttagctcattctagcattaaccaaaaagtctacatccaaagtctcatctgagacaaggcaagttcctttctcctatgaacctgtaaaatcaaaagcaagttacttacttcctagatacaatgagagtaccggcattggataaacacactcactgcaaatgggagaaattgaccaaaacaaaggggctacaggccccatgcaagtctgaaatctaatcatgcccacctcagctgatgcatgaggtgggcttccacagccttgggcagctccaaccctgtggctttgcagggtacagctccctgcttcagctgttttcatagcttgcattgcgagtctgaggcttttcaggcacatggtgcaagccattggtggatctaccattccgggctctggaggagagtggcccccttctcatagttccattaagcaataccccaccggggactctgtgtgggggctctgaccccacatttcccttccacacttgcacccatggtgagcacctgcaaaagtcactgggactcgaggatataaggtcagaagtaagaaaaagatgctttttaaaatctccttcatgtaccccaggtattcattggaaagagaaagaaatacatttctccaaaaaatatatataatcagtgtgtaagacattgggtatgtctttttttttttttttttttttgagttggagtctcactctgttggccaggcaggagtgcagtggcacgatctctgctcactgcaacctctgcctcccaggccaatcagcacatgaaaagatgctcaatattattacccatcatggaaatgcaaatcaaactcacagtgagttaccacatcacactcattaggatgattacagggatgaaatgctacgatctgaatgtttgttactcttttaaaattcatacattgaaaactaattcctaggggtattgtattaagaggtggggcctttgagaagtgattaggtcataagggtagaaaccttatgaatgggattgatgccctcataaaagaggcccaagggagtttatttgccccttcccacatgtaaggatgccgcaaaatggcaccatatatagatatgagccttcaccagacaccacgagtctccttgatcttggacttcccagacttcagaactgcgaaaaataaattgctcttgtttataagttactcagtctaaggtattttgttatagcagtttgaatgaactaagacagatggctacgaccaaatagatggacacaaaaaaaagtgttggcaagcatatgaagaaattcaatcccttatacattgctagtggaaatttaaagtggtgtagccgctttgaaaaacagtctggccattcctcataaggctaaacataaaattactacattatccagcaatttcaatcctaggtatatactcaacacaattaaaaatatatgtctacacaaaacctatatacacatcatcacagaattgttcataatagccaaaaagtagaaacaacccaaaagtccaatcaactaatgaatggattaaataaaacatgttaaattcatacaatggaatattggatggcattaaaaaagaatcaataagcaataatatggatgtatcttgagagtattatgctaagtaaaagaagctaattttgaaagatcactattgtatgattacatttatatgaaatggagtgcatgaaatttatgtgaaatgctagaagaggcaaatctagagagatagaaagattagtggttgcctaggactaggggagttggggggaaatgcttacagatgtggattttcttttgagggtgataatatttttaaacttaccgtggtgacagttgtacactctgtgaacataccaaaaactatttaattgtacactttaaatgggtaaatggcatgtgatatgaattatatatcaacaaaggtgttaactaaaggaagaaagagaaggaagtggaggaggacctgcccagatcatcagcttttcatcttaactgccaaattcgtttatagaaaatctatgagaacccccctaactatggaggtttctaaatgggtaatatagtttacatcagtgtctttaatagctttgatcaaaataaaatcgaattagacatagatcaaataagacatactggctgcgtgcggtggctcacacctgtaatgccagcactttaggaggccaaggcgcatggatcacttgaggccaggagcttgagacgagcctggccaacatggtgaaatcctgtctctactgaaaatacaaaaattagccaggagtggtggcatgcgcgtgtattcccaactactcaggagtctgaggcaggagaattgcttgaacctgggaggcagaggttgcagtgagcagagatcgtgccactgcactcctgcctggccaacagagtgagactccaactcaaaaaaaaaaaaagacatacccaatgtcttacacactgaaatcactgagacacaggcttagcctttataccaccctacacaacaaaacctgttacctaagaagaggtcatttatattagcaaggggcaatgagtacaacaatcataatttctgatttgttggaacccaaacaaaattaaatgattttcttagtgagaaaagttgctttggttacataataatatgatttctcggaattttccaattattaatattacttgtaaaaaaccactagcttgtcacttatgtatttgtctcttaaccttagtcgtatttgagggaacttctttaaaatagttttatccacccaccggtttcaaataggattataaaaaagtgaataaatcattttatgcaaattgaaacatagaactgagatgagattggtttttactggatgaaaattgaatagtgaaaaacttaggctacgagaaatgtcaatgctgatttaatctgtatagaaaggtgaccagagaacgtgcatcagtacgctctaagtaaacgcctctgaattcccatttaaaatgtagctgtttctttcttggtaagatggctcccaaataacttgttcaggaaccatcagggcactccccaacccaaaagtgaatgtcatgtttgtagcttaattcttaaactgaaaaggtaagcaaatacttcaaccctttctaattaagtagcatttgcttattcaaaatatctatttaattgccacaatacatctgattttcattccaaatgtttaacagagtaaaaaaatagtaattttctggctgggtgcagtgggtcacgcctgtaatcccaacattttgggaggctgtcgggagaatcgcttgaggctgggagttcgagaccagcatgggcaaaatgaaaaagaaaatagtaatttttaaagttggaacacttggcctgaatgggaaactggtaaataacctgctaggtatttttcaaagataagcaggattctaatttctaagcaattagtagctcccaagaatctcatttgcattcgatatttcatgtttaacagaatcaccacaatgtaatctagtttttctcctattgcagcatatgtcaggaaagcacttcatataggtgaacaactaggcttagttttcagtggaaaaagatgctttatttttttcaaatattatgaagtagacaagaaacaataaacattatgctcaaattaatataaagcatggattggataaatctctcaaataatttgatgtggcatctgcactcctcaaatgagagacagtacaatcagcctgcctttactcccaacatccttatttctaaactcagtaataaatcctctgtggcaataggatttgacaattcgatattgtacgtctcgttagcgccacctactgagtgctggtcacattttgtaaatctcagttaaaaatcactggctgaaaatgcagaaggaaccaaatcaaagtaacaaaaggatgacaatagaatgattacatctccagctttttattttcatcaatgctatttaagtataggtacagttaccagagcagtgaatgtcatgtcagaaaaagaattaattataaattacatttatataaatatgataattaatttgattaaaagaggatttacattgacaaaagcaaatattattaagccatacctgccttacccatctcacaaagttataacaaaaattatacaaaataatttatgtgaaaaatccttgggaaccacaaaacattaaaaaatgtaaaagcattattccataatgcaatagcattttcattttataatttttttcaaaaattttttaaatgctacaactaaatttatgatacatgctagatgctacttttaggctcaattaagcttagcatttggaaaagctgaaatatatactttcaaaggatggaaattttctacactatatgatttagaatctcttttatattgttttctcattcctataaaatagacaagctattttatagcctaaagtcatatttatttttcagttctgaaaatagattgaatcatacacactgagagtggcatatgaagacttcattaataaaaataaagttggtgattcaaacttctggttttgctgaaactgctaaaggattcatgaatcgcatgaggaacttaatgtggttaagtatcaagtttattgacattcaactgttggtgaggtttataaaatagatttattctatataagagatgttcctctcacaagctttgactctttcatcacctttctgtaggtcttgactgaaataataaaacaatataaaataattaaaaataaaaatgaagtgattccatgtatctgaataaatatattcactacatttagtctttctatcatatacatagtgcaggtggaacacaagctttcaagaatcaaatgatgctcactttgaatgttttcttatccacaatagacaagaatatcaagcagccttaccaaatttggaagcaactatttagttgctttacagatatttatttacagatatttatttacagatatttatctgtaaacctctaaatgattgtcataaacataaaagataactgcctgaaatgttaccttttcatagactaggctttgacattttgtaaatataaatgtagccaaaatattgaagtcaatccaacttcccacatgcaaatatattaatgtgtaacagaaatcatccttttgcccaattccccctacgtggcatctttatgtccatcccccaatcccccaggggtttctcagcatgaagagcccaattacaaaataggaaaagcgccactcaaagcctatatatacatgcagctgcaaagtgttctggagaggttaaaagactgatatgaatttggcccactgcatataacctggagcaatattgccagaaaagaggatttgaatgagcccaggttggaaaaataaattacctttatgccttgaaggcaatctccatgggtcaaggctaatgcctttttctttgctattgtgtgagataatcatctctatcacctttttttcttttcattttttttaaataactaggtggttttgacatttttgtggttggtaatctaatactttttcacaaattttctttcaggaaatagaaaattttttcagtaattgaatgagaatgatggatcatgctaataaatgtctttctcaaaacctgtcataactttaaatcaaagtcagggtattaatatgagactcctatattcctcatatttatttcatgtcagcatgtgcctagctgatgtcaacagcagaggaaaataacatcagggttcaagaaatgtggtaccattaacatttacatgacgtattgacttgataatgaacatcagtaaacatttcagccaaatataaataaaaatgtatttgtgtctataactatatttaatatacagaaactttaaggagaaaaacaagtgagccttgagagtaaaggtggtaacataacacataattgtggtaatggtcaatgcaatttaatgattagagtttatgagccagatatcaagctgctaatttactttcattatctcttatcatattcatagcaacactatgaactccatattattattcccattttacagatgacaaaactaaatctagagcagtaaaataatattttcaagcccactcagctagatagtgacagtaaagagaactgaaacttagcagatctctaatcaataagtcatacatattggcaagaagctaaatctgcaaagattgagagagacttttttctaattcactcagagtgattgtttgctcacgaagctgtgtgccttcaggactttctgctcaaatcgactggtttttctaatttatgcaaatacgtcaagtgacctcatattagcctgtgtgttgccaaatgttctaaaatttcaaaaagtttgcttttactcagttgatcaggaatgagatcatagagaaaagaaatttaaatttaacctaaaaaataaataggattttaatggggaagatggagagtatagtgggagggtaaaagaggatctttttagaacatgcaaaggatccacatgcagaaaaaaataaggcctatttgaggtataggagttaggattggctgaagcatagattttctagcaagatgggagatcggactagaaaggccaacgtgtggaacactcagaatgctaagttaaggtgtgtagtcaatggtcatgaagctgtggagaattaggaaggaaacaacagagtcaaaaataggattattactctggtgctgggtgtagatatttttgagcaggtaatatgacaataagaagacaatggagaaacttttaaggctagacctgaactacactagtgtagaagtggtggaaatggagaagagaggtaatctatcactagacatgcaagtattattctttcttcccgtgaacaatagttgtttttcggttcctagatttaatgtttgctcctgtggtcatcaaatttaaacactaaaatgttttggaatttgatatagttgtgaaaattatctaatgactttgaattatgattttaagagttcaatcaaagaatgaactttaatacctgatatgctttggctgtgtccccatccaaatctcatcttgaattgtaattcccacaatttccacgtgttgtgggaggaacccggtgggaggtcattaaattatgagggtgggtctttcctgcactgttctctgatagtgaattagtctcatgagaactgatggttttaaaaatgggagtttccctgcacaagctctctttttttacctgccgccatccccataagatgtgacttactcctgcttgtcttccaccatgattgtgaggcttccccagccatttggtactgtaagtccaattaaacctctttcttttgtaaattgcccagtcttgggtatgtctttatcagcagcatgacaatggactaaaacaataccccttcttctcttcaccctcttagtctcccaaaaagatacccaaacacatatacccacatcgacacaaaaatacctcttcagcctacagttactgtaggatgcagtatatagaatgtttggctctaagagggtatgtagagttattaacatcttgtttggacacaaatagaggccctcaaggagctctattttcagagacttttaggaagaactcaaggataaattactaggaccatacatccactaatagcagtattgaaaccctacaagggtattgatgcttttgagtactgacatcttgacaatcaagagaaatcccttatatcatatctgtgatatcatttgattcccaactgttctgtctaccaaattcagggaattcttcccagcagagtcttcctttttgtaaagatctttttgtatcatttgacaactgataagcaatttttagccaggtattatttaggcacattctttttatttcttacctattcatgtttccgttaaaatttgttataaatttttgccaactgatttattggtataaatcatctttcagcttattattactgtaaatgttattcactgttaaacaaataagccataattattatcattgtcattagcataattgctttttaccaattattaactcctgctagtatgatcatgattaatattattagaaatctgccacctcactgaaaatgttaagaaatcctatgtttattttatagataaaaactattattaaaaacttgtagcaccttaaactcatgtcttaaattgtttccattccaatcccaataacataaataataggactggcttccatttatttgtgtgtacaataatgcttgcgatgataaggtcactgaaggtcaccaagacatttacaggagctttcactacaccttgaaaagtatatagcccaaacatatagagctagagaaatcacttcttttggaactaccagaaaatatgtgatggatttaatagttttagttcatatgactccaaaaagtcaaataattgtagttagcagcatattaacataatcacctcacatatagttttatattttaccagctccaataaatctacacccctagatctatattaatattttaaatataaattagcacatctcaatacttaataagtagaaattcaaggaataatggacattaaattttcttataaaagggagcaaaggtgtcttataaattaggtgttcactacagggaaaggcattaatcagctttcaaaagctaaatttgtctcaagctcattattattcaaagcagtgaattttctctggtaacatgtcacagagggaataaggaacggaaattctaatgatagcccagcaatttaccatgaggttttaattaattaatctggagtttatgcacataagactgattatatgaaccaaagttcagttctacaagtatttcccaaattaaaggaatgctacatatttcaataatgtcaaatatgaaaaaatcgtacaaaatatgattcagtatataccaaaattaagaagcagttatagtatacttctttgccaaacaaggcaatcattaatttttctcacactaaagtacacaacaaaagtatttacaatttatcattacatccaacattgaaaaatgataacaaagtgatgacttatataatttatattgatgaaaattgggatgacatgaggaataagcactgacaaaggtgtagtattaaacctgggctttctgagtttgactcttgttacaaataatttcacaaaaaccattgattattagatgtatatgtccctacacagaaaaaaagaaaagaaaactgggcatgcacaaattttaaaatcagtattttccagaaagatgagtataattttcctaccaataaatctaattgatccagttctggtgccataatgttcattaactcctttggtattaaagtgattggaaataacataaaaacctgagcatgttgaatggtatatgctaacagtccagttctaatacacttatatttgtggtcattactaacaacattattcacatacacatagccaaccttaatgcaaacgtttcacatttgctaatgacagtttttgattacttcagaagagaggtccccaagttaggtttatatgatgcagattgtctcataatcgaagaacctgttaattgaagaatcacacttatatcccttcagttttagctaggaacatctgaaggactgatgactaagttgcctagagctatcattttttgaatttcagaaggcactgtgctagttgcctctgcttctacactttctctataacctttctttctctttaagctcttactcagcaggcatgaaatgtatttaggaacacatgtattataaaagtctttcagattaaaaatagaaaacatttacagacttgttaagacgatagaaggttgtggttaagaaacccatggaaggaaggacatagaaatcatcttagcagttgtacaactttttatctcagtacttctaattggcctatgtcaagtctcacaaagggtgagagtagcagattgtcagcattcagaatacagcattctcttatttgtgtgtgtcttacattcatgctccccaagtgtattagattgggtccataggaaaagattctgagataataagctctctgcagaaagtttattgaaaagtattctcaggagttgcctgcgtaaagaaatgtggaaggcaggactgaacagaaacacctgcaatgtcattgcaactgaagtcttaggcaatgccaagggcagccctgcaaatggaatggactctgagtattgttctgaattgagatgggagtaggctctatagcaccacatcagccagttactggttatgcgtcagcctctaggaaatgacataagctggctgaaacatttccctgcaatggagggctatgctcagtgagtgaaatagttgtacactgtcagcagccaatattcccagcagcagagaaatggcacttaggtgaaggatcagagcattcaccacaccaggatgggacatatgactgggtcaggatacccccatctaaataggaccatatcattaggcttggcttattataccaagcctattcatggttgccattggctggtgccccaggagctggtccaaccagttaatgccaagtaaattggtctgttctcacccaaaacataaagtgtgaaggattgccaaggactctaggtgtggcagggatgtaaaggtttacaaactcatcttcaacataacaaattaccaacttctcaataacaacacagaaacagcaacaatataataatattttatgttaatttggtatttacagtctagatactatgctaaatactttacacaatttatctcatttaatcttaacgggaaccctatgaggtgttattattttactgttacagacggaaaattgaaacccagaaaaatgcagaaaatgtatccaatacaataaaaataataagtcatagaccttgaaacaaagagtttcagagtctttcgttttaagaattttactaaacaacccacagagtctggcttattaatgaccgtatactacttgtcacttgcatggaaatctgttggcttcattttaagtataaatcattttaagtataaagtcatatgtactatattacaaatattgcaaaaattgacattgtacttgttggatttgaaatctgttggcttaattttaagtaaagtataaagccatatgtactatattacaaatattgcaaaattgacattgtatttattcagaggtcctatatccaatgatcttaactcttaagaacattattgagaaccacaagaccagtttaagagacttttgtgttctggtagaaatggaataatggggattgaataatctctcctgccctaaacaactagatgattggacaaaacctataacaatcattataaaagatgagactgctgttggaaagcaagtatcatgggactgtaatctctgagaaaaaggaaacaaattgagtgagccctgaatgcatcagctcactccagaggcagtttcacaccaccttttaggaagatgggaccctaacagagcccagtggtctcactgaattgaagaaccagagatcaatgttggaggaataaagatggttagaatttgctaagaggaatatggtactatagaggtagaagctaaacagggagaacttcagagatctgcagaggggtctacttgaggctctgagtattgacctgttcatgtgtgacaagaaaacacccaaggccagagaaacacttaaaaacatttgaaatacaaacagggctgaaagtaatttgtgtctccagagcagagtggaaagaccttgtaatgcaagatctatcctgtagagtactcacaagtatgttaccttggttgtcagcctaaatttgccctatgcgacaagctaatctaaacctaccttacaaatacttaaataaagcttcaaagatatctacctgattcctgcagaataagtgcatgccagaacaaattctaacattatttaaaattcagcaaacaacaaaataaaatttacaacatcagacatccagtcaaaaattaccagttacagagttacctcattttatcgtgtttcattttattgtcctttgcagatactgcattttttacaaattgaaggttggtgtcaaccctgcatccagcaagtccatcagcaccattttcccaatggcatgtgctcattttgtgtctctgtatcacattttgggaattctcacaaaatttcaaaagttttcatgattattacatcttttatgatgatctgtgatgagtgacttttgatgatactactgtaattttttcaggacacctcgaaaactgcctatacaaaatggtgactttcattgacaaatgttgtgtgtgttcttactgctctaccaattggctgtttccccacgtctctacatatcctagggctccctattccctaagactgaacaatattgaaattaggccaaataataacccaacaaaggcctctaagtgttcaagcaaaagagtcacaggtctctcacttgaaatcaaaagctagaaatgattaagcttagtgaagaaagcatgaccaaagccaagacagactgaaagctcgacctcttgctctagttagccaagctgtgaatgtaaaggaaaaattcttgaaggaaattaaaagtgctactccgattaatacaagaatgataagaaagaaacaatgccttattgctgacatggggaaaattatagtggtctggatagaagatcaaactgtaactcagtagcttagcttcaaaacacattttaaaacctttttttttcattttctgttttctccctagtctcaagatgtaaccttgaagcaaacaacagaaaccttttattccctccttagccttaaaaaaatacgctaaaacatactttaaaactctgtttccctccctttcccactctacactatgttacaccatgcacatttacctaactatatacttgtatttaattacgtgcttacttagaagttccagtggctaatcttgagacagaccaggaatggagcccaagctgcaaaattctagagattacctcaaggtggtagtcaatatgcagccattgttgatatgatcccagaccacactccaggtggaccatgactcaagatagctaccagaacaagacacacagacattgtacccagcactactccccacatgcctctcattcccagttccctttttaagcccctctcctcagcataaagtttgaaatggttcctttaaggtatgagccttggccatttctcccactgctagctctggaataaagtcactttcctttcaccgcattttgtccatgttactgactttgcaagaagtgagcagctgagtttgtattcggttacaaaaccagccacaacattcccttaagccaaaacctaatccagaaaaataccgtctcttcagtcctatgaaggctaagagagctaaagaagctgcaaaagaaaagtttgaggctagcagagattggtttatgaggttggaggaaagaagccataaaaatataccttgtaatgcaagatggtatatcaccataccatatcatcataccataaaaatgcaagatgaagtagcaagtgctaatgtagaagctatagcaagttatgcagaagatctaaaataattgatgaaggtggcaacacaaaacaacagattttctatgtatatcaaacagctttatactgggaaaagatgccatctaaaactttcatagctagaaagaagtcaatgcctgggttcaatgcttcagcagacaggcctgactcttgttaggagctaatacagttggtaacttaaagttggagctaatattcatttggaattcaaaaaatcctgtagcccttaagaattatgctaaatctactctgcctgcattctataaatagaatcacaaagcctagatgagagaatatctgtttacagtatagtttactgaatattttaaatgcactattgagacttactgctcaaaaaaaaaggattcctttcaaaatattattgctcattgacagtgcacctagtcactcaacagctctggtatagaggtacaaagagattcatgttgtttctatgcctgctaacacaatatctgttctgcagccaatgggaaaaggagtaatttcaacttttaagtcttattatataaggaatacatttcataaagctacagatagtgattcttctgatagatctggtcaaagtaaattgaaaatattttggaaagaattcatcattctagatgccattaagaatatttgtgattcatagaaggaggtcaaaatatcaacaggaatttcaaaagaagttgattccaaacctcatggaaaactatgaaagtttcaagactgcagtagaggaagtaactgcagatgggatggaaagagcaagaggattagaattagaagtggggggcctgaagatgtgactgaattgctgtgatctcatgataaaaccaggagttgcttcttatggatgaggaaagagagtatttcttcagatgcaatctactcctggtgaaaatgctgtgaatattgttgaaataacaacaaaggatctagaatatctcattaacttagtacataaagcagcagcagggcttgagaagattggctccaattttgaaagaagttctattgtgggtaaaatactgtcaaaaagcattgcatgctacagagagatcttttatgaaaggaagtcagttgatgtggctgacttcattgtcttatactaagaaattgccacagtcaccccaaccttcagcagccaacatcccaatcagtcagcagccatctacatcaaggcgagaccctccacggtgaaaatattacaactccctaaaggctggggtgatcattagcatttttaaacaataaaccattcaactctgaccctgtagcaaaaagcaatcatagacaatatgtaaatgaaaggatatggcgaggctgcaataaaaccttatttcacaaaagaggtggcacacccataagccgtagtttgccgaaccccttcctagagctaaaaataccacatcggatatttttttaaaagccataaataggattaacttcagatgagattctgtagcagaagagattagtgaaattaacacggtaactattcacaatgaaatataatgagaacgaagatggaaaaggaggaatatagagaggatcagttaccttcgaaaccatatcaagcagtctagccgaaaaattggagtccctgaagacagaaaggggacagaaaaaatatttgaaaaaataatggctgattatttttcccaaaatttattgaaaacaaacccacagatcaagacagctccagaaaccccaagaagatgaggaaagtaggcttagacttgttaggtaatttttccaagacttttttattacaaggtatgtaccaattcatgtttgttgattcaagaacccaagtttatacctatttggtacactttctcccaagcttgccagaatgagtctagtctccataataagagtgaaaatattgtttttagagaaacccatgtgtatcaggcactgtacaagatattatctcatgtactatctcatttggtcacaacttatctagtagataagaatcattttctccattttacagatggaagaactgaaactagcagaattaacattgtgtgtttaaataattgccagtaaagtaggggaaaaaatgcactctcaagtcttctgtatttccaggcagggctttcctatagagatatgtggatggcatatcccccgccaaaaataatagctgtagatatgcgaactattcaaaaaagaaattgttatatgtgttatacaactagaaatcatgcagtttaggaatatttgaaatatgaactcattgaaaagaaggaaaataagaccttcaatttaaccattaggtcaggcaattgctggcacatctaaattactgacaataaatctcagagcaagtacaatacttctaagtatggttataagaattagaatcataaaaccatagaattgtgaaattacttacacatcatagaatccaatcccttctttttggagaaatggaaacataccccagaaggttaaatcatttgcccaaaataacatgattggttgttgaccctttctactaagccatccccagttccactccagaaaatataaattattcatgcagaaagacaaacttaattttggcaggtcagagatttcagaaagatgtgaattggctaagggttgtgatttatgaatctaggcagctattcagattgccttatctcagctgtccctctgtgaaacataccattctgagtacctaaattgacctctattcaaccccactttaccatcattgggtatgtcatgagaagaagggtaaattactctgacccaatgcaaaatactgagaatcaaaaaatggtagagaggaaacatatatagagattacttccccttgttttccagatgtaaaataagccaagacagtttgtgaccatactctgaaggattaaatataaatcatcctttattttaagcaaattatcagcagcatacatttcaaccatatacacatatacatgtgcatgcatatacacatatacatgtgcatgcatatacacatatacatgtgcatgcatatacacatatacatacatacacaattactcatgcttttatgtaagccccatggaggcaagggctacactgttctcacaaatttctaacaccttgcacagtagctggtattatatatagatgctcaacatttattcaaaagaaaaaaggggtgaataaggacaaacacatagaacagcacagctctaaagcaatgaatgtaacttgcttttttattttcagatttatcatggtatacctaacaaataattataggtatttaaggtgtacaacttcatgttttgatattcatatacattgtgaaataatgaccacagtaaagctaattgacatatccatcgcctcccataattatctttgtgtgtgtgataattacctgtgtgtgtgtgtgtgaacatattcacagtgagaatatgtaagagttacctcttaccaaatttcaagtatacaatacggtattgttaaactatagtcacattgctgtacattagatttccagaagttattcatcttgcataactgaaactttctagtctttgaccatcttcccatttcccactccccactagcttctggcaatcaccattctactctctgcttctatgaatttgactattttagagattccatatacagtgaaatcatatagtatttgtctttctgtttctggcttatttcccgtcaacataatgtccttcattttcattcatgttgcaaatggcaggattttcctcctttaagggcttaacaatattcctctctctctctgtgtgtgtgtgtgtgtgtgtgtgagatttctttatacattaatctgtggatggacatttaggttgtttccataccttggctattgttgaatcaggctgtagtgaacactggggtgcagatagctctatgagataatgatttcattcccttcaggtttatacctagaagtaagattgctgaattattaaggtagctctatttttaattttttgaggaatctccctactgttttccttaatgactatttcaatttacactcccaccaacagtgtgtacaagtgctcccttttctctacatcttaccaacacatcttttattttataatagccattctaacaggtgtgaagtgatatcttattgtgattttgatttgtatttccctgataataagcgatgttgagcactttttaagacttattggccatctgtggttcttcttttgagaaatgtctatttatttttccgcccatttttgagtcaggttatttgagggattttttttttttttttttttttttgctgttgagttgtatgagttcttcatatattttggatattaacccttatcagatatacagtttgcaaataatgttctcccaatctgtaggttgctcattcaatgttgggttttgggggggtttatttagttttggttttgaaggccttttacttttgtgtgtgtgtggtttttgttttgttttattttgtttttgctgtgcagaagctttttaattcaaataacttatctgtatttttgtttttgttgtctggcttttagtgtcctatccaaaaattcatgctcagacccatgcgaagaagcttttgttttatgtttccttccagtaattttatgttctcaggtcttacacttaaaactttaattgatttggagttgatttttttatagggggtgaaataaaggtccaatttcatttttctgcatgtggatatccagttttcccagcatgatttgttgtagaaactatcacttccccactggattttctttacattcttgttgaagataagttgaccttctggtggacttattttggggatcccttaatttccgtttgtctgtgtgtctgtttttatgccaatactatactattttgattactgtagtctttatagtatatttttaaatcaggaagtatgatgcctccagctttgtttttcttgatcaagattgctttggttatttgggatcttttgtagtttcatataaattttaggattgttttttctatttctgtatagaatgcagaattgaggtttcagtagggattgcattgaatctgtagatcactttggatagtgtggacactttaataatattaatttttccaatacatgcatatgaatgtctttccatttatctgtctttttttttcttcatcagtgttttataattttcattgtacaagtctttcgcctctttggttcagttaattcctgagtatttttttctttttattgctattgtaaatgagattattttattaatttctttttcaggtagctcattttttgtttgtgtacagatatgtcactgatttttgtgtgttgattttgtgtcctgcaactttactgaattcatttgttagttctaacaggattttttggttgagtctttagtgtctcctacttgtataattatgttatctgcaaacagagataattttacttctttttttctgatttaaatgttgatatggtttgaatttgtgttcttgtccaaatctcgttgaattgtaatcctcaatgttggaggtgggacctgtgggagatgtttggctcatgggggcagatttccacctcagtgttgctcttgtgacagtgagtgagtgctcgtgagatctggttgtttaaaagtgtgtagcagctccccacgctttctctctctcttcctcctactctggctgtacaaataaatgcctgcatccccttcgccttctgccatgattttaagttttccccagccatgcttcctgtacagcctgtggaatcataagccaattaaacctcttttctttataaattacccagtctccattatttatttatagcaatgcatgaacaggctagtacagatatctttttgggtccaattgctctggttatgacttctagtactatgttgaatataagtggcaaatgtgggcatccttactttgtactggatcttagaggaaaagcttgcagttttttttccattgattatgatgttagcagtgggcttttcatatatggcctttattatgttgaggtaagttccttttatgcctaattagttgaaaggttttatgaggaattgattttgaattttgtcaaatgatctttctgcatctattgaaatgatcatgtggtttttgtctttcattttgttaagttggtatatcacatttactgatttgcaatgtattaagcaatccttgcatctcagagataaatcccactggtgtattattcttctatctatgttgctgaatttggtttgctagtattttatggagggtttttgcatctgtactcttctgggatgttgccctgtagttttcttgtggtgtttttgtctgactctggcaacagggtgaaaatggcttcataaattgagtttggcagtgttcctcttcaatttttcagaagagcttaagaggaatcagtattcattcttctttgaatgtttggtaacttgttgcaaactattaaattagaccagatgtcaatgtaataatatataacatttatgcattaatttgcatgtgttaatcatcatgcataatgctttaactcatttttatttattttgatcctattttgggttctgaacaaaatttaccctgtttcttgtttacaccacaaggtcttaaatgcttttaatctcagaaagaagttttaggacaccaagaatgtctaccaaaagattatacattactcccagggtttagaatagtactggcatatagtagtgattaataaatgtcagcaactttttgtactaatagtagtagtagtaaatctgagctcgccttccctcctttatctgaaactaaaaacttcaagcaaatttgagcaaacacccttgtattggtgcctcaaattttgcccacttactcagaaaatttataaatgtatcctggtcattttaaaaattttagggctaaaagaacaaaggtatattttaatgattaaattaactaacagccttaagtctttctggggttcactcccactagtccttgcttacaagtagatgtcttggtatcttgatagactcaaaaggaaaatgcacttattttccaagtagagacagagagagagagagagaaaagacattgaaaacagacatggaatttgcgtctgttatttattcttccctgaaacactcttactctggccaacacaaaggttctttaccctcaaggaagtagtgactcttctttgcttaaggagtattaatttgttaatatatagtagtctgtataacaaggagaccatagttggtccacggtctcattaaggacaggataaatgttctccgaatcctttcataatccacatacaacaatcacttgaggtaaatacgattttcattgccagtttgagaaactgggattcaaggacgtgaaataatctgcttgaga

SEQ ID NO: 329 - DNA, 196675 bp, Homo sapiens
acagatgagagagactttggaaaagaaccacagggctgggctctccccagagagaaagagaagagcaagagactaaagatagaaccttggagacgtgctcacttatggggcagcaggaagaagcaaaagaagaagaaggggagcggcatgaggaggaggagaaggataggtcaggcctgggcgtgaaggaagcatgacgttggaaggatgaacaaggcttcaagaaggaagagttggttatattttccatttttcggttaataactttattcagacataactcacataccatacaattaacctgtgtaaagtgtacaacccaatggttttcagcgtgttcacagtcatgcaaacttcaccgcaatcaattttgggacattttcattaccccctaaagccccataccctttatccattacattccaagtccccatgtccccagaaataggcaacgaaaatctactctctgttttatagatttgcctactctagactttcatataaaaggaatcctcaattattgaatttgtcttcttttgtgactgccttctttcacttaatgttttcaagacccattcgtgtggtggcacgttatctgtacttcattcctttttatggccaaataatattctaatgtatagatataccacattttgcttatctgttcatcaactgacagacatttgggctgtttccagtttttggctattacaaataatgctgttatgaacacttgtccaagtttttgtgtggacatttgttttcatttcttttgggtacatatctaggactggaatggcctaatcacatggtaactatgtttaactttttgaacagctgtcctctggttttccaagggactgcaccgttttacactcctaccagcagtgtataagggtttcaatttctccacatcctcgtcaacactagtcattttcaattttttaaaatttattaacctaatgaatgtgaagtggtatctcatgttgattttaattcacatttccttcatgactcataatgttgagcatctttccatgtgctttttggccaagtgtatactttctatacactatagataagtctattcagatcttttgcctattttaaaattagattatttgtctttcattactgagttataagagttttataattgcagatacaagtcccttatcggatacatgctttgcaaatattttctcccactttatgggttgtcttttcactttctagatagtatcatcacaagttgtcacttctgatgaagtctaatgtatctttttctttggttgcttgtgcttttggtgttatacaagagtcctttgccaattttagaatcctttgccaaattcaaggtcatgatgctttaccacctacattttcttcctggcgattttatcattttaactcttatatttatgcagttgatccatttgagttaatttttgaacatgatgcaaggtagagatccaacttcatttgtgtcttgatatccagtcccaggactatttgtttgttagaaagactactcttggctgggcatggaggctcacgcctgtaatcccagtactctgggaggccgaggcaggcagatcacctgaggtcaggagttcaaaaccagcctgaccaacaaggtgaaaccccatctctactaaaactacaaaaattagccgggcatagtggcgtgtgcctgtaattccagctattagggaggctgaggcaggagaattgcttgaacctaggaagtggatgttgcagcgagctgagatcacaccattgcactccagcctggacaatatggcatgactctgtctcaaaaaaaaaaaaaaaaagaaaagaaaagaaaagaagacaagactactccttccccattgaattgtcttggtacttttgtcaaaatcaattgaccataaatgtaagggtgtatttctgtgctctcattctattaccttaatgttttacacttgtcatccatgtcctatgccaattttttatttttatgttacagtacagacatctacttcttgacttggtgacccaagttagtgtcatttcccttagactaccagctccagtgagttcaaacaatgcctacagaacttgctttgcactgtggcaggcacagcccctgcagttcataaatctgctgtacattacagggggagttacattacagggagttacaggatgcctgtaactcagtgtcccaccctgccggcttccgcttatctgacagccacatcaagccaactggttcatcacacaccctgaagtcagaaggttgtggctcaacactatgttttagactcgaccaaactgtactctgatgaggagctaatgagaaagagatcaacgataggatgatcatatgttaaagtactcatgtccatggagcagggagggagggagagacagtgagagcaagagagagaagaaatgaccaggagacactgagagaaagggaagggaccaaggaattgagaaacggggagaagaattgaggaaggcttatttaaaattcttatcaatcacttgactaagtatcccctcaagatagcataactgtaggctgctcaaagcacaggtgtgggtggcagagaggcccacgtgtccaacctggctctgctccctgccagccatgttgccttatgcaagtaactccacatctctaggcctccattccatcatctgtcaaatcggataataagaaaattgccctcagggggtaggcgtgaagattaaataagttaatgctcttagcccagggcctggcacaggaagatcaatacaattagtgcaaaccacaggagagttgaataaccccctactagcctcatcaccaactgtataaaccagtggacctcgaatgaacttcatgtgcattggaatctccagaaaggttgtttgacagagattgctgggctggcaccccagggtttcaggttccgcaggtctggggtagtgcttctaaatttgcatttctaacaagttcacaggtgacactgatgctgttcttccaaagaacatactttgaagaccactactctgaattatgaagggtcaggaaaacaaaatgccacttattggcattttaaattctcaagtgaaaagtctttaaataaaagccctaataactgatcccggatataggcaccctgaaccatctggaactcactaatagaaagaaaaggtgactttaattaccaatttctggaatgtaaaaatacaatcaagcctagttgccacgataaaagtgtcctttaaagcctttatttgactggaaaggaagaaatctgaagcaacatgtaatagcacatgtgcattaacaacatcaaatgaggttgtctttaccatggaatcgtgttcactgtccacacaagtgctcaactggggccattgagaaaagcttttttctcaccaaaatcttgcaacaaaacatactaataaaacaatgcttacccatacaggaaatgcgttgtctgctgtctacttgggaggggctataaatagctccttggagaacattgttctataattagctttcacttcaagtgaactatgtgtaatgaatttcatatcactagatgttcttcctgggcaaagtatatggcagattatgcatctgttaatgttgaaactgaacaaacggcattgcacggaagtcagagaatttttaaatgagacagagatggaaaccacactatgaaattgactggaagtgcccatttggggtgtatgtgctcttacaaacagacgtgtgcaaacacattaaattacctcttcatagttgagttaaacaggcaggtgttgagagcaactaaagacaatggctgcttgagcctccatacagctgtttcttggccctattcttaaagggtgttccttgcactttttagaaaagtgcaaatctcaaatttgtttgagtctccacgaaggagggccagggcaaacacctgaaagagctgaaatggatttttctacattcaatgcactttagttccaattccacagtgacttctgaaatcctctcagctaattgcaggagctaaacaacacctcccattcttctggtacatttacagttcccccacatttgctgccctcgcaccttcctccccccacaactcccagcaccctgctacacaaaagacttttcttcattctattttccacatgctctgaaatcagtgtcccttctgcattccataggttccctcttgatggctgtttggctaggatggggtcatttaaatgcctccctggagcactcagaatttgcgctgaccattgaaaaatgttcctgttccagtgagaaaggctccatccccggccactaccttaaccagcaggatgaccggaggtaacagctgagcaaagcccctgccttgggctgacctgcactggtcccatattcttgggccaagatgagcatgcctgacctgcacccaaactttccatttaatgagaggaacttgcatcctttcccaacctgaagcccagagctggtttgaagattgcatatgtttacaaaagaacactcccatccagtctgttgccaaagtccaaacagtgcccttggtgagatgccagtaggccaataacccatgtatcgacccactgacttcatttccttatatgaatgatcaggacctagtattgctcttttgccaatccaatcctttatcctggaattctatttcaagcacttggaagacagctgctttaagaatggagtaaagatattaataactgatgcactgatgggaggatgagagaaaacagagacaagaagtgtgtaacactgctttggtatcagttcattacccagcaagatctcatggggagtgaatgatgccgtgaatatctttgtgttggcattggatgtggcgatgtgctgggctgggtgggagaaagcccgggcttggcagtcatcagggtcagtttcaagtcctgctctgtcttgcatttgccaagggactgagggcaccttgagcctctaagtcagattccttatctgccaactggaaataattaaacactttttttgtacaggaccttatgaagatgaaatgaggtaatgtaaataccttggcatataagtattagataaatgtcaccttttattcctgaaaacattattaagtaaaatatcatttaaaaattctcttatccagatgatggaatagtattcaatgcttttaaaaaaaagtgctatcaagccacaaaagacatgaaggaaccttaaatgcatactactaactgaaaggagccaatttgaaaaggtacgcaccatatgattccaactctatgacattccagagaaggtaaaactatggagacaataaaaagatcagtggctgccagtagttggggggaggaagggatgaataggcacagaatagaggatttttagggcagtggagctattctgtattatactattataccttaatggtggatttgtgtcattacacatttgaccaaacacaccaagagtgaaccctcatgtcaactatggactctaggtgattatgatgtgtcaatgtatacaacaaacctagcactgagggaggggatgctgatagtgggggaggctgtacatgggagggggggtgtatgggacctttctgtatttcctctcagttatttagagtcaaaagctgctcaaaacaataatgtctatttatgaaaatcctcttagaagtagataggatctaaaatcacactttattgttagagaaaatgtacatgaaagaacttcctcagcggggcttaagcataaggaaatattattctcaagtgccggtattggcaataatctcacctctttttcagatttgtgtatatgtttgtgctaaggctttagggctttgtcacctccagactcctccagccctgttttcctccctggctcctccacacggtctttgtaaggaaatcttacttcattctttagtttgccaaccacatgatctaataggcacaaaaaccaagttaagtcttaaccctaccaggcaggctgtacaaggccttgattgtctcctggtagcatcctctggcccaggcgggagggcgagagcctgctgcctcctgcgctcttctattctatgaagcttatgcagaaacagcacatcaaggtgctaaccttgatattgtttctttttttaattaattaattaatttttttttttttttgagagacggagtttcaccatgttgcccaggctggtctcgaacttctgagctcaagcaatttgcccacctcagcctcccaaagtgctggggattagacatgagccactgtcacggcctaatcttgatatttgaaacacatgataggcgttcctcagtcttgctttcaaaggtactcttcataagccctggcctctgagtcagtctccaattattgggttctaaagcctcttcttcacgtttatactgacccaacttccctttgccttggttgctacaattttcttctctagcataatgttattctatccaatgatgcgtggtattgtgttttttcttttgagttttgaagtgaaaactgataatcagaggtaagaatccacaaatgggcttctggacattcacatgaagaaagagggccttcccaccttgtgattaactagaaaaactgtgctaacatctggcatggaaccctgttcttattgtctgttccaaagcttatgctgaagtcattgaatgtatacatccaacaagagtcccaagccctgggctagtgctgtaattcgtatagcagcccacacattcttgcccttgtgtaataccacgaatgaacacccatagtcacccaatacatattttgaaaatttaatgtgtgcatatttaaaatgaggatatgccacagattcaacttctatgatggaaaagaatatccaatttgactgtgagaactttgaattatttcaccgatacctctaaagactgataaaattgactgcaaaaatttttttatcctcccttccatacatttggattctttgaaaaatatctggagttcctgaatacatcaaggcaacattcaatcagtaaagccatgttcttttaaaggcccaatgactggaactcagtgagaatgtcccaaaactggcaatgcagttttgaaatggctcttttgctccatgctgcacattttgaacaatgcatagatgatctattgtagcttggctttgttatttggttaacgaaaaatccaagcaccaatgtcacctcttccaagaagctcatcctgagtccttcctcggcacccatgggacatctgcttttggcttggagggcttttctgaccctagccctatttggctggtgtttatgcctgcctcaacatagtaaaccctttgtgtatagaaactgccttaatgttcccttgatccctcacaggccaagcccagcctgactcatggcaagccttcaacagatgtcagtaaaaggaactcaaccgtcaaatgcatagaatgaacatggggtcaactctcctccgtagctctcttccgcatgtgggggaaagggcctagtctaactggcttctgtgatgcagaatccactctgccttatggtcagataggatatgtggcctatcttagaggtatccttcccatctgggtgagattaacattaggacacgggatggagtttggaataaatacgacaaccacatacacgtcatctccaggactaaaaaggcagaaaccacatttagtaggggcatctactggacaacagagaaaaagagaccacagcaaaaacactttttgtactgcagaattatttgatgagttactactacaggacattccaggtttcctaaaagaaaatttaatgattgttcaacaagttcccaaaagggagtaggaaaagggagttggaatctcttccaaagcaaaaaaggaagggaggtgactttaaataatgctttaaaaccggttagaagtacacaatttcatcctttagtaatattagtcatggccacgctctaaaggcggggtgaaacctacttgcctggaggaaaaggacggggtagaaaaacaaagcaaaataaaatccatcaaacaaaagtttcttcttttggaaagggagggacttcaaaatcatgacaggccaaatgcctcctcctctttcttgaaaagccctccaagtcagaagcaagcctgagaataacagctgctcttaggatgctcaaagctccttgcagctgattatttttcaggaggagaattagacacaaataatacaagtgggaaataaagagaatgacctactttacagggggggtaaaaaggagctctgtgtgagcgttttgatctaattgacggtgtggggttgcatgcccaaataaggcgctgctggtcggatctgcgagggagagggcacgtctcaaactcgagggagaggacgagacagcgagaggaacagcgtccggggcgacccccagtccaccgcgggggcctggcgcgcttggggcaaaggccctaggagaccccttctggccacaaaatcgagtatgacagaaaagggccagcgggggcgctttccttccagggccacttgccggaatgtaagagggacggagagacgtccggaaaaggctgccacgctcggagcgctgcgccaggccaggcacctaggccaggggagcggagacctcgtgggagcgggcagggggacctttcccctctcccgggcttccacccaggcgcctccccgctgtgaacgccgccgcccaggtgaaggggaaaccggccacgtttccggacctcggcggggcacacggtctccggttttcaccggctctgtcttggagccccgaagggcatcagacagcagccccggcacccggggattattcctgtacctctgcctccctccgcttggcgtttgcgggaaccttggtaaaatcctccctgtttctcgcgcgcgcctctctctccagcttctttttcttggattctcgcctgtctcctcccacagaggaaaaaaaaaaaaaggtcacgtatgtttggaaaaatatgtaggtcagtggaacatttcctgcactggtgcaaaaggagaggagggcagcggaggaggggagggagaggcagagtggagctccaagtgcccgctcctggccgcagccccacaccccacgtgcccctgccggggaggggggcaattagccggttcctttccatccttgacccattttccggaccagctacgttcgccttaggacaggcactggttattcctccccagcagtcgctgctgtcctccgccgaccaccgctcgcccgcatcttccccgacccccgcctcccacctgcccccgggccgcacccccgccgctcattgagaaatcgcagtggtccccgcagagacgcgctttgtgccctgggtcgagacctgcgcgcaaccctgcccctggaggacagtgtggagggggtgacagtcgcgtgctcgtcccccttcatcccctgcgcgggacagcagggtggcggcccgcactgcgagggtctacactaggcgggggcggcagattccttgttccccccgagtgacaactttaatgggacctcggctggcagcctctagtccacttgcctctcctctgggccggctcacctggaagcacaacccccccctcccccagccccggcgcccaaccccgaccctgcgccccaggcccgaccccgccgcgcgtccctggcagcccagcagaggctgcggcggcctggggactcgcgggtgtctgcgccgcccagggaagccgggggtctagggggccgggggtccgtctgcctgcggcgcgcgcggggtgcttgtcccaggctgggtcggggccaggagagaccccgcaggcggaggcaggcgaggggaggaggaggagggtgggggtaggagggggaggtggagagggaggagggtggagggaggaggcaggggaggaggcagaggcggaggcggctctccccgccggctctgcgtgcggaagagtttgccgcgcgagcagccggcctctcgcaggagccgagggacccgcgcggctgcggcccaggagcggcggccgcggagcccggagacccgcagccgcggcggcggcggcggcggcggcagcagctagagcagcgcctcccgccgccgcccgggaggagctcgccgcgcccgctcgccgcctcgtctcccagcggcggcgggaggcgcgtctccccggcccagtccgcgcccggccccgcggggccgctccggcccgctccgaggtaaggggccgcgcctaggggcgcgggggacccagggtgggtagtacgtgcgcgcggggtcgcaggactcggtcacctgctcgccagcgtggaggacgcgcgggggcggaggggcgctcaggcgcgaggctgcgcggcaccggggaccccggacgcgggggcgcggagaggtgggttcccctccacagtcaggccgctgggggcttcgcgtcctgcaggaggtagcaatcgctgggccggtgggctccgggcgcgtctcgacgcagaagacagaggactgggcatccgagcctcggaatttgggggtcctcggggtgtccgacagggtggagaaggatcgtgccccagggcaacagctttggggattgcccgtggttgtcttcgagacccatcgcgctaccctccgaaacgtcgggcgtcctggacccccggagagtgcggcgtgcgcgccctgggcccgcggtctctcggagtccctgggtcggaattggttccgggccggattgggtgcggaatcggtgcccccaacccccgtgtgcgcagacagcgtgcagcctggctcctcacgtcgctgccgcccccccaccccaactccggagctccccaggttggatgtatgcgtatggttttgttgggagatgtgcccctttcccagccgaggagggacgcacctttgacctttctgaagagctgggcaggtcggtaaccagggaagggacaggcaccacccggctaaattcagaaccagtcccgctcctctgcttgccactccttaattgctcaaggtaagaaagtttgtttcagccctgtgattcataaataattagtaactagttttgttgattaagcaagatggaaaccttgaatatacgcacgcacttccacaaagtctaaacactcccgagcttgtgtccgggaggctttagtacggaaagttagaagccctggagttcaacaggtgttcaggagggtcccggagaggagtttcgtctttacgcgttgctttggcatccaccccaacttcattaaagtggttagcctgttttcctacaggtaaaacattgatcacttattaaattaacttaatcagcagagacgagctaaaccgtcttgatcatttagaacccaaaccttattttccttaatagaaaggtttttcctgtttgaacttcccaggtaattagttctaaagtagttcccagcaagacatctctgccagcatctctctctcactgtagcttggtccccatcagtgaattgaccaactaattatggcttgcattaaacacagagctgccctccttgggaggcactgttcacattcaagcgcacacactagctccatcttcctgccactaagatgtccttaaaggaaaaagttagccaaaaataacccccaaataaatagtgtaatgtttaaaagagttatcctgacctgcgccactattttataaaagcaaaaattcagtgtttcattacagcgctaaaccaggaccagtagaagtattggtatctctcagcagtctacttaaatatttagttaaaaataaagtgtgcaaagtaaagacgttcagtaattatcttccatctcacagagagatgtggagtatggcttagaagaattgtaaatgcgctgcttttagccgttttcttcttggaaatcgatgcctctatttatttgctgatctgtcccactgtgcgtaaatgtagaatcggttttattctcactgcttcccagaggggctcctgtggaggtgaaagaaggaaatacgttctagaggaaatatgttattaataaaacgttacccccaaagagttaaccacgccaaaaataaccaagtgaggctttactaattagtggtctgatgagagagtgttcagatgatgactaaagaattgatctttatgtagaaaacaacaattgtttttaagctcatttggttctcttaaaacagtttgggccctttaaaaaaatttctggctgtttaataatgcaaatgatgaaaatcgttaaagataacacatataacctgatgtgtgccatgtttaagttgaattcaccctatttttttgaacaatctttcttaactcttggtaatctttatagctcactcaacactgcaacttattagattaaaaactgaaagttaattttttcagaataaaataataaggcatgcgtatactttttaatttaaccatctttatatgttcattttttcagagtcttgcttttgaatcttaagaacccaaagggctaagtcttctttcttaatttttaaaacaagcatgtgttttgttctttacatgaatcgtcggttctcccagtgtgatcacgacactgtcccatgctgattccatgcacggtgcaactctttcccaagagaggtcagatttcgaggtgttgaaaatagcccagtgactcagtattcttggctgctttatgccaacggtttaattggctgcatcatagcaagcatctaattgagtttcacatttaaatagtggatagggtacttggtgcattatttgcttacagaagtgtctgattagcatgttcctgatcctcgttctatttgtagcaaagatgggaggtcagggactgtcacatttcatattccccacagcatctcatctcgatggggccttgttcagaatagatgctcagtaaataggtgtgggaaatgagctgaattgttggtggtcactatccaaaggtgagaaatttctgaatgctaatggggtacttaactatgagtaattctattttaaatctcaaggtgatgatgattaatagtatctcagggcactaaataaacatgtattaaatatgagcgtatgtttaaagggggagtttttaatgcagtctttaaggcacaactgcttctcacttgaattctttaactgagattaaggagtccttggcattttaagcaaagtcatttcttaggtaaagttcccccagagaccacttgaacttttgcaagtcttaaaacaatgggtggttccatttgatggttcagaatagaaaggagagtgttgatcctctacactggtatgaaaaaaactgtataaggagatggaggatgctggatatcatagtgcccgagaatcacctggggcccttgtcaaacacagattctaactcaggacacctgggagaggacccgagctgcatttctcacagctaccagatgctgcacgctggcaaggttttgggatgcactgaatccagttcagcatgtttactgagcatataccacatagagagcccagatgataaaaaaatgagaagatgggttgtacctgcccttgaggagctaacaaggtgaggtggcagggagagagagagggattgtaaactgaaaatgaggttctgggatgccattctctggggtggtggccagaaaggggcccaggaaaggagagttgctggtagggcttccacattgctgaccttgacctgtagtcatatttgaatggagagccttgtgacttggcaagaaataaaatgcagattttgaagtcagacagacctggggtagcctcccagctcagctatggcaacttttaacctgagactcagagtccttgtcagaaaaacagtgcaaatgatgcttaccttgccaagtttgtagaattaccagtaaaggacgcgtgttaggcctaacaaaagtgattgcttttattactgttgataggagagaggaggctggaaagcaaggaggacgaagaggttactaaaatatgttccatgtagttcaccaattagagattcaatttggtttaccagcaaacccaaggccggccgtggagaaccgggccagggctggagggcaggcagctgtggaagctaatcagaggcaaaatggaaaattattgggagcatgcttatctccaccctctcctgcagtccctggcttctggtttgctttgttgatagcccttcctaggatattttcatctgaagcttttcttggtacttaagctgtaggttctgttgatcaagactgctagtggcaatcaagcgctctttaaaaatgtagtggagaggacaaacacctctcctctttgaggggcattggtctattctgtggtgggtcactttccaggatcaaagccatcaatctgtctttccaccatagtacgagttacttgaaactagtgccgagcgtgttggaattcacctggggtgccttttatgctttgcactctaagatattgcttcctcctgccatctaggagagatggatattgcaaggcaatggtgtccttcaccctgatattaggaggggtcacctgggtggccctgaaaacacttcaaccaacatcactctgattttttaaaatatattttgggattccatttattatttgcaaaggcgatttctctgctaccatttgccttccacgctccctgaaagtaaatcttgaaaaccaagttctaagagaatggcaatggcagtttgatgtttagggggaaggaaaagcagaggaaccccctggagccaaggcaggcctgggtgagggtggagacgagagagggaaaggaaggcatcgtcaggcatgggagtaccaggatggaaatgggagcagtggtgggggctgaagctgagaggttggaccctaggactcaatttgtggactttgttgctttgctgaaggccgtggcagataatgttcccagaccactgaaaatcatccaggcttccagaaaacacaggcccatctaaagacagacaggtgacgaggtgacagaacctagtggcgtgattcttctagcctcttctgagccaaaaatgacatgcacaattttatgaatgatatttgtgccccttggtgataaaatattaagagctcgaggtcatctgaaaattattggttttttgtttataaaagtacatagtttttggaaaagatagaaaagaaggaaaaaaccccacaatttcaagatatattttccgttcagtgttttttctatgcattgaaatatttttatattagtttatcttaaaaagcacatggatataatcttgtaaaaattttcaaatagcacagaaccatttctagtagaaagaaaaaaaattcccttcatccttgtggcctacccataatcatcgccctatcttttatttgcctagcagaaactggattttgtacagtagactgccaacccacacctgcctctggaggtttatcagattggccactcaaccctggtgagggtggggctgctgcccttgccagtgactggctcagggtgagcatgcggaccctgttctagccaataaaatgtgagggtgggccactgggaggcttctgggaaagtttccctgctctcaaaagagacaaggaaggaaacagtcctttccttccactagatactgtgatatgtggccataatgcctgcaaactgggcagccatcagccaccagaggggctgggccaggtctcagctgacctgcggaagaatgcaaaggtgaagaagggcagggggcggggaggtctccgtggtgcccttgactttctgaattacacaaagaagagtctgtttttgaacatgtgtgagatcatgaaaccattaccagatgaagcaaactgagctagtttttctgttgtagccaaaagcatcccataactctccacctttctcaggaggtaatgactgataaccatggggcatgttctgctagtcatttttggcgcatttacatatacacacacatatgtacacttttaaaaactaaggccgggtgcactgactcacgcctgtaatcccagcactttgggaggccgaggcgggcggatcacgaggtcaggagttcgagacaatcctggccaacatggtgaaaccctgtctctactaaaaatataaaaattagctgggcatggtggcacatgtctgtaatcctggctactcaggaggctgaggcaggagaatcacttgaaccagcgagtcggaggttgaagtgagccaagatcctgccactgcactccagcctggcaacagagcaagactttgtctcaaaaaaataaaattaaactaaaaaataaaaacaaaaactgaactcattttatgtatattatttagcaacttaatatggcatggatttttaatgacatacctttttctttatttttaaaggctacagagtattattcagaagtacaaataggacgttatttaacccatccctattaataaataatctattgagttgactgttacagtttttgtattaacttccttatctgtatatctttatgtacatttcaagattttctaggtcagggattattaggcctgggtaaaggcacacctgtttgaaatattgatagatgctgccaaattgggggctaaaaaaagctatgcctgttaacctccccatctacagtgtgtaaggccgccttgtctccatatcttaactaacacaagatattttccagcttttaaatcttttttgtgcattttcacatgtttgaggtagtaccatttatagttttctattctgattgttttgacgtgaacataagcatttttccatgacataaacaatttaaattaaattttattggctacataatagttatacttgttttgggagtgtatcgatggtacatgaagacgcaaagggaaatatttgaaatagaggttgtctatgaaaattaagtggctatgatcgaccttgcagtaaacctgaaagattttctggaaatggtgttgggagacacacccctccagtgatatgtttccaagaaaaccctgaggagatgaccttccaggcctttctcaatccagtcagatggtaggctgccccaagcatttctaagaagctttgttgcttttagaatccatcagatttacagtcagacaggttctaaattcagttctctgaatgtacagtagttacgtaaacacttcgtacattgcatgagacagctgaaaagtaaatttgctgtattcttttaattttttcgacttttattttagattcaggggatacatgtgcaggtttgttacctgggtatattgcatgatactgaggtgtggggtatgaatgatcctatcacccaggtactgatgtagtacccaatagttaggttttcagtccttatcccctggctccctgctccctccagtagtcttcagtacctgttgttgccatctttatgtccacaagtacccaatgtttagctaccacttataagtgagaacatgcagtatttggttttctatttctgcattaattcacttaggataatggcctccagctgcatccacgttgctgtaaaggacatggcttcattctttttatggctgcatagtattccatagtatatatgtaacacattttctttatccagttcactgttgatgggcatctaggttgattccatgtccagtagacatggacatggaatcacgattgctattgtgaatagtgctgtgatgaacatgtgaatgcatatatctttttggtaaaatgatttgttttcttttggatagatactactatcagtagtgggatggctgggtcaaattagtagctctgttttaagttctttgagaaagctccaaactgcattccacagtggctgaactaatttacattccagtcaacagtgcattagtgttctcttgtctccacagtctctccagcatgtgttttttgactttttagtaatagccattctggctggtgtgagatggtaccttattgaggttttgatttgcatttatctgatgattagtgatatggagcatttttttcatgtttgtatgtcttcttttgagaagtgtctgttcatgtattttgcctatttttaaatatggtttttgttttttttgcttgttcagttgtttaagttccttatagattctggatattagacctttgttgaatgaatagtttgtaaatatgttctcccatttatgtaggttgtctgtttactctgttgataggttctttttctgtgcagaagctctttagtttaattaggtcccacttgttaatttttgtttttgttgcaatggcttttgaggactttctttcccaaggccagtgtccagactgatgtttcctaggcttttctctaggattcttatgattgaagtcttacatttaaatccttaattcatcttcagttaatttttgtatatggtgaaaggtaggggtccagtttcattcttctgcatatggctagctaaatatcctagccccatttactgaagagagagtcctttccccattgcttatttttgtcaactttgttgatgctcagatggctgcaggtgtgtggctttatttctgagtcctctcttctattccattggtatatgtgcctgtttttgtaccagtaccatgctgttttggttactgtagccttatagtatagttagaagttgggtaatatgatgtctccagcttcgttctttctgcttaggattcctttggctattcaagctcttttttggttccctatgaattttagaagagttttttctagttctgtgaaaaatgacattggttgtttgataggaatagcactgaatctgtagattgctttgggcagtatgagcattttaataatattgattcttccaatccatgagcatggaatgtttctccatttgtttctgtcatctatgttttcttttagaagtgttttatagttctcattgtagagatctttcacctctttggttagctgtattcctatgtattttatattttaatggctgctgcaaatggaactgtgtgtgttttgttgttttttttttttttttgagacagagtctcattctgtcgcccaggctggattgcagtggcgcaatctcagctcactacaacctcagcctcctgagtagttgggactacaggcacgcaccaccatgcctggctaatttttgtatttttagtagagatgaggttttgccatgttggccaggctggtctcgaactcctgacctcaagtgatccgcccgcctgatcccagcactttggaactgtgttcttgatttggctctcagtttggacgttattggtgtgaaataatgtagaaatgctactaatttttgcacattgattttgtatcctgaaactttatcgaagtcatttgtcagttctaggggccttttggtggagtttttcggggttttctagccatagaatcatatcagcagcaaagagagagagtctgacttcttcgtttcctatttggatgcctttactttctttctgttgcctgattactctgactagcacttccagtactatgttgaatagaagtggtgagagtgggcatcctcatcttgttccagttatccaggggaatgctcttaaaacattttcaattctgctagagaagagaggaaggcaaatgaaatggataaaactcataagaaatgttaatcacccttcaggcaagggcacatttgaaaagcaccactcttgggcatggacctctgatcatccttctacttcctcactcctaagtgatagtgcatagcccaggaacacccaccacctgctgtcctccaataggaaaggaaaaggcaagatgacaaaagaaaaaaccttctcagagtcaacagaccacacaagaaaaagataccttgaaagcaaaaacaacctatcagtagacttcctggggacatcatgaggcagccagcatagctctttggtctttgttgcatgcattgaggcatcccaaatatcctaacgcgaatagaattgttagtcatcagactacgtgcaataacatgacaggtggtagaagaaactttgagaccacgaagaaatgagaatgcctctattttttattaatttttatgaatgcctatattttttggcatacaaatgcaaacatttgttttctccttaattcagatgggttaactccatttctttttattttatttttatactataagttctagggtacatgtgcacaatgcgcaggttagttacatatgtatacatgtgccatgttggtgtgctgcacccattaactcgtcatttacattaggtatttctactaatgctatccctccccctcccccgaccccacaacaggccctggtgtgtgatgttccctgccctgtgtcccaagtgttctcattgttcagttcccacctatgagtgagaacatgcggtgtttggttttctgtccttggatagtttgctcagaatgatggtttctagcttcatccaacccagcagctagtcatggttctccgacatgggctggagtccttttggagtattttcacaaatagtccccgtcagtagaagtcagatctgtctttagtgttgtatagaaacatccatccattattttttcaatctcagaacttgatggcttcaattttccattatccatcatggagggtgaagaccttttagaagcagacagcatcatacgtccacataggtcacgggacaaacagtgctgatcactgcctgttgacaaagtgttgacagtaagggaggggaggaaacattttcttgtagctagagaggttttttgaggaggtgggttggagtgaggacaaggggaagccagtctggctgctacattgacctaccaaatcttgtgtttgggctgggcacagtggctcatgcctgtaatcctagcactttgggaggctgaggcaggtggatcacctgaggtcaggagttcaagaccagcctgggcaacatggtgaaaccgcttctgtactaaaaatacaaaaattagccgggtgtggtgatggctgtaatcccagctactcggaaggctgaggcaggacaatcacttgaacccaggaggcggaggttgcggtggactgagattgcgccattgcactccagcctgggtgacaaagcaagactctgtctcaaaaaataaataaataaaaataaaaataaattgtgtgtttgccacgtcagcacttcagtttgtgttgtctacgaaagacatggcatacagtatcataagttactgcaaaagatgcctaattccctggagatcaagatctaataacaaatacgaggaaaactttaaaccccaagttgtggggtgtgtggtaaggtgggggcggatgtgtcagctagaaccttgctgagaacgattgctctgcagctctgtcatctcagctcatctaatgaccaaaagcagatggaagtttttgtgtgacctctccaaggccttcttaatggtcagagagaattttccttttatggcctcccccctttccccttcatagcattgtgggagagagagattcattcacaaccaatttgcatggcaattttttagaggttttatgatctctcaagcaaaataaaatcttctttactttcatttgatctgaaaaggtaccacttttggaaactgtccaggggaagcacgggacccctggatttggatccagttcaaggtggccttgatgaaaatagacccctatcctgcattttacatctccttcctggcttttctattctctcaaacctgcaaacccatattctttttgccttcgtttgctgtcatttaccccctagcatgctgattctcagctgccagggccccaagtccttaacttgctctccagttattcctgggatgcttcctggcaaggctccagctgctggcatcattgctcttgtcctgatgtgtgtgtgtgtgattctcatgaccaagctgggctctgcctgggcctgcgatccccgctgaatcccctgcacctcatgtagggtaggcacatcggcattctatcacattccatggagagaatgagagaagaactgtgctgattcctgactgccagacagcagatatgagcccctcaaagagagtctcaggaaactcacagcaccctgagccacctgtatctcccttcccaccctgggcaggtcattcatcatccttgtcccctgatttctgtagagacctgctccaagcgcttacctgacggttgccatgttgtacctgccctggcaattgttggctcctcctcagccaaggcctgctgctattgctgtaccagttcagggagtcatgttcccggtgctctgtgaaaaatggggatttattgggcagcaaggtggtgcgctccagtgtgcgccacatctgtttggtcttgtactgtttggtatatacacagtccctcggtgggagttgttggttagccttccaactgtgcagtaggtttttctcctctcgccatgcctggtctagtagcattctccccagaagaacgttgctgctggtctgcttaagagacctggatgggcccctgcctggcaatgacccaggaaacaatgggggtgctagtgcaggagacaccatgcttaaattttaaaaggaatagttaattcttcttgggctcccagtttctgggaagctgtgctgtgtttgtgtgagttaggtgtccaaagtggtcagctatctaacctctctgtacaaaatctccttatgttttcctcgtgccatgtgtctaagcacatatctctatgaagcaacggcatctctttgcccattttgtacttctttgggtggtatcattcggatgtgcttccctgaggcgatgtctgtgttttctaacagctcagactttggcagctcttgcatctattgcagcctgtttatatgagacacctataaaaacattcagcctgcaccgtgggtgtgccagcagcaccctatgacctgattttaaatcacagtgtgtgagtggccatcgtcttatgggccagggcatttttaaatggtgtaacgaggacagcgcatggcccatagcagaaagctttgacgccctgatatggtcactgtgaccaagtggccttggcaagttgcataaaccccatgactcagtttcttcgtctgtgaaagggagatattgatactcaggatgagaatcaagaggagagaatgcttgttagagtttcataaaaatgaaaagtagtgctattgatttattttgcgctgtgaccagttcactcaaactcttgcacacccagctgggtaaatgccagcctcaaggtgttttcttcttgaatgaagtacttggttttttcagacaaggtacattctagcaagtaaaaccccaacatatcccagtgttctcttgaaagctaacatgaagtgggggaagtgaaatacttcaactctagaagccaaacactcagaatgtcttggcagttgcttggggctgcacagtgtgcttttgaaagcttttgccatttataagagcaaagtaccctgataaccttttgtgtctgggatttcagtccaaatcaaatagcctctgtgtatcccatggattctgaaatttttatgggatgtgtggggctgttttgccatgatgaatgtgacatgtgctacttcatgtggcctttcttttttatctaaagaggcttggcttgcagaatggaggctcagctcccacagttcttaaaggatcctattgtttgtctcctatgtcagcatcccctgaagaataaggatcacctggttttcaacggaaccaggagtttattcttcagattggagacacactcccaattctggttaataagctggttttgaggtggaaggaaaggaccctagtgatcatctggtacaacgtggtgcaccttttccaggtaaaaactagaggctcagaaagcaaagaggcctttgctgactcctggagcttgcccggcaccgaacagaccagccgaccccttcctggtggctcagtgcttctctttctctgatgagtcctgaagaggcttcctcacctggagaatcaggggtttctcaggccctgcttccagagaatccataagaatgaggctttctgggctcagccggcgcactctccacccagaggttttgggagggccacgccacaggccaactacccactctgcctgaatcgccttatctctctgtgtgctctccacaatctgctctctgccgtgagtagcataagataaggaaggctgggtgctagaggcagctgggtacagggagaaacaaggacaaggatggacacggaccgtccacttgacttgtgggaaccagctgactctcttaggtgcggacatctgacttttttcagatagactgaacgcacagagctcattcatgcctatgaaggagactaaactgcctacttacttgaccagcttttaatagtgcttctcatgtatgccaggcggggtcagggtcagctgcaggattttctcacccgtactttttaatcccataacattgccatccttggccatccctttatcatttttcttttcttttcttttctttttttttgagatggagtctcactctgttgcccaggctggaggagtgcagtgatgtgatattggctcattgcaacttccacgtcccaggttcgagccattctcctgcctcagcctcccaagtagctgggattacaggcatgcgccaccatgcccagctaattttttattttttattttaatttttgtatttttagtagagaccgggtttcaccatgttggccaggctggtctcaaactcctgacctcaagtgatctgcatgccttggcctcccaaagtgctgggattacaggcgtgagccactgcgcctggcccctttatcatttttccataacaatttaggcaaggtaaaaatatcatcaggtccaaggatcatttgggaggggggaccctgtgttcgacagtcatcgttacagacacgagtttgctcatttgctttgacagcagtcacttggagggaagcactatgctcttcccattttccatacaggccaccggggcgcagataagttaaatgactggcatgaggacagtcagaacaggaacttgaatttcactgtttagagaagaaccagaaatagaacagctcgtttttatttactttttctgaaatgttgctttgaagaaaataggatgtgtgtaaatcaaatccagcatctgaacctgccttctttagcttcagcaggtttttcttgagcaggaggtcactgtgcggcggctgggtgcatgccggagtaggaaaccactccagtttggtgtccgtgctcgactccacccttcggaggaggaggctgcgtgtgaaagggtacaaaagaggaacgcttgcaggaaaatcttttttaggacaaaatcattattctgttccttgctgtcttttagtagcgatccagctttccaaaattgtttctctggctgtaataaggattgttaaatcaggacactcattatgtctctcctcattttggagtcaggtacatctttcttcagctgagcttaacctagaagccagcatggaaaggtaggggtcacctggaccacatttgtcaaacagcttttcacctgggtctcatcatcccgggcctggaaaacccgagatggactgaatttatggggaagcctcctagaagtcactcagggtcaccccaaaacatatcctcctgcccctcttcccctccacagctgagcacagacctcagcactcaatgtaatataaaggaaatacatgcaagcaagatattaccgacttttgagtaacagggttttctaagtcattgttcctcggtttgactcctggggagtatctccgtagtgattcacttaactgattaagggcagttcagagcatcctaaccccactcccgccaccagccttggttgtaagcagagatgccaggctctctttgcaggatggcagtgaggagcccagttaggttacttccactttgtctaccttcctgctgctaccgtttatgaaaacagaagcaaaatctgaacataaacatcaataaagtaatttgattgacatacatatacacacacaaaatcaaatttgccctagcgacctcacttcgatgtgtaccacccccatcccagagaggtgggatcagccacccagtgccttctcagaataagcatattaccctgacccgagccatttctgttttgttttcttctccccacctggaatccttgaataacatctgtctgaattattctgggctgtatatcatttcagagagttctaggaaacaacactgaaactgatttaagaaggcttttcagctggaagacatggccactcaacgcctgcgcctggggacagtggtggtaggggagggtgaggttgggatgacctgtggtaggaccaaccatggaataacagggtcaggagttaacgattcaaggggtgcctccgagttcccattgtgcaggtcaggggtggctctaccgagtgaatgcccttcttctttcttccgtacgcacggaactgttttgcatcttggttccaatgcctccctgggttctatggcattgcagctttgccccgtcgtgaaggcaagtccccgggccacatgtataatgttgggggaaagaggtatacagggtttgggaggaatggggttttcctccattttcccagatagggaaatgtgtggtcagaaatatgaaagaactttgaaaagaacatgagatgaggtctgtgaattgtgaaacatggtgctcctcttagttctggggcagatttttcaggatcaagaactaaaaccaagaatacctttgaacactttagtgtggctcatctggtggccacactcacattgctatttccagtaaattacatcgcttacagacactagagccatacagcagcgggaccccatccttccagagttattaatgttctaggacaaatctagtatcccaaggagattttctttcagctaaagcagaagcctgaattcacttgagttcgggcagaatagataattcatccagattacttgaggccccaaatggatctgacagtctaaaagttagattgtaaaaggccgtattgatcctaatatcttattctctttcttatacctaactagggattgccatttttatttattttgtttttttgagatgaatttttgctcttgtcacccaggctggaatgcaatggtgcgatcttggctcactgcaacctctgccttctgggttccagctattctcctgggattacaggcatgcgccatcacgtccagctaatttttttgtatttttagtagagacggttttgtatttttagtagagacgaggtttctccatgttggccaggctgatctcgaactcctgacctcaggtgatccacccgccttggcctcccaaaatgctgcgattacaggcatgagccaccgcacctggcctggattgccatttttagacacacagtttaccttttaattttgcactgtcctgttttgataactacctggaaaatacttggggttagctgctaatctgattgaagataaatggagttttcctcagattggtctttttgcccttttcaagctgaagtaaagaacagttgggcgtatgctgggaggaggagatatggaagagagacactgttgtcctcaactgtgattctaatccaggaagtgtcctttagagaggagggtcagggaatgacagagctggacgagaccttagaggtcaggaagccagcaccatcattttacagaaggggaaactgaggctgaggctcatcagtggcagaacccagggtgggaacaggtcttcagccttctgtcatgaggtcaccatctgcctttccacctcattctctgcagcaccctttctttcttgccctacctgtctttcagtggcagtgttaattattttagacacaagaacgtgattgtagctgtgacatcagaaaacgactatctttcaagccctgaaattgtcatccctgggttagcttttttttttttttttaataattcccctaagtcagatgggttataataaacatttaagatttgcttttcatgaatatgtgtgctgatttaatttttcctgaagattatttcttttttatttgagacagagttttgctcttgttgcccaggctggagtgtagtggtgcaatctcagctcactgaaacctccacctcctgggttcacacgattcttctgcctccacctcctgagtagctgggattacaggcacccaccaccacgcctgactaatttttgtatttttagtagagaagaggtttcaccatgttacccaggctggtctcgaattcctgacctcaggtgatctgcctgcctcggcctcccaaagtactgggattacagatgtgagccaccatgcctggcctttctcttgaagattgatttgcatagtcagtacgctgagatggagagagcaggacaccggggtcagaagacccctggtctaggcccttttagctgcagagaagtgactgactttacatcctctgagaaattgagataacaaggcctgccttctcaaaggggtgttcataataatcggaggagataatgagggtgaatttgctttgaaaattgttagtactgcttagaaagtttaaggggtgctttgctccattgctttggatcagttattttttaatatacagagaagagattaaattttagaaatatatattaaatatatatttacagttgacccttgaacaacagaggtttgaactgtgtggaatcacttatatgcagctttactttcaataaaagttatagtgaatgtgcctgactctcctgcctccccttcccttcctccgtctctcccacccctgagacagcaagacaaacccctccttttcctcctcttcctccttcttggcctactctacatgaagatgatgaggatgaagacttgttttgttgttattgttgttgttgtttttgagacagtctctctctgttgcccaggctggagtgcagtggcacaatcttggctcactgcaacctccacctcctgggttcaagggattctcctgcctcagcctcctgagtaacagggactacaggtacctaccaccatacccagctaatttttgcatttttagtagagacagggtttcagcatgttggccaggttgctctcaaactcctgacctcaggtgatccacctgcctgagcctcccaaagtgctgggattacaggtgtgagccaccgcgcctggcctgagaatgaagacctttatcttgatgcacttccatttagtgaagagtagatagatctcctctttcttatgattttcttaataacattttttctctagcttagtttattttaagaatatggggtatgatatatataaatgaaatacgtgttaattgactgttatcagtaaggcttctggtcaacagtaggttattcatagttaagttttgggggaatcaaaggttatatactcatattttcaacttcatgagagttggtgcccctgacccctgcattgttcaagagtcagccatatttctatacagattatttttgtaatccttcgaattttttatgctttcattttatttttatcaaaaattgctgccaggcatgtctagagtttttgtttcatatcagttaagaatatttgtgcttcacttttgaagtccatcttcttctatagatactcttagaaccgtaaacagctactctatgtttaaataatatttttttctttttgatggaatttaggattaacttgaaaattgctcatggttagtagatgcagagtgcgtgaaggcagatttttctcatctatattcagggaattttatgctttacatgaacagcagatgttagtggcattactccgttcacctatccaggccccggggcctttgctcatactgttactgctgccctggaacacccttccttccgtcgttgcttgccaattcttgttcaccctttcggacagctctggcttctaagatcctgcccacaggggtcgaatgtctgtcctctgggctctgacagagactcctgcatgtctgttacatggcagtatctaaattttacagttccaaggttaccggtgtggctctccttcacttaactacagcgaagactgtaggttcccgggagtggggaccacgtgttttttctcctgtcttttaggagctgctgtagagtagacttgctctatccatgtttattgaactgcgctgaaggacaggaagcctctgctcatttgaatggagacccatcttttaaaattattcatttttaggtccttgagacgcaccattttattaaatccactgtgttcacagacccggcttcctcacaaccctctaatgcaaccttctggtagccgctttataccctggacaatcttctctccacagcccccatttttttttttaatcttaacccccacagcaacctgatgttcctgaggctttgtttggggtttagaatctggaattccagagtcgatctgtcagagaacatcagatgcctgtgaagtcatcagtttcacagtggtggggcagggaacattgagaaccatatccatcagagaaagtcacatgtgcgaagggaaagagcaaggggcaaacagcagtttgattccatttttgtttaaaaaaatggaaaagtgaaaagaatgatcgtctaaaaataagcacgaggaagtctagaacacggtgcttaccagtcaagtttggagtcaggcagctggggtttgcatctctgctccacttctgattggctgtgcaacttaggaaagtggcttcagtccagggtctccattcctcctctgtacagtggggataattgtaggatctgcttcaggatgttgttctgaggattcacggagacaacatatgcaaagccctacagttgtgcctggcatatagtgagcaaacagtgcctattacttgttactgttcaattttctagactgggcgcgacagctcacacctgtaatcctagcactttgggaggccgaggcaggtggatcacctgaggtcaggagttcaagaacagcctggccaacatggcaaaactctttctctactaaaaatacaaaaaaaattagccaggcatggtggcaggcgcctataatcccagctactttggagactgaggcaggagaattgcttgatgaacccggggggtggaggttgcagtgagccgagattgcgccactgcactccagcctggatgaaagagcgaaactccgtctcaaaagaaaagaaaagaattttctacagtgactgtgtatgcccatgccaaatatacctatgaaaaatttggagaaagtgttaaaacaagcataatccctatttgtgtgcctaagatcttgctgtgggcctgtgtaaagtggccagaggggctggtgactagttgatgtgaccagtgactaaaggttagaacattcgataaccagactgaccctccagaattccatctacacacacatacatacacacacaaatacatttacacatacacatatacaaacatgcatatacacgtaccacatgcatacatacctgcatatgtgtatatacatgcacacatatgcatacacacacgcatgcacaaatacatgtatatacccacagaaagacacatacatatgcacatacatgcacagcgtatacacatgcacatatgcgcatgtacacaaatacatgtaaaggtgcacacatataactgcacatgtatgtataccatatacataagtgcatgtacatatacacaagcatgcacagcatattcacatccacatatgcattcacacagtacacatatacacacatgcatgtatgcacaccatatacatgtgcacatgcatgttcatgcatgagtgtgcatgtacgcgcacacacacacacacacacacacacacacttaagcccccaggtgccaggaagactgcagcactgtcttcctaggtatttacatgtccaaagggatgaagcctagatcttagagacaattctaggtcataaaagcccagactcatgaggctttctgacccctggagatattttatttatactttaaaaggttggggtgagaacccaggatcctttccatcccatctccaaggagctaaaggtttctctcccttctttctacttggggagggaggcagctactcctgcacgtagacagaatgcatcgtgcgccatcccttgtcaatgggagctagtctgcgcccacatagaaagtttccttcgactgtcatcatcttgcttgtggtctgggtgtcggggctgctgctgcagttactctggctgttagtcagggtgtgagtgtcagtaaagaaagggcccttttccctgacccagctgcctcctctttctgcagtattcacttatataaagtccttagtcgtgcaaggtgggcagcatctcagaccctacacagtttcacaaagcgggtccatataactgagcacttcactggcctagagaaacctgtgtccttgtctctgggatgtgtttgaggaactggacgacaggtcagcacagcccacaggtgcattgttgacaacaggaggctccatgtggccccaccagtgttgcttcttttagcaaagacattcagtgcctcaacaaacagccagtttttacacattgtagctggattctttttacagaaaagtacagctctatcataatgaagtgattctgtcctaagctgttcctgagaggagtaggaaatgctgggatcggccaggtgtggtggctcatgcctgtaatcccagcactttgggagtctgaggcaggcagatcatgaggtcaagagattgagaccatcctggccaacatggagaaaccccatctctattaaaaatacaaaaattagctgggtgtggtggtgcatgcctgtagtcccagctactcgggaggctgaggcaggaggatcgcttgaacccgggaggcggaggttgcagtgagctgagatcgcaccactgcactccagcctggtgacagagtgagactctgtctcaaaaaaaaaaaaaatgctggcatctgttccctggtgtccccacttttggtcagcctcacctgggaatttcatacattttctgatcaaagtccaaagtctctgctttgcttgagctttaatcattggctataaagcctcccctgcccccaacattgcacacacattaaaattagattacagccaaacagcaatatagttttggggattgagggggcaggtaagaagcacatttttagataaatagggaatcagaacctccattatgggaagatgttttgatagtctcaggtaaaagtctgcttagaaaaattttcactgcaagttttcagtatgttttgagatagtttgtcctatatactgatatttgttcattgttgaaatggctctgacccttgttttctgttatttaacacttatgttaagcagaagaaacataaaatgctttccacacttcagtgttcactttaacattttcttgattaagaaaaatttccatttatcttaaggaagtagatgacatttataaagagatctaaaggatctctttataaaggaaaatggatgaggtttagaaaggactctggcatgaaggaataattccttttcagagtgtcctttatctcacccatcaatcagttgttcagatggtttggcaaatgagaagatggtgtcctgataagccattccagaactaaggaattccagcacccatgtcctccgtttgctcagaaggagacagaaatggaagattccaatgattagatacaccaagaagaggtgagaagagaaatggtggtgaagatgcccaccctgatagggccgggctgcccatagtacacagactcccagggccgtgtcagctctcactgtctgcaggctcacagcctggccacccaatttctccttcaatactgacccaattaatatagggtttgtgtcatcatccccatagttagtgaagtgatttatctacccagcaaccaccatgcccagctctgtgctgggtgtgggtaccactgaagggggactccatggggtcaaggggaggctcggggctcagaaggaccctagggacccttacccaggatgttgggagagtcaggggttttgatcagcaagtattttgataaatctccttaaccatatattttatacttggaacaccaattttcagagaattagaagaaataagtatacataaatgttacagaaaagttcacctttctttgctcagttagcctccagtggtaccgaggaggaggggcccgtgattctgaacagttttctgcatgattccccgccagctctgcaggtataaaaggtgtagggtaccacactgatatgcatcgactgcagagtacattttgaaacaaacccttaatattaatttttctttttcatttagctcttatgtcgccacatgaatataggggaacgtttggttgtttgaaatctagatcagtgagtatttcatattgatgctgtccggatgagtcatacttactactagaaagtgagatgagagtgttttgtgatcattcaaatgggttgtgtatagttgcgcctctttccagagcaacagttgactttttcactgaaattaactacttttcctttgccactttcgttagagaaggagacagagagtcaagggtgaggaagggatgagagacattgtactgtgggaataaacaaagaccacccaaatgagaacaagcagaggccatttatccagagcttgcactagtgagggtgtcggccaccagcacttgtgtttggcagagacttagaggcaggcagggggtgggaaagcctcacagtggaaagaagggaaggctgcaagcatgccctgattggaggctgttggcatgggggagctgctggtaactaactagaaatggggcctcctgtgtgatccgttaggggagcatgtttggctctctctggttggttctaagttggaagcagtggatcggggtggaattagggcagctgtcatttattaatcaactcctggccatttggggctgatcattatagtttggcttcgtggatggtggctgcagatagaggtctgacttcttccaagtctgacgtggagcaggctggctccatgctgattattgtagatgaggggctggcttcctgtacaggttgctgcaggctggggatcaggttctgtttttacatgtggtctgcccattgtccatttgtacattcagtctctcagtgccaatgtagcactggctaagaacaaacaacagacccagcacaccggttggcataggctagcatggaagccacccagccaggcagctgactacatgcactcaggcacccaggctgctctgggtggatgccagctggggccacactgcagccatccaatgtcagccctggtgggcagtttcatacttggccatggggcttgttgacagtgcagtgtctttgtgctgtgagctcctaactgccttccttcaatttgggattcacatcagagaactgcttctctgagaggcatgctgttttattgggcaaggcagctctagctcagattttagcccatttttggtagtgaccagctgtctttgtcatctagggatcccctgacagtaaaagattctcctgcatgtcatcatgctcctgttctcagctctcacctggttcctcaccatggcagagggttttctggtcaggaatggattattccaaaccactctggaatttctgtaggaaccgacccctccttcagtcagtttcttgccacccctgcaagttcaatgctgtggcttccccaccctgggtgcggtgtcaggcccaaggtgaatggagacagtgcccaaatggcttggccatgtgggccagccctcggtgcccacgatttcagcacctgcaggcccacatgtggttttctgaaggtcatgcccctcccccatggttttctgcttatatgtttcttgtgtgttttctccaacatttagggaaaattctagggtggtaacatcattggtagtcaagggagacactggaatcttttattttgctagaagatatgaataaaaagtttccagagtttaaggcattaagttttacataaaatgcgcttaaagtattaaagttttataaataaactctaaaaatgtgatgttgggttttgaaagacatctgtaatttttgaagaggggatggttttaaaaaggcatttcttctcttgtctttgtgtgtgtttgtacgtttaaattaaatgacatccactgtgtgtaggagttaaaagagtgtttttttctcctaataacaactcttgtaccattgactaccaagaataacaataagccttctttttaagttaaaaaagaatatttatttttgtcactgaaagaacaattattcatgtctttaagttaaagtatttttatgaattctaaaacattttgatgtttagctgcacacaataaaaatgtcatattagttggtccttcaactaaaatattttggttgcaggatcttggcctttcaataatactaagtatcatttaatgaggacttatttgtgccataaagtgttgaaaatgccttacatatgttaactcatctactcatgctattctcattttatagcttgtaaactgaggcccagaaaggttcagccatctgcctgaggtcacacagccacagtttggacctgagccatcaatcatccaccaaaagcctgcattgaccctagaagattccattgcatgttgtcaaggcgcttagtttctctcttgtgtctccccaaaacataaacctggaatggaagagagccacttactctatagatgcttttagctcagaacgcttcaagcttttggagtatgagaaataataacaatcattccattctttcctggagtttgatctcagctgttggtgatattgttgggactgatttgctatctataaagccaaatttgagaaaagacaggttaaaaataaacagggaggatgatggtagtaaaaataacgtgactgtcttcttatcttggaattcttttttagtttttagcagagttacatttcttcgttgtggtaaaatacttaatgccactgaactgtcacttaaaatggttaaaattgtgcactttagattatgtatactttaccacaataaaaatgaatttttttttttttgagacggagtctcgctctttcgcccaggctggagtgcagtggtgtgatctcagctcactgcaagctccgcctcccgggttcacaccattctcctgcctcagcctccggagtagctgggactataggcacccaccaccgcgcctggctaatttttttgtatttttagtagagacggggtttcaccatgttagccaggatggtctcaatctcctgacctcgtgatccgcccaccttggcctcccaaagtgctgggattacaggtgtgagccaccatgcctggccataaatactttttttataaagccagtgagctgatggggaacccggcaaggtgtgacatctgtaggactcaaaggttgtagtgaagttttctcctagcacgttaatgttctgtgttgatgacacatgtaatcagaacgccttcgccatatatgaagacctttaggaaaaagccaagaatagtgtagaagggccttcttttggtacaagaagtggctgatttcgtggcctcaagaaccactttggtttctactgtgtttggggaagctacaagtacagataaagacactgtgaatatatgtctttctgtgtttaaaagaagaggaaagaaaagagttgatgcagaggggacccctggaccttatttttagtgttgacaaatctggtatcatttagaagtggatgttttcaagggctttccccttaaaggaggaagcagaggcccagggaaggagcttgcattgggtgggccattgtgatgctgtggctgggcctgggagattcgactggactcatgtttttattgggattgttttcgattttgcaaagaccctggttacaaagtccggtgggtcctcagtggtctgcccagccctgcttttcccattggcccagtttttcttagggtgtgatcttccaggatcatatagtattctagaagagattcctgtatcatacttgggaggtaatgtgaatggaaagttcttatagacacaaatcttataggaaagatctggatgaagccttgagtgtttgcctttctgggatccaaggaaactcatgaaacagggaggatttaaaggaggaggaaagggaagtgaaaagagaattcccaaagcctggaattgacccacacagtttggcatgaaatggtcacttccgcatctagagcacacattatttttctgaagcaccctgttgaatgagaggaatacatacgtgccatcataggttgaaaaagtgatcttttcagcataaattggtgggtgtttgagagcattacttgcacagttcaacaatacagagctggaaatgcataaagaggacattccctgctagtcaacgaatacatagatctgtagctggaaattagttttaactttcaagtagtcaagaaacttttatgtccaataagactctctctacgtaattttaggctgtacactggttaaaataattctatttggggaaaatcttgtggttgtttgtcccaaatcgccctgacatgttctctgccttgagtccccaaatccctgccgtggggcgcagcctgtcatgcatgggccaggaggacagccagcacacggggcagatgccgcaggtcatccagctacgttttctgtgcattcatctcaggaatacgggtttccctgcacacttaaatctacgtgtaacccaagtttatagacctgctgggaagtggaaggcagttggttgcctttctcaaaggctgctccatgagcaagatgcctttcatctagaccattccgctggaagcatctgtcagaccagagtagtgcatcagtctaaagtcagctctctcttctctggtttagggtggtagttgtgtgctttggttctgtttagctgagtgggtgaatgaaagtaattaagataccctaaatagggtctttagctaaacggtcacctccctgcctaattgtgacaccaataaatccaagaaaggggaggacagtggcagcaggtcacagtgggaggatcatggcttggagcaaagacaagggctgtgagttccagccctgccaccattagctgcagtgtttgcgcagttggtttcacctcccaggtcttcaggttcttcatagggtcagaactccaggtagatcattcctgggcttccttcaccttgaaaaatctctgcctcaaccatattctaatcacaacattactataaaatgataggcatgacttctatatttacaaaaagccataatgtatttcctcactctctgtaggaagacatttgaattgttacattctttactttgctctaaagcaaggttgtggaaggtttcaggtgccagcaggtttctcagggctagagtctgtaacaaagagatcctggaaaactggagagaggttggggaggagaggaatggacacagcgtggttctggtcccacagaggtcctattgtctgtaagaatttgatgttggctaaaagagacatcaggagtcactggggagggagaaattatgctgtaatggtcagggaaagtggttagactttttcaaaaacaaacaaaatgtaaaattttacatcttcactttaccctatatagccaacttaaactccaagatagatctaacagtaactctttttgtaaaaaaaaaaaaaaaaaaaaaaaaaagcaagagaaaatagaaaaaaaaatttgtgaaattcagtgtatagaattttctaagattcaatgaaatcactaaagaacatactgacagatttgagttaaactcatatacttcataaaaggtaatcaaaatgtaaagatcattaacctttagaggaatttgcagaaaagaattaacatcttcagtataaggaaaataaacaaattttaaaactgatactataatcgagttctcatattctggcccaagaataggttgcatcagatttagtttcaagtgtagattcctgtcctctgtcaaactcttctgccaagtcttcagcctccaaaggttgggatcctttctcttctctggcagaaggcattcattcatgtgagggtacaaaagaggaaggaatggtatatggttaacaggaaaatggaagtcaataatgtgcaaagaaaaaggacgagatcattttgtatcaaggtatccaaaaaaatgttacagggctgtacatccaaggttcataccaacattattctcagtcaccaaaaggtgtaagcaacccgtgtgtctgtcactggatgaatggataaataaaatatggtttataggtacagtggaatatccttcagccttaaaaacgaaggacaggccaggtacggtggctcatgcctgtaatcccagcactttaggaggccgaggtgggaggatcacttgagatcaggcattcgaggccagcctggccaacatggtgaaaccccgtctctacaaaaaatacaaaaattagccaggcatggtggtgggtgcctgtaatcccagctactcaggaggctgaggcaggagaatcacttgaacccaggaggtggaggttgcagtgagccaagatcgcaccattgtactctagcctgggcaacaagagtgaaactctgtctcaaaaaaaaaaaaaaaaaaaaaaaaaaaggaaggacattctgacccatgctaccacatggatgaatattgaggacactatgctaagtgaaataagccagtcccaaaggacaaacactgcatgattccacctagatgaggtactcagaatagtcaaatccaaagacgggaagtagaatgggagttgcgggggctggagagagggaggaatggagagataccatttaataggaataaagtttaagttttgcaagattgagaagttctggacgtagtttacacaacagtgtgaacagtactgagctgtacacttaaaaatggttaacatggtaaattctgtgttatatgtcttttaccacaatttttaaaaatcaaaaatcctgaaaggtacttcctgtggatgtgcaatgggctttccgcagcattgcttatggcatgagcacagggaaagccttctgcagtatacatcaaggtccttgacaagttcacactctgaatgccgtcattctgcttcggggactcctcccaagggagtaagcccaactcaaggaaaggctttactaaccagcgttgttcatgttagcaaaaagttggaagccaagactcttgaaaagctttgtgtggttaaataaaccctgagcacccactggccagaaacacatgcagctatggaaagtgttgtttctcgagactacagagtgacatgcggaaatgcatataatgttcagtgaaaaagagaataagccaaattatatctacagcatgatctcaactatgcaaaatggtcccatgcccaggaatgaaaacacaaaacattaatagtggttgtctggggtcatgagtccatggaagatttaacatttttgttttttacttgtctgggtcttccgggtttttgaatgagtgagtagtcttattgggaaggtgcatggtagatgggaacacagtcaaaaatgatctttagtgaaggaaaagaaaggaaagcaattgcctgctacaggtagaccctggtggaggaggctgttcagggagtctcacgttagctacatggttcttgcaataaccaaatcaggcagctggtgttgtgctcccattttgaacaggaaaaagtgaggttccagcaggttagataacttgccttgggtttagcaaataaaagtttttggccgggcacggtggctcctgcctgtaatcccagcactttgggaggtcaaggcgggcggatcacgaggtcaggagatcaagaccatcctggctaacacggtgaaaccccgtctctcctaaaaaatacaaaaaattagccgggcgtggtggtgggtgcctgtagtcccagctaatcgggaggctgaggcaggagaatggcgtgaacccgggaggcagagcttgcagtgagctgagatcgcaccactgcgctccagcctgggtgacagagcgagactccatctcaaaaaaaataaaaataaaaataaaaaaagttttgaaagcctccaggaatgggtgtctggccattttgaggcaagaattttcccccatggaactctgcccatccacgtaagaacaggacttgttttacagatgtttgcatctgtcaatgcagggacccctggctagcacagcataccccatttggccccacaaacctgtccttgtctagctagagtggaaagaagggagacaatgagaccacttgtgatggagcactgcaggaagggattcatgcactcacagtggagtcaccgcctctacattgcaagagagatgggaggcactgatccctgccctggtgtcctgcactgttcagagctacaggagaaaaatgagcaaaatcgcaagtatggaccctttctgcctgccccctgcacaggcaccagactcggtaggttagcactagttcctgcaggggcgttcagtgctttctttaaaaaaataaaataaaataaataaaagacaaaaaaacccgctaatggcttgatatgaatttcactcattatcttcccatagcccttaaaacatcattaagtattaaattagcaagctgaacttcctaagaggagcaagaataatttgaactctggattttaattacttatcttataaacttctatcatgtgaggtagagtgaagagccctgtctacacccctgtggactttcaaagcagctatttaagatttcataagactatccattgtgactacagtgaataaattgtggtcaagggagtgtatcgatcaaacaccagaaggctcctctcagcttctgtcgcaatcttgcacaggagagaactagacctaaacaggaggaagagttgataagcagtaagcgaacgaatcttggttctgaaaagaacagcatcatatgtaaatttcaatttacatttattagaatttgctcagtaaattgtgctctacgatggagtcaaggccagattgggctctatttccacaaccccctaaggagtagctcaccagtgtcctaagtggctgtttcctgggtgaacatagtacatatttgctgtcacgctgggaataccagtgagaatctcatgcatggacagaggacatgatcatctttatgtttgtaacctcgggcctggaacagtctccttttgtgttcacttgattctgaaaggtcagtgttttagaacaggcttttcacatggttcaccaggaggccagttagatcctgtagtgaaagggcaaactcatggcacccttctgcttctcaaggcaggatgctgcaggggcagtgaggtaagacggtggacacgtggaggagaacaaaggggagccccaggggcatctgcagccaggtggagccgttcagccttctggcacacatctgttggctgggtggaggtatgagggcgcagatctgaaaaccaagtggtgacctagggagggaacaagcgctgtgcagcattgatgaaacttaaaagatgaagtcctggtccgggcacggtggctcacttctgtaattccaacactttgggaggccgaggcaggaagatggcttcagcccacgacaaaaaaaaaaaaaaaaacacaaaaaattagcagggcgtggtgacatgtgcctctagtctcagttactcgggaggctgaggttgggagatcagttgagcctgggaggtcaaggctgcagtgagcagagattgcaccactgcactccagcctcgacaacaggcttttggacatagcctgcctcaacaaaaaaaaaaaaaaaaaaaaaaaaagatggagtcctgcctttgagtctggctggtgacctctctgtggcgtggcatgtagccttagagacgggctcctaggcatggagtgggaggacatggccatgggccggagttgtgggagtggctgaaacccaagcctaagtggcttaaggaagtgagagcaactactgggaaggaagtggagtaggtggctgaatccaagcaagagagagagacctcaaccagggcctcagggcatggaactagggtgtttctttgccttttcatgaccccatcctgagacagactatgactctagatctctatgatagggagagacctagactctaccccagcaaccccaggggaaagagaaagcattttccccccagcttttatacatcagtcctagggaaagattctaattggccttgcctggtcacaaggcccttctcttggactccagcattagcctgaattatgattaggaggccagggtcaggtgctcaccctgcgagtgaggtgacaagtactgtgagtgacaaccttgttaaaactgtatggcaggaatccacaggaaataaatgcaggccaaaataactgaagccccacaaagggagtacactccaaacctgctgcttcgtttggtgatacccattgttggtacgtgcattcacctgtctctacagctgtgcacagtgtggctattgagacgctgaaatgttgagtgctggaccctgaaacgctgtgtgagatgtgctgtcagtgtaaagtgcatactggatttaaaagatttagtaggaaaaacgaatgcaagctctgctattattttttaatattgattatatgttgaaataacattttgtgtatgttaggtgaaataaagtgtattttcaaaattatactcacccatatagctttacttgtaaaaatgtggcttgtaggcatttgaaattacatatgtgactcatattatatttctcttcacaccgctgttctagactgtgttcatatttctaccttgggggtattaatccttaagtcactatccactgggtcattaattttgttttccttgacattatttcctcagacttcaatgtgcacccctgtttgagtgttgggggtttcagtgagtcattgtttgcccttcgtgattcctagacaattctcctaacttgcttagcctgtctcacgaaggcctcgaccgcgggtagagctggaaccacctgagattcgaggggaaaagagtgagtgataggtgtcacaacttttggaatctcattcttggatcctatttgtgaaggtttgcatgtctccatgaaaagcactagcattccgagttgcttgtctgtgttcttacacattttgtttttacctcattgttgacccatcatgcatttattccacaatccagatgtgagaaagcacttcagagcctaatcaaaatggcagctctttgccctcttgttgctctcatgtttatctccctccattcagccttctgtctgtccttccatccattcttttatcaagttgtgacagcccctagtatgagccaggcatagggccgaattcagcagtgaggcaaccaggcccattccccaaactcacagggctagcagatggtagcaccagcttcagctttgctgcatgtctgatgaatcactggctcttgaccaactttccccaaaactcttggaggaaaagtgcacaatgcctagtacagagggtctcagcccactcagcttgaatggggaaggttaaggtaagggttggagtccgtactgccttctcccaaggactcctctgagaaataacccctcgaaataacccccctccctccaaacacattctacttatcacatcttccagtaatacattttgattagagggattggagctaagagccctacttaagcaaaattaaggagctttgtctaaaattgacatattgagagaaacccatccaaaaccagaacagaaaaatggatccagctctctctggcaattacaggtaactctccctgtggcatgtaactgcccagtaaaagtcagacaagaccatccattaggatttaagtgtcacgtgtttaattctgcttgctaattagtagcctttcttttcctgaattaaacgtgtggttaattctggttgagaactgtttcgttacatgactatccacattcccgagcacaggctcccaatgctgtctgctttctcacaagcccccggtccttggtgcagatccagttagaggggacctgtgttacctgctggttgggtgtggaaaaagtattctttgataagcatttaaatgttcatttagatctaattggaagtaaattagtaaagactcagggtaaagaaaagaaaatatttttcattcagactttgaaattgatttttcaaaatttgatgtttataaagaaaagaagtggaaataatgctcacagaattcaagccatgcggcacactccgagtgcattgcatctgctttagcagctcggacttcggaagcaatgtagagagaatgtgtgtatgggcggggtgggggcgggggcgggggcatgtgtttagcagaatcataacccctgtgaatcaaaaggaagcacctgtggtgccagggaaggaccaaacatgaaaagagagaggtgtccacgctgcttgcaccctgaccttttcagatgagctatgagtcatttaaaaatttcagagcaggtagtaagacagcacctgggtgaggaagtagggcaggtgatggagagtggtagggcgtgcatttctgccagaattgggagtggctggtgcggcatggataggacaggctgtccaagcacaagcttaagatgttgtcattcctggccgggcacagtggcttacgcctataatcccagcactttgggaggccgaggtgggcggatcacctgagggcaggagttcgagaccagcctggtcaatatggtgaaatcccatctctactaaaaatacaaaaattagccaggcgggcgcctataatcccagctacttgggaggctgaggcaggagaatcacttgaatccaggaggcggaggttgcagtgagccgagatcacgccattgcactccagcctgggcgacaagagtgaaactccttctcaaaaaaaaaaaaaaaaaaagatgttatcattccctgagatcgcccctgagctttcatttgttgaaaacatttgctgagcccttccatatagtagatggcagggacatggaaataaaaagctcagtccttgctctcaaggagctggctaatgagagagcagcccagtggattgtcagtcagtgtggtggctgccctcagatgtggccatggggcttcctgggtccatatttaggaacaggccagagcaggccactgcagtgacttggtaaccattggataggtcactagatatgtgtttcagggagggttctaatcgtgaaaggccactgcctccaagagtgggagcctggccaagtctccgcaaatgggtggcgtgaaaacacgctcctgttaacctgggctgcatgaccacagcaagtgtttctgtgcacccggcgtctgctacagggcaggccacagtttactcttgaacttcgctttccttcagttctcaccaaatgactctttgtcccactgaaacaaccacatgtgtatattttgtgatctgtaacacttggtctctcttatgtctgcttcggagagctcaagctgcctcctggcattgaagaagaagcacattgccttaattttgtgtatttggccattatcagctgtaggcaagttggaaaactggttgtaaaacatcctttaggaatctggaagaaaaagtcagtactcaagagaaggaaatgatgcagctctttataaaacatgattcagtgttaaccagtttgtttgcatgatagtcctagacaaagaggccaggggttaagtcatggaaaagaggtctcgttgcctctcttttgcatcatatcagggactttgctgtaatttctagttccttctcactgtgaaagctacaggccatctgactcagcctctgtcttcagggatgaggatgctatccatattttaaaaccgtgaccagcaagacgtagagaaagaaagtgatttgccaggctggtaggtggtgataatggttagactggaattcgagtctcttgcccttgtctctccctttgtcatctgctttaatgcttaaaaaactgcagagaaaaacaaactccttccagcgtgcactctcacttctattagttactttaatttcctcgctgagcagagaaagcattgtcacactaaagtttttgctgtgagggtctctgtttccagtggtctctgtgttccctttcgttatggggaaggctggcctgatgtggtggggctggaagagttaggggtgctgagcaaggagcaattcagaaggtggcggggagttcccaggactgcacataaaaattaattacagaaaagaaatacatcattaacgtcagatctcacaataggtcccagtgtgactattatgtgaaattaattactccctactttatttttttaatcaccttctccgtactctgaaaatagtcctaattactgacattagttgtttaagtcattaagggtgatcatgttacacgtcagtgtgcacgccccgtcctgtttatttggatttaaatatagcagcccttgccctccatagtgtaattttcctgctcaataagatatttagtaaaactaagtaaggttgcataatcaacgcctcaagaatataagttgttggagtaaaataataaaaacacatgcatttgtctgggcacggtggctcacgcctgtaatcccagcactttgggaggccaaggcaggtggatcacttgaggtcaggagttcaagaccagcctggccaacaaggcgaaaccctgtatctacaaaaaatacaaaattagccgggcatggtaacatgcgcctgtgatcctagctcaggtggctgaaaggcatgagaatcgcctgaacccgagaggcggaggttgcagtgagccgagatcatgctactgcgctccagcctgggtgacagagcgagactccatctcaaaaaaaatagcatgcatttgtgatggaaagaccactgcctccaagagtggaagccaggtcaagtctctgtggtcgagatcttttgttcagtcctttattccagaaaatatgcttcagccctgggaattgaaagtgaggaaaacaagtcaaacccagagctcatagaatagtgggatagatgggcattaaatggataatcacctaaatcagtgtagaatatcaccttgtgatggggagttcggtccagtctaggggacaggggtggcccttcgaggaagtggatggatttgaacttagacctgaatggtgggaagggagtaggaaccagtgacgccaggggagcgagcagagcttttcaggtagagggaacagcatagaaggacaccttgggtggagaggatgggaaatgttccttgaggggtggttagaggtataggtgcagattaccaaggccctggtagttttgccagaagtgcagtgggaaagcggtaagggtgggtgggttggttggttggtgttaactttttatttagaatcatttcaaacttaagagaaaagttgtaagaatagggcaactagcttccttatagcctttgctaagaatgttaacatttgatcacagttgcctatcatgttctgtatttatattactgttttttactaaaccatttgaaggtaagttgcagatatgaggcttaaggacactttcctgtgtatgtatccatgattcagtcatcaaaagaaggcaattaacactgatacagtatttctttctaatgcttggtcccctttggaattccacagattgtcccaataatgtcctctacagattcaggatccaatacaggatcacacgttgcatttcgttgtcttctggtgtttagtttcttccttctgggatggttctctaagtcttcacttgttttttgtgacctagatgttttggaagattacaggtcatttccttcatagaatgaccctcagttggggtttgtcttatgtgttctaatgattagattcagattctgtacttctggcaggaatatcagagtgatgcagtgtatcagacgaccatgctgttgattagtcccatgactggtgatgttaactttgatctcttgattaaggcggtatctgccaggtttctccgctgaactatttttccttttaattattatgttgtgggagatatcctgagactatgtaaatatattgtttctcatcaagcctcacccactagttttagtatccattgatttttcttgcttgaaacattactatggtggttgccaaatggtaagtttctaattcaatcctcccttctacgtgtgttagttggcagtctacttgaaggaggagctttccttctcctccatccattcattctttgtttattctctatatcagtatgggtttgtagatttcttttatttggtggattataattacagtttgggttctcagattgtcccagatttggctggggagagctctttccagctggcttctgacgtgtccgcatcattctttgagctcttctgactttccaggctcattctgtactttccttcctccccactggacttagcatggtttttttttattgtttgttgttgttgtttgtttgtttgttttgttttgtgttttgagacagggtcttgctcttttgcccaagctggagtacagtggctcattgcagcctggaactccagggctcaagcgatcctctcacctcagattccctacaggtacacaccaccacccccagctaattttttttttttttgaagacgaggtctcactttgttgcccaggctggtctcgaacacctggcctcaagggatcctcccatctcagcctcccaaagcactgggattatagctgtgagccaccatgcctggcccagcctggctcttttcgagaagagtgaggcactgaagggttccgagctgctcagtggcctgatctgattggcatttctaacatattactgtgtctacccttgaggagcacattgaagagaagcaggagacaaaccggggagaacacttggaaaactttagggtgtagctcagtctgctggcttgggcttgatattcatagtgcagacagagaatgggatggatttaaggtagattttgaagctggaaccgacagaattgtgatgggtgggatgtcggggagaacagaggtgtccttttctgacaaaagaaacacaaggggaggaggggagccgccttggacagggaagatggaaggttctgattcgggcctgtgcagcttgagagttgtttgtcagccaggcagtcatgtgaggggcaggtgggctcaggggtctgggacacaggaaggaggcctgggctggagatgcatatctgagaagggtgagatttgaccacacacctgggggcctcttctacaggtattgaatcaggctgtcctgggtagaagagtgtgtccttcaactcatattctgccttgttttccctttgcaatgcttggcagatgcttggcattttcacaacagatatgaaagcctttgggcatgttttctgggtctggctgttggtatgtgtatcaagaaaaagaaatgtaaacagattacctctctgcaccatcctatgactaccaacccggtggactggggaagatgtcaacaggaattgtcactttttttgtattaagggatctgtgttaagaaaagaatgtgtgtatatgtatgtatacatatgtatgtctatatgtagtatttaaaatctttgctgtcaaaaaatacattatgtcaaaattaaaattgataaggggtaattaaaaatagattgtggataaagaatttatgatgaggaaactataatcatagcattctcacaacctatcggatgggtaaaaggaaaaaaaagaatacatctcaaagaaagctgtagtcagagctactgctaagtagatgcgtagttcacaaacacagtggttttgttgtctgatcagacctcggaaggggatctggcttctatgcagtaggttcaatcatttctgtagatacagatgttgtttgttttggcatttttggtaatgtttacttgagggttggttggggttttttttgcctctaaatcagaaacagctgatattcatcgggctgtatttaacttctgcttttgtctgaaaagcaaagttggagggtttcattgcctcgtagcttaatttttatttcaaatcaagggctggtattaaccatagcttggcagtgcagaaggctgtggtcaggtctggaggtcagggcatggtgatccagcggctgcctgacagtcactgcccagagcttcccttaccataaccttcctcagtagactagaaaaggttttcaggtttgcccaggttatccacacgtaccatggcatagtttctccagcaagtcagcacactgccgttcctttttcacacctgaaacacgcattgggcctggcttttgcatatagtttggctttagattctatgtggaaaggggcagacagtgctccacttcctgttgatgagctcttccttttacgggagttgctcttgtacgcctcccattttgtgtcctccccagaccagacatggcagtgagggggacgtatgtgagtgaccctcttcttaccctgccttttggcagcattaataacagctatgtatggagctgttagtgaaatggtgttgtcgggtcaggaaggagtaagctctgccttgctataaggtcgtgaggaaggatgtatcttcacttccgtgtcaagagccttagcccgtgcacagcagtgccaccatggcagtcacctatcctcttggttaatctgatgcctctgaaagcctactttgaaacaacagcccgaccttctcactgtctaaaataagagctagagcagaaggggctagtctaccgctagtagcacttagcacaatgacccaagtgctggagcatctcacacaggtgtaggagttggatgctcagccacactggttccattcaagcaaaagagggccatggctgctagactctgcttcctcttccctgctttgatggtgggttgcttggttgattagttggttggttggtttgatgggaaccccatgcagttacctatgagccctttcctgagttgctatctgtgtgttagagaaagagatcctggcagatagaaagatgtgcatatcagtggccacacagtccgtgggcccacagatctgtgccccatgtttggaggagtggttgcttttttcaacatcctagagggatgtgaagcccagcttgagcgtctcatggggaattatatctaatgggtcagaatggcatgagaatgactctaaatagcttttctttctttcttcctgctagtctaaacacaggaatgagaaataaatgctaacgagttgcatccttaaatacagttggaccattttcacgcaatggtgaagacatgtttttttgtgcaaatattttatatctttgccattttgaccattcttattttagtttcttccatctgtgagctctaatgtatatatgtatataatttatatagccctccttgcattccactttgtagtgtgaggattgctgcagatctccttctctctctctcatggacagtgtcctccatcagtataagcttttgacctaaagcacaccttaatttgtcacgctgccaaatccaagccaaacacaactcagcacttagaaattgtctgaaatgtgaatgaaaatatttctatcatatcgagactgggctaattgtgaaagcattatgccgagatgtcatgaagatgggatgtgtagtgagctatcagtagctagatgcttggtgggaatttggttgacttacatgattatgaattagcatcctatttctctgtgagttattcataattcagagcccatgtgggataccttttatcttttcggcttgttgatttgtatgttggttttgtagaggaagagtgctcatctgaatgtcagaaaaacattttgtggttattgttttagttgtttaccaaattaccttaagttctagactgagtagtccatcaggataaaatattagtatatttaaattgctcacaaatttccctgatctcttccaaaactgtgtgatataataatattcggatataaataaagcctctcccgcatttaatggtgctgggttcagcattaagtttccatacgattagccaacaactccttggaataaaaagtccacgagaaccttaccttgggacacgtgggaagtgtcttccttgaaactctggagccatttctgaggcaccaaggaacatggcattgaaaaatggttgacaagtcttttatattgcttgaacatctacataacaaagaaaaaatggggcacaacacccccttagtctttaaagtgactgttaagtatttctggtaagtgtcaacatttgtaaccaaggatttatgttgaaaatttagagcagcagttcccaaacttgttgatttcaggcttcttttacattcttcagaattattgagaatcccaaagaggttttgtttatgtgggtttatctatgagtatttatcaccttataaatgaaaactgagaacatttaaaaatgtttattaattcatttaaaaataataagtgcattgcattttaacacaaaaataataactacgtttccccaaacagtataatttagtgagaagagtagcattgttttaatttttgcaaatctcttcaatgtccagcttcacagaaggcaaatatcacgtgccagtgtcctctgggaaactccactgtacatttgtgagaaaatgagattgagaaagacagataatgtcttggctttattatgaaaatagtttagactttatggatccccttaaaatgtcatgagctcccaaggggtcaccagaccacactttgagaactgctaatacagagtaattagttgaactggaatattcttgaacataagaaccctgaactcaactacgaatctgttctctgtccatgaagttgggagtccgtgggaggaagcaggtcgtgctgccgcctgagccagcatgctcctttggatgcatgttcaaccttccctctgtactgggaacgtagcctggactcctgtctgcttgtgtggagctgaggccccacttacctgctatgtgttcttagactactgctgcctgcactgttgacctttcggaagctcacaattcacctggttccctgaccggtgactgctgacatagtctactttgtaggacacctttgctcaagtcgggtaacctggccacaccaatcaccaccatgacttctagttaaaataagaaggtaagctcttaaacactcagaacccttgttgaaaatccaccttctgaccccatttcagagaagaatttggaaagggggcaattccaagtgcctggtgttactgactggatctccaatgcacatgcaggaagtcatgcttccatttaacttggaaactcaaggagctctgtccaggaaggacaactgctgactttgggaacaaggagactcctatttggaccatactctctaagttctggaaggtcacacctgaggcagtactatagatggaaaccttgaactacctcccgctaaaattgttaccagtcccaagtgcttgcctagaccctggccctgatatctctttattcctgtctcttcactgattttgacgccagcctggacccaaccctcagcctgacagcccagggtgacccgcccctcttcagtcaatgttcatgctcagcaattccgtttatgaatggatggtttctctgttgctctggtccctgcagctgtctggccacacactctgcagggccctagctgtgccatcagtgaggcctgaaagattggaagtggagtgagcactgtggcagaggagttgagggggtgatggggagagaacagttgatcagggcaaagcattcttactcatcttctgcatttctccttggatactcctgacacagtttgtcaagagcaggcgactcatgagtcatttgttgactgtgtgattttattcccctccctgtaagaaaaatactagagaagtagagctaagttcacttttgttttatctaccctctttctgcttttcccagcaggctttgctgccatgagcaagcccagatatgtccatcatggcatctttttctttgtccagcagtctcagagttaacctggcatcaggagcacaaaaaagcaacgcagatgttgggtgctttctttccaaaataccatgtctgaacctaaatgtgggatgattaggtcactcacttgccaagtagcatatacatcacaaaatattcagaattattacagtgccacagggaaaggcaaagaacatctagtagtagtgtaggatcttcattcatttattcaaccaatcattcagaagtatttatcaaatgctgttatgcactagatgatacatctgtgaacaaaacaaagattcctgctctcattttactgacattctatccagcaagtaacaaatcaacattctccaagatttggggtgaagtgaatcttttatctaggttctcaatggtcattttaggagttgtagcttctatactctttctaatttgctgtttatttgctcagtccagtgagttgtgtgagcggggaaaacaattcttgttctttggggtgacattaagcacaccattttaaagagagtcatttacaggttagttaatttattttgtagccagtgtaatatttggtcacctgacaaatagctgaatttgaagtggatgctccaaatcccctgttaggaggactgaaacatagtctactgtgacctaaaacagcgtcttcctaaatggtcaatatttgtttgttgcgtgcttgaagagaatgtttattctcccattattgggtataatattccatatttgtccattagatctgtgctgctcaattttatttatcctaattgttgtgttgcctgatatatcacttatgagatatgtcagaaatttatgactatgatagagttgtcagtttttctttgaggtatggtgctttttgctttatataatttgaggctatattattaggtgcatgtaagtttaggattatcttctcttccaagtaagttgaaacttttatctttgttttgtggccctctctgatgtcaaagttatgcttatatgctactaagttatgtttattgccttaaagtctgtctgacattaacagatgtatggtagattccttttgttagtatttacctggtatttgttttttctccttttactctttaagttttctgtttttagatttcagatgtgtttcttgagaacaatgtttgctaggttttaaaacatcctgtgtgatgactcttaaatctttttaactggagagattatatgtttattatgattactaaagtactttttgttttgttttgtttttgttttgtagacaaggtgtcactttgttgctcaggccagtctcacaaactcctgggctcaagtgatcctccctcgtaggtctcccaaagtgctgggactacagacatgagccactgtgctcagctgaagtacttatttatttttaactattttatattatagttggtatttgtcccatttttttctgcctttttttcccctttattacatttttcctctactaattggaacttctgttcaaattaattaattaaatttcaatttaattaatgaaaattttaagttaatttttctcctcccaaatatgaagaccttagaatgatttattacttacatgttactgttatccagtattattttctatgaagcacactatatttcctcacttttttgtcttgcctctcaaaattcccatctgggacaatttccttttgcctcaagggcattatttagatttactttagtgagattttgttagtagcaaacttttttcttcatctaaaatatctctattttatcaattgttgaaagatagttttgcagggtatacaaatctagggtgatggtgatgttctctcagcacattgaagggattcttttcctgttgtctggcttccatggttgctcttgaaagtcctgctgcccatccagttgctgttccttattagataatcagtgttttctctggctgcatttaagatgattcccttgactttggtaatctgcagtgtcatggtgattgtctccaggaatagatacattttaaattattctgcttggggttgttaggcttcctgaatctaagaattggtggttttcataaattttggaaaattttcttttgaatatttcctagaccccattccctcgaatatctcttgctagaacttgagttttgcatgtgttaggtcactgtctgttgattttactctcccttttatattttctgtcttttgtctctgcattctgcaatctggataattccttcagatctgtgttaaactttagtaattctcactctacctgtgtctcagcttctttttaaccaatctattggggtttttaagaaaaattaataaattcttattccagaaattatcttttcttcttttctcaaatttcaaattgcttggtcttcattttctaaaaataatcccttcttccttgctttatttttaagcctcatgtttatatctttaaacatattaaacatacttattttattttatttttttgagatggaatctcattctgcacccagtctggagtgcagtggtgtaatctcagctcgctgcaaccttctcccaggttcaagcgattctcgtgcctcagcctcctgagtagctaggattataggcatgcaccatcacacctggctaatttttgtatttttttttttttgcagagacagggtttcaccctgttggccaggctggtctcaaactcctgacctcaagtgatccacctgcctcggcctcccaaagttttgggattacaggcgtgagccaccatgcttggtctaaacatgcttattttataactgacatatgatcctcaagtatttgaggtcattgtgaatctgattttgttctttgttgtttctgctggatcccatccagggtgacctttttccttgtacatttggtgaaatttgaccaggatcctaatccttggaacttgatctgtgagaattttttgaaggctgggttaaagttacctctgcagaggatttgtgtttgttctgctacacacctgcaggctgtcaacctgaaaccactcgaaatgatctcttaaggattttcaaaccacgcagtgggaatttgggcctgaaccttgtgtgaaggtcagtttgggactaggactatttgggagaggctaactttctccttggcattgaaaaaggcatgttcccttcctgtcccttccgtgtgggcgggtttattcctcatgtccattaatactgagcacatccttcctttgaggtcgagctttacaagcaagggtctcttcttaggcatacccctcccctccaaggatgggcttcatctctggcctcctgccttatccacacaatatcaaaaaggcttgggccggggctcccctcctgtgagcatgctagttcaaccctgttactctcaggaccccacttcctctctgtgtttggccccagcagactcctgacttcttttttttttttttttttttttgagatggagtctcgctctgtcgcccaggctggagtgcagtggcacgatcttggctcactgcaagctctgcctcccgggttcacgccattctcctgcctcagccttctgagtagctgggactacaggtgtctgcgaccacgccaggctaattttttgttttcagagatggggtttcaccgtgttagccaggatggtctcaatctcctgacctggtgatccgcccgccttggcctcccaaagtgctgggattacaggcgtgagccaccgcacctggcccagactcctgactttcatattagctcaacagttattcagaagtttcctattctcttattctttttagctgacttcagtaggaggctgtccagggtatacactgaaaccacatgcagttaataagtgttctgtattgttaaggccaaggggccccatcttttttcttacagggaccaacttctctgcttagttctcaccccacccctcatttttttgagacagggtcttgctctgttgcccaggctggagtgcagtggcacgatcttggctcactgcaacctctgcttcccaggctcaagtgatcctcctacctccacctcccgagtagctgggactatagatgcctgccaccacacctggtgaatttttgtgtttttgtagagatggggttttgccatgttgcccaggctggtctcaaactcaactcaagcaatcctcctgccttggcctcccaaagtactgggattacaggcgtgagtcaccactcccagccttctctgcttagttcctctagctgagggtgatataggcaggtcccttcttcttccatgttgtctgtagttgggcacacacccccaaccagcactatggtgtgaggggctgtgcatgtaccaacagatatgcttgtggcaagcgctgatgcttcagtcccatctaggtgaagattcctgtggggagtcaatgcttcctctcatctctgaattcagctgtgtgccctctagtggcaccttggactttggaccagtcaagtcttttatcattcagaagatcaatgacttttgtgctttcctgttaacgctgttctgacagccttctgccagctagcctgggtgtcccatcacactgccctgggcaacctgttgccttctcttcaatgccatgctctaaggcaggggttggccaaccactgcctgtgggccacatctcacccactcacccacagcttatttttgtaaataaagttttattggaacacagccacacccgttcatattacctttggctactttcccactgtggtagcccatcaaactgaaaatatttaccatatctcactttgcaaagagtttttcagcctggctttaaggtcctgagctaggatgcttgctgcccacctcttcttcttccttgttttttttttttttttttttaaagacagtcttactctgtcacccaggctgaagtgcagtgatgtgatctctgctcactgcaacctctgcctcccagattcaagcgattcttgcaccccagcctcctgagtagctggaattacaggcacatgctgctgtgcttggctaatttttgtatttttggtagagacaaggtttctccgtgttggccaggttggtcttgaactcctggcctcaagtgatctgcccgccttatcctcccaaagtgctaggattacggatgtgagccaccacgcctggcctgcctacttctctcttcttaactcttccctagagcatcctgtatccaggccttcacctcctcattaaccacacttgtcacctcttcagctccagcgttgctccactgaacttttcctgctgtcctcagcttgctcatgatttgccctttgaaacactagaaattcatctctgcatgctgaaagacattgtagtagcttgcccttggaaacccttacttaatttagttagacgcttaaagtctctccactccacatcagggacctcattccactcttcatgggtcttctgttgcagaccctttgggggaaggcagatatcttgactccatccatttacacattcagtccaaatacacatttcaagcagcagatagtcttgggaatgcaacagcaacaacaaacttgtaacacagcaagttaaatagcatttaatggcactagaggagttctccttttgagtcatcagcttgagcagtgaagaattaatttgtactggaaaccatcaccagcaagtgtgttttgtgtaagtgttcaccaatatgctttctgtggctgcaagagcacaggctgttgatggccttgtggtcagaagtgtgcaacctggaatcagactgcttagttgggaatccttgctctgcactgactaaccagtgggcattggcaagtcactctcactgtgcctcagtttcctcatctggacaaaggcaaacatgacaaaatgagataatatattttaaactacttagaaccatgcctgcaacctaggaagccgtcaaatgtaattcattatcataatatattatttaatctttctgactttgtctttcctgctgtaaaatggaaatcataataacaaacttttattttaaggagtaaccatgatagatttaaagcaccaaagcaggagacactgtaggagccaaatacatggtagatagataccattttctggggtttcatttatatttgttctctatctcccttttcctactgaggctatttataaattcctttttcaaaggaaatggtttctagaaacatctagaacctagtggccatcctcagcatggtggatctttggtagcttcttactgcctcactctagagctgaacactggatgagaagcccagaaaagtttggtctcttgtctgctaactctgtttaccaagactcagcatccacctccaggaagtcctccctgatccctaaccccctaccaccttggtgcgtctgtggcatcctgagatcctatttgtcttctggagcagagactggtgtcattcatctgcatatctattgtgactaacagactaagttctagtaagtaccaaagacttcctggttcaatgaatgaataaatgaatgccagttaaaatctatttgaaaactggccaggcgcagtgtctcatgcctgtaaccctagcactttgggaggctggggtgggcagatcacttgaggtcagaagtttgacaccagcctggccaatatcgtgaaacctcatctctactaaaattaaaaaaattagccagaaattgcttgaacccaggaggcggaggttgcagcgagccaagactgtgccactgcactccagcctgggcgacagagcgagacttcatctcaaaaaaaaaaaaaaaaaaaaatacatatatatatatatatatatatatatatatatacacacacacacacacacacacacacacacacacatatatacatacacacatatgtgtatatatatatattttttcaaatatatatatatttgaaaacacacaaggaagctaccttaagaaatttgcagtatgattcattttctcaatacaacaatactgaatctcacaagagcactatatattgtatccctttttttaacctatctccaaatttcacagttaatggaaatatgcccagaaagtaacccccaaagtatatgccaactcagctacatagatagtcctttaaacctctgtattttctcctttacattttgttgaaacaccatttcattttcttatgctctctataaaaatattttgtaactacgatattataaagtgcttactttcatagcaatggagcggggattcatttgtgagtggattaggattgcagtttgagcagggctgctgcacaggtgtaatggatgcacaagtaagctccaaaatcccaaccgctatcatacctgagcatcatacctgccctgttcctccccatcataactgtctgtagctttaaaggcttaaagacagaaatgtcttcccattttggtcaacctgaaaaataagaggggcttctagaagcctttgttcagctggcagttttatatataaccaactcttttttttgttttttgtttttttttgagatggagtcttgctcttgttgcccaggctggagtgcagtggcgtgatctcggctcactgcagccttcaccacctgggttcgagccttctgtgtagctgcctcagccttctgagtagttgggactacaggtgcatgccaccacacctggctaatttttttatctttagtaaagacagggttttaccatgttggccaggctggtctcaaactcatgacctcaagcaatccgcctgcctcggcctcccaaagtatatataaccaactcttaattgttgagcaagtagaggaaagtaatggagtacaacccacatgatggagcagaacaacgattggtcatgtttgattttgccatatgcggagcaccccacattgccttgtacaaggtggaggcatagtctctgctttacccaagaagctgagaattctcatatagcaactaccacttaaaaagataaaaatgggctgggcacggtggctcatgcctgtaatcctagcactttgggaggctgaggaggacagatcacttgaggtcaggagttcgagaccagcctgaccagcatggtgaaaccctgtctctactaaaaatacaaaaattagccaggtgtggtggcgcacacctgtaatcccagctactcaggaggctggggcaggagaaccacttgaacccgggaggcggaggttgcagtgagctgagatcacaccattgcactccagcctgggggacaggagtgaaactccatctcaaaaaaaaagataaaaatgaagtaaacatcagttttctgcaagcgttctcacagccctgcaaaatgtggccaaggcagagaatgcccagaacccggggccgtttcctccaggctgtctcctatcctagaattccaggggctctcatgccaggccccacaccaaggacccaaggagacggatgggccccggtgactgtggtgggcctcatgctggatcatttgtctattaagtttctatttattgaaaatgaatgtggaatccaagacatacaacaggttgatatttttatcatttttaggatgaaaagcttaagcccatgtgctctatccatacaatacagtggaatattactcagccttgaaaaggaaggaaattctgacgcatgctacaacatggatgaaccttatgggcgttatgctaagtgacataagccagtcacagaaggacaaatgctgcatgattccacctacctgagtcacttagagttgtcagattcctagatacaaaaagcagaatggtggttgccaaacgctggggaaagcaggcaatggggagttagtgtttagtgggtgcagtttctgtctgatggttgcacaatagtgcaaatggacttaatgccattgaactgtacatttaaagacagttaaaatggtaaatttttaattatatgtattttaccacaatttttaaaaataaaatttttaaaaattaaaagcttacacacacacacacacacacacacacacacacacacacacacacagcatgtagggatcacacagatgtgagcatgatgccccagtgttggcatgagacagtcgctttccttagctggttcctacacagcgcggctcctggacgcgcagcttgtcgaggcttgaaaggcgcgggcagggctgcctccccttagctttgtagaccgaaggtcgtttactttggcatttttaacaaagatttaaagtttctggaatttgccagcctgcttggtcccgaggcccagattaagcagcatgcacttttttccttaaacgcagaacaatggcagacggcatgaaagctttcccagggttatttttcccttgaagtaacaaaaggggagacggatgaggaaaaaacacccacatggaatcaaataccgcagaaagcaaacttcaagccacgtgatattagcacagaagggaaatgggaggatgggttaaaaccgtgtgaagtgctcagagttctgaagtgagggctcttaagctatttttagcctcaaaaatgctataaatcctgttatcccattacactccagtggatcgaattatttgcttttctctacctttaccactctaatttttttttgtttgagtaaatgagagcaggccttctcagaggcagctgacatcagacagagacttcctttgcggcctctctggttctgttcctctcttccccgtagctggtatttgtagtgacacctgggagccacagatttgcttagcaacctttctccagggtgaacagggtattcacaactcctgaaccaaggcgtgtggctggtatcattttgtggggccagaacgcattgcgtggagaaattcagtgatgacctggtccccacgcctgctgctcagggccccatcaccctcgtgactgtcagtggtgctgcttcccacgtctcctaagagggcttcaggagaacgtagaacgaggtatctgtctcttcctttcggacctggcctttccatttggccatatgtcagaatttccagctgccctaggggcccaggaatctgtattttagttgctttccaaataattctgctgcccagctgtatttggagactatagccttaaatcagtgattccccgtcagtggtgactcatgaagagcttagatgtgggcctggtgtgtggttggtggcaaggggagtctttcagatcccttctgcttgttgctgttggtggcaggagcgtgcatgttatggtggctcaggcctaatcccatctgtttgggcatctcgcctgtctggaaaacaggtcccggagccatgcacaccaagctcctagggaaggcagagagcactccccgactcttaacaaagacatgtggaggtggacgtctgcccttaagcactcagggttcaagaaatgctgcaaagaacaagagctgcagccaccaggagatgcaggtgactcccatggaccagaaaaaggacagaaacatgacagaaaactggtagaagaaccaaagaggtttggcatttcacagggcacctgactctggagcccacagtcaccctcctcggggccctctccatcaacgtcatggatcaagttcctcctgatgaccaagccaccaaagagagctgatggttatgttcagttgactctgctgaggcagtcagggcagtgtgatctcctcctgggaattgctgtatttgaaatgattgaaataggctgggcgcagtggcttatgcctgtaatcccagcacttgggaggctgaggcaggcggatcacgaggtcaggagatcaagaccatcctggctaacacagtgaaaccccgcctctactaaaaatacaaaaaaattagccaggcgtggtggcaggtgcctgtagtcccagctactctggaggctgaggcagaagaatggcatgaacctgggaggcggagcttgcagtgagccgagatcgcgccactagagtgagactccgtctcaaaaaaaaaaaaaaaaaaaaaagaaatggttgaaataagagagctttctggaagagttgcttctaaagattgtttttctttacagttggagccatgcaagcattggccaagcagccttcagcctcccctcccctcaggtgggctcacagccccaagggttttcacgggggaccttgtcacttgagagtatcctgtgagtgtcatagcacccattttacacagcaccatgtgcattttctgatatgtttttgcaccctgtgattactgttccaaccttcattggtcaattgaatatggcgtgactcatcaccgaagcagcttggcttggcatccctcttagggaaccccatcatttggctcaagtgcagccgtgtcttcagccggtgcatcctttttatttcatttcacatactgccttgtaagaatgccaaggaccttctcttgtacaataccagggaccaagtaaaatgaaattatcaaacagtaaacatggctgaaacactacataaaaagtgctggaaacttatagtctggggcctgcagaatttatcagttacgtgtggtatagctaataccagagtgctgttctttgtaggccccgtggacctgccgtgattgcaaaaagtggtgacgagtcagcattcccctatgtccacggaaggttgtttggcagcagctgagacaagcagcctgtgacagaagacagcctccagggaccaggtcagtgcgtgtggccgtgcaaggagcagtggccctggctccagatgctagggaaagctgggcagaaggcaaaaaaatatagaggactgtccgaggagctcgggagggagccaggagtgaggcaagcagcattccctgacatttctgcctaagcaagggctctgcaggccaggaggagactgtcacccacaacggaatgtccttctttggaagcagctgaggacctggaaaaccagcagttcctctttccagcgttggacaaggacatgagaaagacccacagcaacaagctggagaatagctccctctgtgacattgaagcaagaagaaaaggcatggagagatttggctactttgtttgttcttctaaaggaacacctggttttaaccgtcaactgaaatggccgtgtgtggtacattaagttcagtaagaatatacactttcagctatctgctaacagaatcaaggtaactttgcggttttgtttcaaaaaaagttttctaattttggtggcattgattttgtagattctcactgatacccaactataagggagagatgtttacttgtttgaaattcatctgagtccaaataatataacctgggttttaaacgttcaccgctaatttttttaaagacactgtaaattatttaaaagaaaatgccttctggccaggcacggtggttcatgcctgtaatcccagcactttgggaggctgaggcgggtggatcacttgaggtcaggagttcaagaccagcctcgccaacatggtgaaacccccatctctactaaaaatacaaaaattagccaggcatggtggcatacaatgtaatctcagctacttggtaggctgaggcaggagaatcacttgaacctgggaggttgcagtgagcggagatcgcaccactgtgttccagcctgggcgacagagcgagactctgtctcaaaaaaaaagaaaaaaaaaaaaagccttctaaatattttcatgaaggtgcaatagatctccagggcacatgttgctaaacatgaatcatttgcttcattgataattatattttaagataaatgttattgtatttagggtttacaacgtattacgggatatgtatagacaggaaacgggttactatagtgaagcaagttaacatatccatcatgttacagttacttttttgtgtgacaagaggagctaaaaatatacttatttaacaacagttcctaatgcactacaatgttattaactacaatcctcatgttactctagccttgctgaccccccctcacctgctactttgtatcctttgaactctacttcctccttttctctctcccttccttccatccgtcccaaacccctggtaaccactattttcttctcttatctctgtttttttaattccgcatgtaagtgagatcatgcagtatttttctttctgtgtctgacttactttgcttagcataatgtcctccaggcccgaccatgttgtgggaaatggcaggacctcctgattccctttttagagacagtgctcactgtggccaggcctttcttaatatcgtgcttcacactggatatggtgctgtgttctttgcaaaaggatttcacttttttaggttaaaaaacaaccatcaacaagggacaagatgtgtcctagcagccactcaaggagagaggctccgaatcagtggtcaggagagtcagctctggggttggccactggtggcctgcacggctgagggctggtccctccacacagggacaccgggcccacttctgaaaaccacatttcagggtgtctttgacagtcaagaagtggggagcaactgaagatatttggcctgaaatgggggacctctgggggggacaagatcactctgctccaatatctgaaggccaactgcatccctcggatggctttaatttaaaagaattcttttgaaatagaaaataacaagtgttggtgagcatatggagagattggaacactcatacatggctggtaggaatgtaaactggtgcagccgctgtggaaaacagtttggtggctcctcaaaccgttaaaacatagaattaccatatgacccagcagttccactccttggtctatacccaagagaaatgaaaacatatgtccctgcagaaacttatgttaacttatgaacaatgttcacagcagcgttattcataatagccaaaatatggaagcgacccaagcacccatcagtggatgaatgaagaaaatgtggtaccatatgtatatatataggaatattattcagtcttaaagaggaagcaaattctgaaatatgcccgaatgtggagggacctcgaaagcattatgctaaatgaaagacgccatggcaaaaggttgtatagtccctctctgtgaatatccagaaaaagaaaatcccttgagacagggaattgggggaggtgggagtgagagcatagctcagtgggtacaggctgtttctctgaggaaataagaaggttttgaatccagagaaaggtggtagttgcacaacattatgaatgcagtgaacaccactgaattgtacatttttaaatggttaattctatgttatgtgaattttacctcaatttaaacaataatctgagggctgtcattctgtgtgacccctggacatatggcaagaggaaatgagtagaagctccaggagcacagcagggaggagggagagcagtatttttgctcagcaggaaaaactgactcataaatacaactagtaggaaattgaagaggccgcccaagaaagcagcaagtgcaggggactgtagagtgcctgtcgggtgctgcactcaaccccgagagcagcagttctcaccccgaggacacgtgggattcacttggtggcacaagaaagccacacttgggccccaccccagggatgctgacgctgttggcctaaggtgtggactgggcatccggacaaaggcccctggtgtcttagctttaggtggaaacagatgaccttttgtgtccctcccatcctacctcggccccaacagggatttctgttttaatgactgtggtgcctgcgagcctaggatcatcactgttcagtgtgagtggtgtacccacagcatccgcctcacctggaagctggctgggaatgcagcgtctcccctccccacccccgcccagtcagaatccatactttagcaagatcccaggggacctgtgtgcccatctgagtttcagaagtgctgctgggccggggcatgggggctcacccctgtgctcccagcactttgggaggccaaggcaggcagatcacttgaggccaggagtttgagaccaggctggccaacgtggcgaaaccccatctctagtaaaaatacaaaaattagtcaggcgtggtggcaggtgcctgtaatcccagctactcggaaggctgaggcaggagaatcacttgaacccaggaggcggaggttgcggtgagctgagatcacagcactgcactccagcctgggccacagagtgagacttcatctcaaaaaaaaaaaaagtgctgctgtcgatctttatttacaagacacttcgaggtgcttttcctcattttatcttctgaacaatcgctggtttgttcagctgtttgacaggggaggaagtccaggcgcagagggcttcactcactccacatgccacggacagtgctggtctcccacgtgccccattcagggccttctcccccaggtccagggcctgcttcagctctctgtgacacccaccacctccctcatgtgctcgcagtgccctgcccggagcccaggctgggtaattattgggtatgctgaaactgctggggctggggagaccccgtgcctcagcttggagcctgatgccatgggaatcctcaatgcatggctcagcttgtcattagcttttccctttcttttttcattctttgttttgaaataattatagattcaaaggaagtcaccaagaggttcaagttcagtgtacccaccacctggtttcccccagtggcaacatcttaacgtcactatagcacaatatcacccccaggaaggcggcactgccacaggggcctgtagaattgtgtcatttgccacatttgtggatttgcgtaaccaccacccatttctttccttgacttaaaacaaaaaaacaaacagccgggcgcagtggctcatgcctgtaatcccagcactttgggaggccaaggtgggcggatcacaaggtcaggagttcgagaccatcctggctaacacagtgaaaccccatctctactaaaaatacaaaaaaaattagccgggcgtaggtggtgcatgcctgtagtcccagctactcgggaggctgaggcaggagaatggcgtaaaacccgggaggcggaggttgcagtgagccgagatcgcaccactgcgctccagcctgggagacagagcgagactccgtctcaaaacaaacaaacaaacaaaaaacgatggggtccccgaaaacacactttataaagactgatttcctgctggcaggagagagagctgctgtacatcacaaagcaaggcggcccactagagtggtatggtcagcgacctctgccttgcctgggtgaagtgtctctctctctgtctctgtctctctctcacacgcacacatgcacgcacacacatgccatgcactttctctgtggaagacttcaaagtgtttggtggctgttctgagacctgttcctcctcggctgggctaggggaggggcccactccttttacctgtgtttctttttagaggagaaactgacacaaagtcagatagtcttggggatggaagttgctctcatctgtaagaaaaggaaactgacctaaccagcaggtaatcacttgaaatcacttgtgtcccgtgctggaaacagctccacagcagtgtctatgatggattggaacctacacagctagaggaagaatttgcatccagaaaccacaggagcagatgacccacaagtgtagctattttacttctttcatgttaaattccaaataaaaggatgattatctttgaactgaccccagtccaaagtacaaatgcctggctgagatccaccaaggccagatgttgtcatcagtgactgggtttatgccaggctatcggtgaactgggtcagagatggtgcaggcaaggttgctgggtcagggcaggttcacagcccagtcattcctaaccaagaacatcagcacctgactggagggtgggaatgaggttcctgacctgctgactcatttgcagagtggtgtgtcagagccacacacggtagcagcataaacctgaacttcaggtaaccacacgccatgggatgctgcagatttatgtgcccactgcttgcagctgagaggaccagcatgaatggctctaatttgtcaccatggcacagtcacagatggagaatgctctgtcataaccagcgctcccagtctccataggttcttagcacccttccccatccatgtttacctgtacagccacctgtgcaggtcattcttgcccagaatagtacatgagctaaacagccatcttcaggtggttataaaacctcatatttatatgaggtttcatagtttacaaaagttacttcttattccacctaatgaagaaaccacagtccagaaaagtttggtgcctcccccgaggccacctacctggtcagtgatggatcagcaccacagttcccatcttctcattacacctccctactggttaggccccagcccacacagagaagtgtttctgtttcacccctggagagggccctgaagcatcttgtgagtttgtggaaagagaagaggagcagctcttgcttccgtggggagcacagccagactcctgtcttcatgtcctgtcccttaaatgccctccaaaaccgggggcaggtgctcgagagaacttgaccctgattccggattatggggttttctaaactcagtactgtggctgagatctgtggggcattttgcaagctgcttgcttttgtgtgaaacccctatatttgtcagtattttaagtttctgtgaggctgttcttgaattcagttcctttctctttgcctaaatgcaagccacaccctcatctcctcccgttgaccatataagaggtctcaagggcactgaggaacttagcagaaagcaaacagtaccttcagaagattaaaaaaaaattattgcatttgtttttctacaaccaagataagagacagtagataaaggaatgtgtatgtcttgtacagctcactagccccaccatctctgatacggaccagttcttcctgccccttgaataagtatcccttgtcttatcatagtttacatcctgctgtgatgccatgtgacatacatgctctcgcacacacattattaagacttcactccttgtgatcaaggctgagaaagattgtggtggtgttattgttaatataagatttatgacctcaaaatgtttgcaagcttggggtcagagatggagcattcctcagagggagtcagcctggggtccttcttacatagacatgaacatagtttctccagagcaaggcagaatacacagtttaaaccatgggaaggaggaaagactcaaaggagtgatttagtaagagtataggtaaagaagggagaaaatattagtatttctaggagagttagaaggacttagtacttctgccgttttgttttaaaatatatttttttaatatataaagagacatcttggctctccctaacgaaaatggcctaagatcctttatatatatatataatttttttttttttgagacggagtctcactctttcacccaggctagagcgcagtggcacagtcttggctcactgcaagcttcaccttctgggttcacgccattctcctgcctcagcctcccgcgtagctgggactacaggtgcccaccagcacgcccagctaattttttttgtatttttagtagagatggggtttcaccctgttagccaggatggtctctgtctcctgacctcatgatccgcctgcctcggcctcccaaagtgctgggattacaggcgtgagccaccgcgcccagccgatcctttgtattcttaatgaaagagggaatgaattgcaatgaatatgtactgcttctccagaaaacagaaaaatttttaatgtttttatttaaaccagacatatacttttttatttatttccttgttggtttctttttcttccaaataggttgcaaaaatgaaatttctgtttaaatttataacatgcaagagtatatgtgtatgtggccttggaatgattatttagttttgttccaaagatctgatagtttttaaatgaactctataatttagggtactctgggaattgaaaacttcgtgctttatttaggtaaagatatcctgaattgcttacttaagtaagtcaagtaaatggaacgttctttgtgataatgctgttgcattataagaaatgctttgaatcataggtaggactaatgtatagcctatttatttatttatgagatggagtcttgctctgtcacccagactggcatgcaatggtgtgatcttagctcactgcaacctcccccagccaggttcaagtgattcttctgcctcagcctcctgagtagctgggattacaggcacctggctaatttttctatttttagtagagacagcctagccatgttggccaggctggcctcaaactcccgacctcaggtgatctgcctgcctcagcctcccaaagtactgggattacaggcatgagccaccgaacccggctagccaatttattttaacagcatttcactttcaattttgttaaatttggctagacatgtaaaatcatttatttaaaatttaaaaatccaaacttctccctattttgtccagaatttcaaaattgcagtgagttgtggtcgcctggaaaccaggtgtatgatactttgttaagcacactaattggcagcttggagttttgcattgcagaaggctcgttagtgagggtgggtgggaatccacactcctccaattagtgggcccccaagccactcgcacatttaaagtatgattcactttacccaagtttgtttgtcttcagctcttcaggaaaacactgttacacaagccaaggtctcctatccagcaaccttttggatcccgaggtctgcacataaaaggacttgctctgcaggctccctggtagctggtgaatatcttgggaatttaaatatgaagatagttgatgtccatagctaggatctgttatttaaatgtagaagcatttaaatatgcctttggagttgtttttttgcattgtgatagtagccaccacctgagctaacaattcattgagttttatgctgtcccacattctagctgctttaagggattgtgttctcaggtctcacagatggcctgtgaaggggagaaactgaggcagagagggttaggaacttgcctaagctagttaagcaacagtcacgattagaagccaggatctttcaggactgttcccacgttatgcgagagtccttgcctctcttcataaatggtagatttcccatctcctttaatatcctctagatgaattcatgaacaaaggccaagggacaggagaaagagagaaaggaggaagaaatgatgtcagctctttccttcagttcttaaaaatgccaaagacaaaactttcagacaaggtcgtttcctggaagaggtggggtaaacattcccagagtcatgagtttttagatttgaatgtttctaaaatgttgattgacagaaccttctaatacatttgttataaacgtgacataaaggggaaaaatgtccagcattttgaggaagaaagggctctaaatatacataactgcatttgaacagattcctttgcttcctcgttggcctgggctgcaaggccactgtcctcttatgagccctaggaagcaggactggcctcctgaggaccccagcattagcctccaggtttgtgctgggccctcctgagacaaccccaatccagacactagctcctataagtagagcacctgagactcaggggaattccctcaaagcgttccagcttctgagccagagaggccagaagtggaagcctttctgtcggacagctacagcccagactggatgcaggaacagcaggaacagagcagtggcctcctccgtggcatggggccttgtgcccaccaatcctggcaccactgaaccactgactcaagtccgtcctcagctccagtgagcctcttgttattgccagtggctgacggagaggtgaggggagaggacgtcatgcaggcgagctgggaggtagcaccacggtttctcagcagtgttcgtgcaaattatcactataatgcacccgtgcaggcccagcagcctgtgcaagtatcacagcaccatacagacatgaattcatgtgtctttaataacagggaaatggcaatgtgtcaatttacacagttgtttttctgcagttttttctttttctttttttttttttgagccatcttcccaagtgttctctgggttttcctcttacccgggtcccctgtctgccatccacaggctggcatgagccacccaggctgggtctgggatcagccgagggcctgggctggtgccggcaccgcccctctccgcgaacgggccctgcattcgcatcattagttcatcaccatggaagaactgggctgtcaagctgacctacttttcttgtttgcccacagcaggctaagcctgtttagcctcatccagaggggctgggcagagcaagttgctttccgagtcatacagatggcagtcttctgagtgagtgtggttgaatctgtttgccctttttgcccttagtctgcagagttagggcccagcacccaggatggcttgagtccaggtccaagcacaggggcatcctgcaacccatattcagcctctcccgaagagatcctgcattaggatgaattattgcgggaaccaatgccaggcttctttccaaactttaaacacagattcctaaatggaagctcttcatattctatactaagccctaagaacatcagccacttgcagagatgccaggagggtgggacccatgcctgtgcttgaggggtttaccatccagtgggggagggttgtgaacagctaaagccaaggagaagcagaaacagaagaggatagggatgagccgtgggggcggaggaagatgcgctagtagggtagaaagtgttggagagggggacaatgtgatgaggatggggctaaagtcacagactggcagcttgtcatctgagggtttgaatgctacgatatggaaccatgtgaagtgctagtagatgtacatgttatccccccaccccatagttactacctttattctttgctgaaatattgctatattgctgcctgtgaacataggatagtatctgttagagttgttcaggggaaaatagttaagatcagacccagactgtcatgattaaataagctaatgtacaagaaaaccactagccagagcttcatgtgtagtttatctctcaagctcatggattttgtgtgtagcaacatgccttgggtcctgggcctgtgccttctaattctgatgccatgacttctgactcaggcggacatgtcttggactctccttgacaccccgaagccaccacccagagctttggaggaggaatcgggccagtgggtgaattatgccttaactggggccacttctttagacatttgcagaaggaggaactcagtctctttttaaaaagaaaaatatgtacttctcttttctcttgcagtttccccagcattattcagaggcagagtgacagatgtaaggagagggatctaaaacatctttaatatacaacatgaatatctgaatggacattgagaaactggagatttctagtcctgctgaggcaaaacccagatgacctagagatgacataaaagtcagtcatttctacctgtcccattaccggtgatggtaatgtttgtcactcaattaaggcagtagctcttctttagacattcagcaaacatttgttgaatacctgcatgggactctgagtcttggtgttcgaagagggaaaatggaaatactcggccctacattgcctaagcccctcactagggagagctgtaagctcttgggaagggcttgccacggggctttctgtttgttgaggttcaccctgtatccagtggctcttctagcacaggcagagacatgccctttgccgtgtgacattcgaggagacgaccagtttttttccctactgacctatgatccccacatcccagcttctctgcctactggttggtcttcctgacattagttttgttcttgtgtatttgatccatgcacacatttttaccacaccggatatcctgaagttgggctggttggggttttgggagaggcatgtctagggttggttcactctgtggattaggatctagttttatcaaggtggtgggagaaaggcctcaccaggcagcaatcaccaatggatcccaaattcccagctgggcctgcatccaacacaaccaaccagggttttcagacaactcagattttaaaaagaaaagcagcaacctgtcagtttggtgacctagcagatacatctcaatgctttttactttttaattgactttttaaaaatggtgaattaatgccattttccgtatgaatgcatcattgtgtagatttgtgtagatgccttggagacgtcccctgagattgagagcgtggggtgggcatgttcgggggcggggagggatatgtagagcaactagaaggattgaggttttccttgcgtgcacaccctcctcctggcagcgtgcagtggtgagttcctggttcattgggagtgaaatgggcaccctcctgcttctgtgtgcatactgtatgaggtatgtagctttgccagatcttagtgtgacacaccaggatgacagctagcaaggtcacgtctctgagggttgttaggccccagccctggtataatgcctctgcaaggcatgttggtcccctacagtgggccggctgtgtccagggagcaggctgggctcagaggtagtgcgagctctcagctggcctcagggcccagccaaggcccctcatcatctctgactatagggacaggtgggtgcagggaaggggtggcaaacttagtaacgttgatctccttgatagtttctacccctgaatgcacctccacacaaaattgtgcaggccttcccagggaccctagcctacggggaatctcggggcaaggagaggtgcaggtgctctgggcagtaccacaggtgtccctgtaccctcaggtcatcaggcccaaatacagtgaggagccagccactcagagccacttgaggggctccaaatgccccattttctcatgccccagggcctttgaacaaaccattccttctgcttgcatgcctcttccaggctcagctgaattgcatgatacagtgacagtggaaggagtggaggaggatccaacatcacagatactttaacagtgaatatgttaaatctaatacatcataagagagtcccgggtgtgaaggaagagtgctccttgctgctggtgctgtcccatctgctccctgcggggccccttgcagcccgtgagcttgacttggccttggctgagtcagcaggggtggtgggcaggagacccctggctgcacagggagggccagcagtgtgctgtctgcttaaactgtaagtaaaagaagtgaggatggtccaggcgcagtggctcacgcctgtaatcccagcactttgggaggccaaggcgggtggatcatgaggtcaggagatcgagaccatcctggctaacacggtgaaaccccgtctctactaaaaatacaaaaaattagccgggcgtggtggcaggtgcctgtagtcccagctactcgggaggctgaggcaggagaatggcgtgaacccggggggtggagcttgcagtgagccaagattgcgccactgcactccagcctgggcgacagaatgagactccatctcaaaaaaaaaaaaaaagaagtgaggatgacaggagaaggtagatggtgcaacatgagggtgctttctaccaacaaggtgtgcagcattggacacgcatgaccacgtgacctgcagctctgatggtgcaacatgagggtatgtcctaccaacaaggtgtgcagcattggacatacttgaccacgtgacctgcggctctgaaggtcccacctgttctcgttctaaagtcaccatttctgaccgctgtgctgtggaaggggaggcaattaaccagatgaggcgtcccaacagattctcctatcgattgtgaaaagtgggtccacttcagcttacagatgaggtcatcatgcccaggctccaaggccaccacacaagtgaaggcaagagcactgaggacatttcaacctagatctggctagtttccaaactaattctgctgcctcaattagcaattcacatcaaacctcctacgttttgattaaatgttatttgaaactcttgatattaaacccaagattccacagtctaggtgtccaaaactaatttgacttcctgtttcaagggcacctactttttctctccttgcaaacttgagcacagtgaagatgagcatttctggacctgaaggagcatttggggaacagttccatggagggagatgcttgctggagcagtattttgtggattcatttcggcttgtctgtggcagccgaacagcggtttccaacaaaggctttcactgactcagctccaagcatgactcgtaaatctccttttcccctcttgctgatttttctaggcatctattgtccacaccctgaccacacactgtcacccatcagagtccccagttgactcaggtttacactgtgccatccgaactcttgatagagagtccccctaaaaggaacctgaggtgattgcaacataaatgtcaaaggttgcaagaataatatgttgtgttaggatggcccttccatccagatatcatggccgtttctatcttgagaattatttgctgaccaaacgatgttacggtacatttacttaataacaaatttttcaactttcttcatccattccttcactgcatatgtcaccctctctctgaataatgaatcatcagattcttggaaaaaggaaatcatgaaggaggaaccatggttgtaacaggcagataaagcttcagcttggttttttagacactcatggtagcgtttgcgtatggtcacgacgctcatgagagtcttgtcttggtttcttctagccatctggctctatgaggctccagcaagcactgtgagacccggctccttgggacaaggctggagagggctagtgttaggattggatctgtccgccttgccgtttccaggtcagagaatgtgccagaatgcgatgagaactccctagttggaggggaattgggattgcaggagctgccggctctcaggctttcactgtccatctcctttagaaatttattttttattttatttatttatttttgagacagagtctcgctctgtcgcccaggctggaatgcagtggcgtgatctcagctcgttgcggcctttggctcaggttcgagtaattctcctgcctcagcctcttgagtagctgggattacaggcgtgcaccaacacacccggctaattttttgtattttcagtagagacagggtttcaccatgttggccagctggtctagaactcctgacctcaagtgatcctcccacctcagcctcccaaagtgctgggattacaggcatgagccactgtgcttggccttagaaatttatcttttctcactgaatgaatcattgcaacaccaaaagccattccctggagaggaagaatcacaatatggaagttatttcctagcttccccaaatgacaaaggaagataagtgagcgtcgcagttcatcagcaactgttgctcaaaggctttttattccttaacataatgaggaaaaatcattaccaagctcccatgtgtgagatacagacgttaatccaaaacgacatgaggtcccctcaccagggactggctgggaggacagaaggtacacactctgtcagcaataaataaacccccatcaattggggagatgtgtgtgctcggttttgccttttatgattccaacttgttcttgttttctgtatttttttcttttgattaaattctaccaggcttggttggtatggtggggaagagtgttaggattttccagctaacttgggacctgtaattcaaaccagttctcagccaatttcaatacatcatgattttatgtttgtgaaaacataggccttgcaacacaacaggcttggggtagtcatttcagggaaaattcatgatgatacaaagtgacccactgggcctataaagactttacaaaaaattctaaattaaaagacactgaagaggaaagtttagtcatgattccagtgattctttaacatggtttggcaaactgctgtctggggaccaaatctggcccacaacctgttttcgtaaataaagttttattgaaacacagccatgcccactcatttacatgttgtctatggctgcattgcactataatggcagagttgagtggttgcaacaaagactggatgctctgcacctaaaatagttaccaggtggccctttggagaaaagggttgctacctcctgcatgagtggagtaacatgcctttccgtgcgtgctgcatgaggccctctctggagacctgggtgagctgctagtccctgggggagactgtcacttgtatgactcattagtcttctgtctcactgctgacgcacttgggacccagggcggatatgccgtgacaaaataatcctgctgccatttccaggtccccatttgccaggggccagaattctaatcagttgtgtagtaggtggctgtgagaaagaatgttctaaagcctttggggcagaaatttcacctgggtgtgtgaatgtcatttgcaggcttcacttttgtcctttgcttcagttagagtcaacagattttttgagggtctgctgtgtgaaggaaaaccccagtcatttcacctgatagtcattccattcccttctctccttcctcacaacctcacaatggccggttgctttcctgtttagttatgagcggctcagggtcagtgataaccaggtccatgcatgtttgtgtctctccacaaggtcagacttttattgacgtgatttcaatcacaaaagctggaagctccattgagttcccaaggaggaacttccccttactacttcccattcacttaggagtcagagccgcgggcacacaggctcaagccactccacaggtcagtcagtgttgcaaaccatgcataatagtacacttatcaataaataaatgattaaacatttcacaataaatgaagtaacatttaacatcaaaagaaaagggttaatggaccagtccagggagagcaacatgaaaaaaaaaagaatgtcctggcctggtctgggcagtccattggtctcacaaggaagagtctttgatgtgggcagagcattgggcagtggatgctgggtgctgatcacaagcgacagcaagatggagtctgtggggacagccatttctagctggtgaagtactgctcttatggccgcagagtcctctggtgaggactgagtggaggaatgtacttggttatgtccttgttggaagcagtcttcattgattaggcaaaacatccagtcttgttggcaaggtgccttttaaaatgtaagatggagtctttctctaagatggagtttactgtgtcaagggtactgtatacagttatcactagctagtccagtattctagacagcgtatgtgtgtctgtctgtccatcatgcgtacacacacacacatacacattttcaacactggtagaagggaatgattatcctgtttctcccaaagacacttgttgggcttaagtaccagtttctactgtgagccctttaattcatgatcattagtgatagtgtgattaaaattctgcagctacaattttgtgatgacttatttgtgccggggactgtgctgggggcttcccttggactctcttatgctgtctcacagccaaacagtgagaaaagctcttctgttctctcactttgcagttggggagctagggctgggagcatcacacttgtccaaggttatacagagatactgaagggcaaagcctgggtcggtctcagtttgggtcgcctgaccccaggccaccactgcctttctccctttcacagatgtggatgctggacccaggaactctgacacccagtgtgccccagtagctctgcctgccagcagcaggggtggctgtctgccaattcccttaggagttccagccctcctccccgcccctccacactcagtgctccactggccttgcttgattagattccccagctggtctgtttactgggcctggcagagctccttacccccatgcccccactcagtggtcctcacagtcctgtttgcagcagccacaggtagtccctaggggtggggcagactcaggcttcagctggagcccctgcctgcgggtgcctcttggctgtaaggcactcttcctaccaatatggccttttctgtctctgtttaggagcccctctctgaaaccttaggtctgtgtgaccccagagtccatttctgtttcacccctggtgacctccttactgtgcagagaatgtgttcgttgaaattcaaagtagataagaaaggctgaagctcagtgtcacctcccttagcaggggctcagtggccacagtgtgaacagaaggggtaggacagttaggtggggcaggtgtgcaatgaatggaactcacctagagctttctgtgccccaggcatcatgctgggtcctttattgcacacatacctgtgacctgcttcctgtttgcaccttgcacaattgctgcctggtgggtgttagctgcattgtgttaggaatgaggggaacgggctcatgaggtttaaggggcctactcaagatcatagagcaagtaggttggaatggagatttaaatcagactgactctgaagtcggaaaccccctattctgagcagcagtggctggagaaaggcctcctgagtcagtgccaggaggcagagcccagggtctgctctgtccccaagcctgtgtctgtgggcaggccacttagccttgctggggggtggtgctgcctgatttatgagtggaggataactatagccagcccattccacccacagaactgatggagacaaaatgagattatgttttttcagaacttggcagctgccaggggttggtgagggacccattgggccttcctgaagagccctggctgccagtgctgtctgagtggattttccctctagtcagtagctcctgcacatgcagaagtttttgttttaattttagtcaccaggatataactgtcccttcaaatgtactttgtaagcactattaccttggagccaccacgatcatggggaggtttgtgggagtgaatgtcaggtagtggcacaggaattcagatgggggtttggccctggctttgtccttcctttcctccctccctcccttcctcccttccttttcttcttcattcctcatgcatttattgagcacctaatatgggtaaggagcttgtattagtccattctcatgctgctataaaggactgcctgagactgggtactttataaagaaaagaggtttaattgatccacagttcacatggctgaggaggccgcaggaaacttacaatcatggcggaaggggaagcaaacacgtccttcttcacatgatggcaggaaggagaattgctgagcaaaatggggaaaagccccttataaaaccatcagatctcatgagcacccactcctatcatgagaatagcatgagggtaactgcccccatgattcaattacctcccacctggtccctcccaggacacatggggattatgggaactaaattcaagatgagatttcagtggggacacagccaaaccatatcatagctgggcgagccatcgtgaaatgggtgaagatgcaatttgcctaatccttgccatcaaagtagagaacctgtttttgagtgtctgctgcaggccagactttgcaaacttaagttcatttaagtttcaccgctgtcctctgagataggtgtctgtcactcatgttcaaaacctccagtgccttcccgtctcacataaagcaaaagccacaatgcccctctgcccctggctccacctccccctcaccaaagcaatcaccgggctggcctctgggctgttcctcgctttccttgctgtctgggggaggcaccctcactgctcactcccacactcccttcaggtcacagctcacatagcatctcatcaaggaggtcttccaagactccctaaaacatcagaacaagactccccgaaccccgtcccacccaggattcaccttttcctgcactgcagtgataaccaaagaacaggctctgtgtttacttatttgcttgcctgcagttttccccaactcccctgacacatgcatcccccgcctcatgtaagcaccatgagagtagcggctttgctcacagtgggttcccccttgcccaggcactcagggagtatctgttgaatcactgtatatcacatgcagttggcacatttgtgctttggcatatacattctcctgcctcatcacagagcccaagaggagaggcaaatagaaggagatagtacacacggtgcatggatcagagacctgcacattgttagttttcctaaaattgatccccaaattcaattcattctcaatcaaaatcgcatcaagctatcactttttttttttgaggcacagggtttcactctgttgtttaggctggtgctcactgtaaccttgaactccgggctcaagcagtgttcttgcctcatcctcccaagtagctaggaccacaggtatgcaccaccatgacaagctaatttttacttttttgtagagacggaatcttgctgtgttgcccagacgactcgtggcctcaggcaatcctcatgccccaacctcccaaagcaatgatattatgggcatgagccactgcacccagctgcatcaggcatttctatagaaattgacaagctaattctaaaatttatgtggctgtgcaacgacttagaatggccaaggtaaacttgaataagaacaacgttggaaggcccaccctacatttatgtcagtaattactgcacaactttaggagttaagatagtgtggtaccggcataacaatagacaaagggtgtggtggaattgggaaacatggagttagtttgtttaaacaacagaggagttatattttcaagtgaaatgctcaatatatttccagatgaagggcctctaaatgtaaagcaatggctccaattgttaatctgatacaggttcactcattatatatctaagtccaaaagtacaggcaaaaatcatataatttttttcagcgtaataattggatctaccactttaaatttagatgtctttcacctaaaaaaaaaaaaaaacaaacctgaaagttgaaggaaaacacattgtgcatattacatgtaaatgtaactaacatacctcttatgagtgagtttatcgccacttcagtcgggtggccaaggctggcatccacagtgacaagccatgttgacagcatgatgtgataagaaggacactttatttcctgggtcttcctctcaaaaacccgtattctgagcctgactttgagaaaaacatcagacaaacccgaactgaagaacattctacagatactcctcaaaattgtcaaggcctgagaaactcgcagagccaaggggtgtctaaggagatgtgctgacaaagcgtgctggggtgtcctggatagagtgctagagtggaaaacggacgttacgtaaaaactgaggaagtctgagcaagtttgtctgaaaattatggacttcttttttttttttttttttgagacagagtctggctctgtcgcccaagctggagtgcagtggcgtgatcacggtgcactgcaacctctgcctctcaggctcaagcgattctcctgcctcaccctcccaagtagctgggattacaggtgtgtaccatcacatgggctaatttttgtatttttagtagagatggggtttcaccgtgtttcccaggctggtctcgaactcctgacctcagctgatccacctaccttggcttcccaaagtgctgggattacaggtgtgagccactggcacctggcctggacttttcttaataagaaggtatcagtgttgcgacaaatgcaccatactaatgtaaaatgttaataacaggaaactgggtgtggggataagggaactttctctactctctttgcattttctgtaaatctaaagttgttcttaaaaatgcggtttattttttaataagtttatcttatgtgtctttcaccccacagacatcctgattctgtcctgcagaattgagacacataggataaatgaagctaaatatagtccataaataatgcatataagatcacacactatttgatgaaagtgctaatgcaattcaacagggaaataaatgccttttaaacaaactattctggagggatgtccatattgggggcgtggtgggggtggtggtgaataatgtccgagccctatccaacactacacataaaatttaagttgcaatggactgtggatcaaaatgtgaaagctaagtgatgaagcttctagaggaaaacataggataattcttcacgacattgaggtggcaaatatattttagaatacaaaaatcgctaaccataaaataaaaggttgataaattagactttatcaaaatttaaaactgctcatcagaagacaccatccaaaaagcaccaaggccacccacagactgggagaaaatgttcaccattcatattttctgacaaagtacttgtacctggtagagataaacttctatgatcagtatgatgaagactaacagtccaatttttttaagcaggcaaaagaattagacatcttacaaaagaagatatctaaatagccagtgaaaagtgctctgcatcattagtcatcagggaaatgcaaatcccaatgagatatcataacacacccacgtaaattactaaaattaagaaatattacatgttagaatggagccactggaactccttgtacactactggtgcaaatatgaaattgtacgttcactttggaaaacagcctggcagtttttaataaagtaagcatacagctaccccgtgttccaagaatgacactcctagatatatacacccaagaggaacgagtgcttatttccacagagacttctatatgactcaacactggtgatgttaatgttgaccagtaggtgaaagtggtgtctgccaaccttcttccctgtaaaatgtttttcttttgtaattaataaataccttgagagagatactttgaaactctgcaaatatcctgtttctccccaagctttttcacattaattttagcatccatcggtggatcttgcctgcaacaatgattactatggtatgccgatggtgattttcttttcttttcttttcccctcccctcccctcccttctcctcttctcttctcttctttttcctttttgtggagaacagtgcctcactatattccccaggcaggtctcaaactcctgggttcaagctatccttcccactctcccaccctaagggctgggattacaggcatgaagcatgaagcatgatggtgattttctattgccattgttccttctacatttattaattggaatcttctgtaagaggaagctgtctccctccctccttctacctccccatttgtttatttatctgggggctctttgtaaaggtgtgggtggagagtagggaaccaagagggacagtgtggttacctgaggtggggaacgataaaacaaataaataagactcatgagtatttagtttgtggcacaggctataatcaatacggttgtcactcattttgttgctcaggttgttctgggaacccctctcagcctctcctttcatcaggctcccataattattgttactgttgatcatgatttcttgtgtggtcagttgctaggtgcagatgcctggatttcaaactgggggggatgttacaaagcttaaaaagactccggagagtttgtgttctaggaaaacccaagaaacccagaactggaagagccccagagagatgaatgttaccgggcgtgttcccttctctcttccctgacgctcccctgtgcagaggatcctgcagacatggctaaaggagatgcagcaggagatcagagggtgggtggagaatgagagtgtttattcccttggctcccttcttgtcccttcactgaaggccgcctcctatgggacacactccttccaggtttgggaagtaatttccctcttgtcccttccccttacaggtgttcacagctctgccgttccccacctcaggtaaccacactgtccctcttggttccctactccccacccacacctttacaaagagcccccctgtaagtcagcactcctcagaggatcccacccgccttctgctttcctgttgggaccctgattcacacacctcgtgactgtctacgccacgtaggacacatggttatctggggtaaaggctgtacggcatccctccattgttcactctgggggttcatcacctcaaccattatgtctcagctccaaacaaaatctcctctgctttcatttaagctccttttctgttttctggcactctgtgatcaaaataaaaaaaaaagtagatgctcaaaatccttctcactgaaaactttatacggttgagaagagtcattgtcaccccctaaacttctctgtgattcctttaacctgacctcagaggactgcttttcttcccttccatcctgttccttgtttgccttcaagctggttccagatcctattattaagtaaaagggtgactctaaaacgcaaggggggatggacacccacactcaacagcagccgaggtggaagtagcccatgtccatggacagatgaatgggcaagcaaaacactgcgtttccgtgcaatgggatatcactcggccttaaaaaggaaggagagtgtgacccatgcagcaacatggatgaaccctgaggacattacgctgtgtgaaataagccaaatactgtctggttgcacttacatgacagacctggaatagtcaaatttatagagacagaaagtagaagggcagttgcgaagcctggagtgagtagggaatggggacttcttgttgaatgaatagtttatgctttgcaagggcaaagagatctggaatggatggtggtgatggttgcctaacagtatgaatgtgcttaatgccactgagctgggcactcagcagtggttaagatggtaaatttctgaggtgtattttatcacaattttttaagtgaaaaaataacatggtagacaacagaggtgacaaaatagtaaaaatatcagcacggagcttctgtgacaggtgcaatgggaactcagcttagaggccctctcctcacactgggtgcagctcagctgaatggcttagtcgggtcaagtgagaggaacggggcagggaaatgagagggatgctgaagaagaggaaatgggtgtagagcatccaggttttatagattcaggaaatgtctgcgggataaacatacaaatcacagaagatgtggttgataaagaagagctattagtcatttttagatgtttagtttatgactcagcaaccctggtcatccaaacaggatcccaggagctcaggagagtggactgaggagcagcagccagccctcctgtggacaagctctgtccaggggcccctggtaaagaacacagcgtggccgggtccttgctcatgccctggggctttgatcagccaccattctccttggaagcacaggcttggggtagggcatcattcaatgaattgacataaaactttgaacagattccatctggaaaacattaagcacaggcctgtttgcagatgtgttaacgctgactcaattgtaatacaggctttaacttctaagcagcatttcttgctagtccattgtggaatatgcctgctgttgactgcatgggcattatgtgaacaggggctgtggctgcagaattcatctttgctttggctcagacccatgtttgtgtacgtaggtgaccaaaatcacaaaactaaatgagctcagagaaagattgattggctccattgaaaatttttatctgaaactttatatttcaagagtaattggtggtgcatttgcgaagtgctggtttgggagttccgactgaagaccctgtgtgttgagcgtagaagcgggtgggcagtggtgattcagcttctccatggtccccacctttacctcgatcacactttgccctcccagccaccgcagccttcagcctcccactcccacagctggcattggcctcatgagtgccctgagaacggttctgcttgatgtgctgacttggggggcgcaccccagacaggtggggctctgggaaatgtgtgaatgaagaaaggagccagggctatgcagctctgaggggtggagggaacccaggcctgcgtgtggtaggagaggaagctggatctgtgggcctgagaagcatcaagccagtggcctgggagagtagaggctccggtgttgaggaagaacattcctggattgttacgtaatctttcacatctgtgcaccttcgctgtctcaaggagagtaaacgccctaagggaggaactgcggattacactcctttggggctgattcttccaggccacttgtcagaggagcttgtgtggtttgaatggacagataaacactctcctttaggatgtcataggccactggggtcctgcaagcaggagtgaacaaggcccgctgtggtgtcgctaacggatcccaggcaggcactgggaggtgcgtgcgacctaaggcttgagaggaacagatgctgcttcactgagcaggtctggacagcacttctcaaagtgtggtctgaagacccttggggtccttgaggtcaagacattttttcaaaatataattaactcgttatttgctccttttaaaagagctctccttgtctcatgagtgtacacgacataattgttctgacttttccagaagttacttgacatctgatgacttcattgctccgatgcccaatgaaagagtgcctgtgcatttaaacatttctcagccttaacccacatacacagaagtgctttggagacctcagtccattttgagagtgtaaaggggtgccaggaccaacaagtttgagaaccactgggctaagaccaaaatgacaacaacctgaaagacttttaagaaagatgtagaagcagacagtaattatccattctttttaatttttttttttttttttgcaggaaaaactgcatagaaaatctaatggatgaagatgagaaagacagagccaagaggtaagatgcagctgtccccctgctcagcagagctctctggcccccgggggtctgcctggcagaatctcgctggctttcactctgtgcaggtgaggccaccagcaagataggcagctgtaggacacactctctgtgacatattgcagtgctccatgagaaaccttctagagagctcactcagccctgcccctcactgtgaaatgacacattgtctaggactggctgagtggtctgggtttttgtcatgctcctgtgtacccctgttgacactggtcatctttcagggcttctggttactgcttttccaggacagacactgcttgacaagtcaggctgactggagcccagcaggcctggattcaagtcctaactcagttgctggggctctgtctggctttggataataataatgatcattgccacacagtgagcatgcagtcatcacccagcactgtgctaagcacttttgtatacatagattagctcagtttcctcggctgtagattggagatgtcatagacaccttgcgctgtggttgggtcaactaaaaatactaacttggcagctggcatgtgagagccctgataacctgtctatgttgattccttcattggacatgtattgaatgcctactagatatgcagtggaatcataacagtgacattgagagggtcaggaacagttgaatgtcatcagtttcacacgattcacccaagtcggcagttactgtgccatgctctggggaaaaaaacgtgagcaggaagctcctcagtggctcactgcaggtcattcgggtggaggcccagccacgagccttggcagcaggggacatcctctctggagacactcttcattgcaaccccactggaccagcctccttgctgtgatctcacccctttctgcctctgccactgcttgtgtgtggcagggctctccgtcctctgtgacagcctcgtgagcctgcagagctaaagggtttgcccacttcccttcacagaacccactgcttgcttgtcacctgtaaatggtagtgccctcaggtaccacccagctctgtggctgcagggcagctgtcgttccatgtcacctggagaggcagccatgagaaccacaaatccctggccacccccagacctgccagacctgagtctgcaaggcataaggggagtctgggttgttttaaactcccccaatatttcctttaaaaaaatcagggagcagaggaaatggccagaagtgtagacagaacagccttcatcccaggatctgggagatcagcactggggactcttagtactctttacttttgcatatgtttgcaaatttctgcaataaaaattcaaacaggcatcagtgcatagaactccccagcttatcctgaagtgacaagccctttacttggcattgggacccaggtgctttgcaaactgtaggtcacaacctacaagggttgcaaaatccacttgggttccaagcaacaaatgaatagactagattagaccagactagagttccttcctctgggatgttttggtttcctccagcatagctatggatggagcgctggagacagatgtgagctgcattcctggcctgccctgtgctagctgatgaattccaactgacccctcatctctcaaagcctctgttttctcacctgcaatgtaagggtagtagtgtctgtcctgctttcctcactggttattttggaaattagctacaaaatacactgagtagtgctttttaaatattcatcattacatgtgtatgaatatgcagcacactttacagtaatacatttacagggcaatcttttttgtgtgtgatggagtctcaccctgttgcctaggctggagtgtagtggcgcgatcttggctcactgcaacctccctctcccgggttcaagcgcaggccattcttattagaaatgatggaaagaacagcagtggtagccagcattcgctgggtgcccacagtactgagctaagtccttttatgtacgtcatctcatattatcttctcaacattcctttgaagtgtgtatcattcttattcccattttacaggtgagaagactaaagttcaacaaggttgagtacattgtcagagatcagaaagctctaggaagtggcagaatgagaacttcaatacagacttctttaatcttagactctattcttatccccagaccacaagaggcttttcatataagaccaaactcaatctacctggccgactagacaaagagctgcattctggcatgactaaggagttcataggagttttacttttgctgttgtcatctttaatatcaccctccaaaccccttctagtcccatccctgcctctctcctgcaccgcttacctctaaatcaggaagagataaaaatgcatgtttaggctctaccatacgcagaaatcagcaaatatagacatgccaaaaaaaatctgggctaaaagttcctagaaataaatcagtttgtatgcagtttcttttcattcattcccctccccatttgctttgggccataagcatacctcccccacccaaaaacttctctacttggaaatctttgcacagagacctgtgtagtgaggctggggcccacactcctcccttgtactcagatggaaaaaggagtttagaacgtttggtggtacccagaaatagcaaggacgcagtacccctcctaacacttgggaacacacacacacacacacacacacacacacacacccctaagatcgtattcttttcaaagtagtttttatagcagtaacatgggaggcccttcccctaatcccacctggaggcctggcatgaattgtttttactcacccattatttttgatgagattagaaatgtttaacttgagatcaaaactctcattgcctccagaaaacatgctttgtgttaggcaaggctttcgatgctttagggaattcatggtgtatttgggttgtttgatcaagtattccaaacaagggcacggttccactttcttccgtgaatttccatgtaaatccagggagtattaattgagtgtctattgtgtgttcagaactgagtgctctattcttcagggaagacgcaaaaatatagtccttgtactcaagaaggaaacagcttgattgagagatatttgtaatccctagataatgaagttcacagctttttctgtattccagttataagcatgtctttctaattctgatgtgaaacagtgttgtagggtgtgtgtgtgtgcacgtgcatgcgcgtgcatttgtggtcatccaggaagcagtgtggggtagcaggaagtgcgcagggttagaatcagacaggcctggctttgattcttgccaatgtttactgtctgtccttgggcaagtcactaaatctctcttagcctcagtttcttcttctgtcaagtggggtgataatagtagctacttattgcagaaattaaatgtagctgcgtctgatcccctggcacagtgcagtatgcagtgctgatagggaaagctaaaatttgcagagcgctcacagcctgcctggagcattttacatgcagtaattctccaagccttacaacacctcctcacaaaataggttattcttagccccattttacagttgagaaacctgaggctcagggattgcacagccagttggcagcaggcagggattcaaatgcacacatctgtttctaaagtctgggctcctaacagcgtctgtgacattcagtaaatggaagccgctccttttgagtcaccaccttcccaaggggtagagaaaataagttctgataggaattcttgctttccaaagaaagcaattatctaactttgccgtattgcaaaatccagcttactccatttcttgacagaaatgagcacctgttggctaagaagaaactgcttcatattcacctcttcctttaatccagtgttaaatgagtccatgacctcctctctccagtcagctgtgaggttgtttccatagtcccatacctttggttgagagacggagagtagaaggggagtttatggctctgctgcctttgttcatgagaatcaaaagtgtcaggtcagattcgctgattcttggggctcttaatggagtggatgctggttctgaaacatcagctaaacaattttatgattctttgaccctaattcttagtctcaatgtcaataaagtggttcagatgagagggaagagttcaaacataagcaaacaagaagcctacgcatgccattttgcagaagcagatatttcagaaggaaaaggtttagccatttggttatttcttctggtccccctggggtggaggaaaaggatagggtagtttaatgacatggaccaatgaatggctgagaccatcccatctgtatttgttgactaagtgatgtggtgagcaagtggatgttacagatgaggatacatagcattatcctgccctcagagcgctttcaggcaagttagagatgcattcatgaaaataagcataaagaaggaaaagaaaacactttctgcagagtctgttttaggccaagacaggatggagatcgaaatttgtaaactcaaccctttcagccaattgctctttcagggagagtaatgtggcaaagaagagagactgttctcgtttcatttgtaccatttctttggatataaattctgtaggtctgaaagcaaaggtctgcccagaaaggctgtagcccttttggaggactccagccccatgcacacttgcagagtgcccctgcatgcaggcacagtgcagtgagaaccccgggccctcagcattggacagtgggctgatgctcccagctggagcctgtcgtgctaattttgctgtgatttcctttcataggctttggattgggttttacttacatcatcataagctcccacacggggggaaaaaatggcagtaaaacatctctgaggcttcctctttgttttttttttttttatggttaaggcagcagcaggcattgtgagaacgcaggaggtaataggacatgcgattcgtgtatattaccttgtaatttccagatgagtgattctgttctcaaaacaaaggggaaagtagaactgtacttgcaggcagaatgctaattcttcctgtagcccagtaaacgatggaatggaaaaggggcctccctctgctgaggggcttttggcttttaccctgctagcgttctttgattggctcagaggagttgtcagagaagcgtggtgtctggcaggcttagaaacttgggaatgtcttcgttcaaggagatccagaacctctctgggggcatctgaggcaaaaggcagtttactaaagccttttcaataatttcagtaaattttaaattgaaaagagatgatcaggaatgcaccacttgaaaatgctgcctttctttagaaaaggctaaacgtttctttttagaattttggtgacaagttcctaactatcatgttccaattaaatggtgcctgtgttactgttaactaagagtcactatgaaattaggccagcttcccatttgggcccagacactttctgctaactgtggttaagagtaaagctgttctgttgcttctcgggagaatagacagcctcagctgctctcagtcacccccagacgctttgctaagtctctgcaatagttccctaagttctccatgaggtgaggatggtatcagcccttcctgctggggcaacttttctccccacacagccagatgacatcttctttttttttttttttttaagacagagactctgtctcactctgctacccaggctggagtgcaatggcgtgatctcagctcactgcaacctctgcctcctgggttcaagtgattctcctcccacagcctcccaagtagctgggattacaggcgtccaccaccatgtctggctaattttgtatttttagtagagttggggtttcaccatgttggccaggctggtcttgaactcctgacctcaagtgatccacctgtctcagcctcccataatgttgggattacaggcatgagccaccatgcccagcctaatgtcttcttcttacaccaaacttcttgagactctgagcccagtgatgcccccaaaccgcatggcctcagcatgcagggatgctgcctgggctatggaagtgaggggttgtgcacctgtctccagactctaagcctgggcacaggaggggactgcactgaccttatatggaccttgatttatgccgaagttacccaaaatgtattatggagaatattaatcccaggaaatgcccccaaaataattgcggactgtatgtttactgtttctcccttgtggagaattttagggcttctcagcacattaaagatgctaagactgcaattagcaaataaccaaaaatcatacaatcctgcatttaaaaaattatcctgaaaaataaaaacatagtggcaagaaaataacctcctctggccatggtccttcccctttcttcaagtaattcttcatgattttccacagaagacccattgaccaacactatcttaggcaatagatatgtcatctgtattcccattataattatacattttcttatatataaaaaattccaaaacaacatttgaaaaattctgaaatgtttgaagatgtgagcaaagattatttatttattgagacggagttttgctcttattgcccagactagagtgcagtggcgcaatcatggctcactgcaacctccgcttcccaggttcaagcaattctcctgcccggccacaaagatcatttagaatcataccacctggagatagccactgttaatattatagcatattctctgtcagcctttcttatacatttccattcaattttttttttttgagacagagtctagctctgttgcccaggctggagtgcagtggcacaatgtcggctcactgcaacctccacctcccgggttcaagccatcctcctgtctcagccttctgagtagctgggattacatgcatgtaccaccacgccaggctaatttttgtatttttagtggagatggggtttcaccgtgttagccaggctggtctcaaactcctggcctcaagtgatccaccagccttggcctcccaaagtgctgggattacaggtgtgagcaatggcgcccggcttccagtcagttttaataggaatgctcatagatgctctttgttaatgtgcatgaccagctctaatgtattctttaggaaagttcaccttttatggacagcactgtcttcactgagcatcgtgtgctgcagttgcctcttaaaactgtgagcacctatttggtatatttcagttctaccagaaatgtgtgttccttctacaacctcagtcgtaggcactgtggagactacaaaggaagaataaggcctagtcctgatatgccttctagaaaggttcagtttgctccatttatttatttatttatttatttatttatttatttatttattattattattttgctcagtttataaaactcagatttgagaagcctagtgctgcacccttttcagttcctgtcccatcctataatgcagaactagtgaccccaggtaagatatgccagaattccccgtctggaaggaacttgggtatcagtgtgtctttggtttaggcattaactattctgggtttctgttgctatgtaacaaaccaccccaaaatgtgagggattaaagcaatggcattcattttgctcatggatctttgactagggtagggcttggcagggagtgcctgtttcgttccaggtggtatcagccagagtagctcaaagatggtgggtagaaccccctgaagacacgctcactcccacacctttggttgatgttggctttcaaccagcatgtccactggaagtagctttccctatggagatatggcttcctcacaacacgtggttgcattcaagggcgaatgtcacggggaagctctatctcctcttagtacctggctttggaagccaaacattgtcactgctgctgctatctattcatcaggagccagcctccaagtccagcctttattcaagggaaggagaattagaacccatcttttgatgggagagcttcagagaatttaaatgctgtgtgtcagaatcaccatatcaatgtcctcactgttttttaagaggaaactgaggaacgtgtggttgggagtgccttgcttactctctcctggcttaggtgccgaacgaggatgagaactcacatcttctgaagtctgtctagtgctcatctcagccaagccaaattgtctggattctcttcttccctccacctctcttcagctcccggtgggaattgggaacatgaaaataggatgcctcatagaatgcctttagctcctcaccatagagaccctccaagggcaagaagtcactcttcagagagctgcacatctatctgcatacctatttgtacctcttgttcaaataccagctcttcttggcagcaagggagcctgctagtgctcccttcaccagttccgaacatagctttccaacttgattggaaagcatttaatttatgagctttcactccatttggtcaactgtctttgattcagagagcatcttctatattcccccatcaggatgccctatttactcagttaacagaactagacttagtggagccagtttaaaagatggcacccttgggaagaggcaccaggaaaagcatcttagtagcagggaagcctgatagacgttatggatagtttcccaatggataccagagatgcataagctgaagacattgccagccagagcagtccacatatgaaatggattaaaaggaagagcttcctaggaatgatagtttttcccccctcttttctctttttactgccttttatcctcattcctgatccagctcacagatgaggagttccgattcaatggtttttaattttttcccaagggaaacataggacttttggtgatgtataaaatgtacctgcaccactatgcatgcgttcttgtgaatttaaggaagacagagggccaaggacacaaacttgggggtgctcgatgtcattcacctgcatgctcaaagtattcttggcacagggtctctcccagcaggatgggaaatgagcatcttccttcctcctctgtgccacaggcctctcagaaggacctgatccccatcccagctacagccatgcatcttgggcagctgggtgtgaagtccagtcttgcacactaagtgtgcacacctgtatcatctcttcaccaagaaggaggggagagaagcattgagtatggtgtaaataatatgcatttgtcttatgaaatcctctcagagaagcgcctccaagattccacctgtgggagaaacccaaggggtatgggtgtgggtgtgtgtgtgacactttgccttggaaccatggccctctcctgccttgcattatgtggtgactctccttccttcagccttcctgaaataccacagacacagcccctttgtaagagtatggggctactgtgctaggactcgcttggatcctgagctgcaagtacaaccctcctctggattccagagttctagagagctacgcctgaggtgcacatctactctcagagggtagggaagcataggacagtagttttattgggttagtaaaactccatgttgatgtgcaatggcggattccttttgatgcttttttaatgttagctcattccagagtgatacactaataccaagggaagaagggcctgcccagttcgtctgtcattctctttgttctgcaagagctacccagaaatatgtttcttcaagagtctcttataattacagtccagctcaccccatacgcttttctgcaaaaggatcttattaacagcccctgccaccaggcttttatattctctgttcccaccctttgatttctatgggttttttacaaactcattaaaaaatatatgaaaagatatatgagagttttggatcttggtaagatggagttagcctactccgtcctgtccatcacactgaatgcagctgtaaagcgtgagcagaatgcatgaaacagccatttgaggaccctgaagagtaaatagtagggtgcagattggggaagcactaccaaaccagcagcgagttcaccattttttcccctgtaatatctcctagcctagactcaatgcagccccacacccagaagtgggcctctgctgacagagagaggaccaggagctctagtactggcttaaggagcaggaacaaggtctcctaatgctcagattgtgcaaggttaaatctgcccttttttgttttttatttatttccttgcatcccagaagcaatcctccaacagcagcatagcaggagcaacagtggccatcagaatccacatgaaaccttttatgcagaggaaggggaacctctctccagacagagcagctacacttccaagagggtgggatgaaaccctgctgctttcttcccccttgctctctatcttcctactgcttggccccagatgaaagcgcagatgtaggtagtatgaggaagggcaggataaatagagccagctttctggccaacggaacagaaagggagcctgggaaccagaaggtactgggcagatttcagagagggaggtgctcaggaaagtgactctataaagctggttgtgagtttctgagctcacccctgagctgaatctgcatggatctgatcttgagcagcataccatagaccctcaggtctgaacttcagaatagaccaccacccaaggtctatgactggccatgtggaacatattttagtagcactatggatttctcatcagaaaacagggaagccttctgataggggtaaaatattttttaaatgttaaaagaaaagagctattaacccagaattcaacatgcagtgaaaatatccttcaggaatgaaggtaaaatgaagattactctcaaatgaacgaaaacttcctgtcaagagacctgctctgagagaattactaaaggaagtttttcagcagaaaggaaatgacactagatagaaacttggaataggaagaataaaggaagaaaacagaaatggtaaatatttgacaaaaacagcataatctgatagggtatatttagtgtatgtatagatagtacataagacaattgcagcataaaagaggggagaaggtagagggggctatatagagaaaagtttctagattccatttgaaatgataaaatattctaagtggactttgaaaagacaagtttgtatattacagtccctagaattattactaaaagtcatacaaagaaatatggaggggaaaacaatagataaattaaaatggaatactaaaaaatgtttaaataatccaaaagaaagcaggaaaggggaaataaacaataacccaaaacaaagaatgtacaaacagaaagcatgttaaaatagaaaatgtaaatccaaacatatgtgattacattaaatgtaaattgtctaaatatgccaactaaaaaacagattttgttccaatgatttttttcagtaacctaaatacctaaatatatgctgtctacaagacattcaactcaaatatgatgctataggtagagggtaaaagtaaaactatggaaaatgatataccaaacaaacactaattaaagaaagccaaaatggttctattaatatcaaatgaaatagatttcagagcaaagaaatttactaggaataaagagtgacattacgtatgatacaggatcaattcaccaagaacagataatagctctaatatgtatacacctaaaaacaaagcttcaaagtacaggaagcacaacctgaagaagttagatgagtctttaacatgctcctcttagtaatagaactagtagagtaaacttcagcaaggatatagaagaactgaaaaatgccatcaaccaacagaatctgattggtatttatacaacattccactcagcaataacagaatacacatattttcaagtacatattgaacatttaccaagctagaccaaaccctgcttcataaaacaaatgtaaataaattcaaatgaaaaaattagaaacagaaagatagcgggaaaaatatctccacatcttggaaattaaacaacaaactgtgtagtaatccatgggtcaaagagaaagtctcaaggatattagaaaatattttagctaaataaaaatgaacatacatttcaaaattagtgggttgccgctacagcaatgcttagagggaaacttgcaacattaaatgctcttattagaaaaaaaggaaaggtctcaaatcaacaactaatctctaccttaagaaactagaaacagaaaagcaaaataaactcacagcaagaaagatggaaattagatataaacacagaaagtaataaaattagaaacagaaaaacaatatagaaaaatcaactaaactaaaaggtgattttttaaaagattggcaaggcatggtggctcatgcctgtaatcccagcaggttgagaggccaaggtaaggggatcatttgaggtcaggagttcaagaccagcctgatcaacatagtgaaacccccgtctctactaaaaatacaaaaattagccaggcgtggtggcgggcacctgtaattccagctacttgggaggctgaagcaggagaatcacttgaacctgggaggtggaggttgcagtgagccgagatcgtgccattgcacttcagcctgggtgacaagagcgaaactccatctaaaaaaataataaaaataataaaagttcaataaaattggtaagtctatcaagggactgaaaaagacacgatttatcaatagcaggaataagaaggcctatcattagatattcctgagaaattcaaagggccataaggaaatactatgaacaattagagccgcataaaatccaaccacttagatgaaatgggccaattacttaaaaaccacgactaccaaactcacaaaagatgaacgagaaaacctagagtcctataactaagaaattgaatttgtatttgaaaacctgaacaggaaatctccagacccagatgatttcactggtgaattctgccagacattaaaagaagaaatatcaccaattctgttcacactcttccagaaagttgaagataaggaaatactttggagtttattttatgagaccagcattacccaaagacagtatgagaaaggaaatctacagaacagcatttttcataagtgtagatacaaaatttctcaacaaaacattagcaaattatatccaactatatatatttatatatattttaaattacaatcaagtggagcttatctagggaatgcaaggctattcagaattcaaaaatcaatgtaatccgttatgttatgaagttacaaaagaaaaaccacatgattatatcaattgatgcagaaaaagactttggcaaaatgcaacatctattcatgaaataaaaatcaatactgaaattataaatctaaatgtaaaatacgtaaaactgtaaaaccataagaagaaaaaatagaaagtctttgtagtctataaggttaggcaaagagttcctagacctaacaccaaaagtacaactcgtaagagaaaaaattgttaaacctggacctcatcaaaattaaaaactcactctgtaagttactattaagagattgaaaaggcaagctatagtcgggtagaaaatactgacaaatcacatttctgacaaaagacttgtatccagaaaatacaagcaactgtcaaaactcaatagtaaggaaatagacaacccaattttaaaatgggcaaaagatatgaacagatgcttcctcaaagagggtctacagatgtcaaaaaaagtgaaaagatgtccactgccattagccattagatacatgcaaattaaacctctaataatgtaccaccgcaactttcttagattagctaaaatttaaagtactgacaatattaattccctttaaggttgtagaacgctggatcactcatacattgctggtagggaggtaaaatggcatggccactctggaaaacggtttggtagtttcttataaacatatagtttccatatgacccagacgttctagtcctggattctttacttcagaaaaatacaaacacgttcactgaaaaacctgtacaccaatgggcatagtagctgtattcataattacccaaactggaaacaacccacatttcctcaatgggtgaatgcataaaccggctgtggaacacccgtacagtagaaaactactcaccaatgagaaggcacacggtattgacagacacaagttgaataaatctcaaaggcattatgctgggtagaagcagccaggctcaaaaggttacatgctataggattatacttttacgacattcttgaaaagagcatagggatggagaacagaaccgagctggccagagttttgtgggagtggagggcatgagagttttgtagagagctctctctcgtcttgatggtgatgacggttgcatacctttatacatgtgctaaaacgtatagaaccgtgtccccgaagaaaaagtcaggctcactgtgtgttaattttaaggggaaaaaaaacaaaaacaaaaacaaaaaaacgttttaaagcacccaccgtcagcgtcactttttcgaggctaatgaagtttgactgagccttgcttggctctttccctacatcccccgctgggggcggtagggagcagcagcgccgtgctgtgctttggggtggaggagcctcacggacccttcctgtctctactcacttcccctttaagttgggtccctcatcctttcctgaggacccatttcatttcctttccctgtccccactcatccaaaagctcagaccaggttgcttggcctaccattcacgactgcgccgtcggtctccccgtgcctccccaccctatcctttccttctccaattgagcccaactctgctgccaaacttgaccacccagctttcccctgggctgtcctctccacccctgactatgcacccctcaaagccacctcatgttcttgcctctaggggctccgtggctgggctccctccttggtgagcacccttggcgattcgttggaacttctcaccgggcagtattgtattgcaccccctataccagcttctgaggaatgagttccatctcttcctctagacactgagctgcttttagttgagggccaagacctcttcattgccgcctcctccatatcgcttgatggagcgccttgtgcacagaaggtgctaatcagagaatatagaacaaatactcttcctgtctctaattgcccttgtccagagaaccctcaagtcagaagtggaagagggtcctcctgtcaaagggggagggagtggggagatgttagtcaaagggtagaaagcttcagttagacaggaggaatcaggttttgagatctatcacacagcagggtgactgtagttaataataacgtacagtgttgtatatttcaaaattgcaaggagagtaaatgtcaaatgtctcaccacaaataagtgaagtgactgatatggtaattagcttaatttaatcattccatgttgtatatatatatatcaaaacatcacattgtaccccataaacatgtacagtttttaagggtactggaaggtaacctgtgccccacttccctggaggtctgtctgtattgcatttaataactggatgtttgagttccacccatgagtgcctttctgctcaatcccctactatgtgtatccagatagactagttgggctatgtggcccacaatccccatatctcagtaaagctgacgtgctcatcacagagctgctggccccttactataaagtgtcctcacccaaggacccaggctgacagaggcttcacctcccattgccaagggaggtgaatggaaaaaggaatgaaacagattttgcactgactcttcatgcttctccctgggaactgacacatggcacttgtgcgtacgtgttcttggccaagcgaaggggcagggaagcacaatcctgctctctccagaagacaaactggaaatatttggtgaacagcaatcctaacaccacaggtgaccacgacagtgggaaaggccactcctcctaggagctgaagcgaaggtcgcagtcttcccttgatttcccgcagtacccttccccaacggggaacacaaacaccagcctcctgttagtgtgtggcactgtttctctgcacggtgtgcttagtttttgtgctataaactcaagcagccagaattagtcactctcagttctgtgttcccagaacactgggtccgtaggtccataacagatcccgccacagtgatttggagggagctgtaggaagtggcaggagggtgcacggcctcacagcgtgggcactggagccagcctgtggcaccacttcccagacctgtgatggtggtgagttacacagcctctcagtgcctcgctccttccccttggaatggaaatgcaatagtacctgccttaaagggttgccatgagaattgaaggaatgaatggatgtaaagctcttaacatggtgcccgttacatacatagtaagtgcccagcaaatattccttgtgtaaccagacccaaactccccaagatgcccgatgatggacgcttcagaaccagataacttggggtttttgagccccacattcaaaaatcaatatccatgtatatttaaaacacacacataccttcccttcctccctcccttggtctctctcttactctctctttcttaaactcaataagatgatgacaaacagcccaactggaaaataggcagaagatttgaacaaacgcctcacaaaataagatacataaatggccattaagcatgtaaaaagatgttcgacattactagtcactaggaaaatgcaaatccaagccgcagtaaggtaacatttcaacggctaaacatttcaatgcactgtatgtcagtgcagccgtgtcttatcaggttaaacatacgcttagcagatgacccagcaattccatgcctctgtattcacccaagagaaatgaatgcctatatctacacacagatctgtacatgagtgttcagaacggcattattcttattacccctgaactggaaatgaaccagatgttgtggcatattcatacacaggaatgctagtcatcaggaaaaaggaatggggtgttaatatgtgcagcaacatgatgcaactcaaaaatgtcatgctaaatcaaaaagactgtatactctgattccaggtctgttaaattctagaccaggtgaaactacactaccagcagatcagtggttggttgcctgtggctatggctgggggtgggcggatcaatcacaaagacacaggagaaacctctttaggatgaaggaactgttgtttatcttgattttggtggtagttacccaactaatacaccaaactatgcactaaaatggatgaattttattgaatttaaaaaatgccttataactccaaagcctggccaggcatggtggctcatgcctgtaatcccagcacatttgtggaggccgaggctggtggatcacctgaggtcaggagttcgagaccagcctggtcaacatggtgaaaccctgtctctcctaaaaaatacaaaaattagccgggtgtggtggtgcatgcctgtaatcccagcttcttgggacgctgaggcaggagaatcccttgaacccgggaggtggaggttgtagtgagctgagatcgcgtcactgcactccagcctgggcaacaagagtgagactctgtctcaaaaacaaaaacccaaagcctggttgttggggttgttggagtgtctttcaaaaccttcgtcccagtgtctgtgtgtggtggtctcggggcctgccgagaggaccttctttttggaaataaggtcattccaggctcattttctttctcttgcctgatagcagtggaaccagctgacagcgaccagtttccagtggacaccacagtgtgtcccagccggaggcggatggaaacaagcttgtgtctctgtcactaacgataggagccttcgtcggagttgctaccaggccatgttggtcgtcattacacccattgaagacgagaacagagcagtaatgagctgggtgttatcagctcacaaataatttataatgggcaaactaggacaggaacagagctttttttggctaaggaggttgcatgtcactctttaaaatctaggccaaaaaattatttataatgcatagacattcactctgaaagttaaaggattcctttcttctctcccatgtgtttgaacatggtcttttagcctggactagcaacaagactccgcaacatcttgctgccacgcctgcagttagtgtgtgatgtgagagagtgcaggtaaagagagtggctcggcgagggacagggcctttgtagaaggccaagaacagacagggaggaggggagaggcaggaaaagacccctaggtaaagggtagtgaccacacacgttagctgagctttgaagaattgcccaaatgttatcaggaaacagcctaaactgagataggaccggtaaaagatgggttgtgaacatgtgtgttgaaataaaggcaggttgtgtgcaattaggcaggggcaaactgagtggttatggtcctcgtgatgtctagggaaagggttttggaaatacgtccttttgtgtccaagggctgtttattgatactgttacctatagatacttacacctgctccaagggaggtgaatcagaatccagcagcacactctgtcctgaccacacattggccaggagcctcctggtgaaggatttgctcccctgagaaccatgaccccgggcccaaggtgcctggaaaagcagcaatgttttatgggcctggcctctggggcccctgttctctctcagagagttgacttctggaacaagtctgtcttcagtgaactggggaggagtgagccagctttctcagccctggatcaccttcaaatacgtggattgttgatgaagggcctgtggcgtgtcattgaagatggaggcccctcgagtagcactgcttccggacttttcaggagggctttttgcatcacgtgttccttgttcgttgttaattagagcattcctgagagccacgattccctactcaagttcctgaggatctcagggtcctcagaggtgcttgggtggcttgggggaggcccctcctctctaaccaagcagcttccctttgatctctcctataagtgtgcagcacagggtgtcacttatttaaaatagactttattttttggagcatttttaggctcacagacaaactgagtgaaagacacagagcgttcccatatccccctgagccctccctagacacactcagcctcccccattatcagcatcccccaccagagtggtgcattagttatagctgataagcttacactgatacattgttaccattcagagttaacatcaaggcacactcttgtgttgtacattctccaagtctagacaaatgtgttgacacacatccaccagtatggtgtcatacagagtggattcactgccctaaaaatcctctgttcatccctcctaacccctagcaaccactgatctttgtgctgtctctgtagttttgcattttccagaatgtcatatacttgctatcatacagtgtgtagctttttcagactggcttctccaacttagtaatatgtgtttaactttcctccatgtcattttaaaaagtgttcgtctgctcttagcagcttgacagccatggtgcagtacctgtcatacctctgccctgggtctgtacagccctggctgttgtaggcagggtgtgtcttgcctcccccaacagggcgatgagctctttggagcaggggccaggacatatgcactggtggcacacgggatacctggccaccccgtgggccctggaaccaggctgggtgttctggattgaaggggacttggtttgagtcttaggaagggctctccgagcacagccatctcagtcagcagtgtgtcctttgctctctgaaagtgaaagctctatgagatccgaatgagcagcatccggcctcagagctaatctgtcagattttgcgtctgagtcagaacttactggttattaatgctgtctgtctttgtggccaagagtctagcaaaacattttctatcctcctgccttggaaatgtggccagcgtgaccttcctgaaagagttttttgataagatagatgatcacaatagaatgtgctctaatagaaagtgcttttgtttcatcacaaagcctttgtgacgtggaatgttccagtaacctgctcgttttgtgtttacagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatggtaaaggtcacccttctctctgttttttttccaccctgccccgtccatgtggtgatgacttcaccaatctgggctgcctggttggttttgtctccccagccaggcccagccttaccggtcgagggcttcccattgtaaagacactccaccctctatcagcccgtctctggctgggtggggagagggcacacacctcccaattgcattataagccagacgagagaatccaaaacaacctcacaggtagcacccagccgaagcagcgtggcattcacagtgacaacatcttgatcaaaaatccctggaacaagtgtcttttattcaatgctgaacagatgcagtggctgaatactcacttcctgtgggatcagactatgtgggccttttcatccctctctgccactgccctcgaactctttggtcttttgcgctacatcatgaaaaaatacattgaaaagaatttattttcttaatgtcacattcattctgtttttattgagatataatgtttataccataaaattcaccattttaaagtgtagagtgcagtggtcttcagtatattcacaaggtggtgtaaccatcaccactctctaatttcatcatgccaaaaaagaaaccctgtatccattagccatcatttcccattcttccccctccctccagatcctggcaaccacgaatctgttttctgtctccatcaattcccctattctaggcattttatacaagtagaatcatacggtatgtggtctttttgtatctggcttctttcacgtagcatctgtgttttagcatgtgtgagtacttcattccgtttcatggaccaacaatattccattgtatggatatattaatatcatattttgattaaccattcatcagttgatggatatttgggttgtttacaatttttggaaattatgaatgatgctgctgtgaacattcatgtacaaatttttgagttgatatatgttttcacttcttttgtttgtattcctaggaggggaattgctgcattaaatggtagtgtttagctttctgaggaactgccaaactgttttccaaggtggcttgtacctatttatattcccagcagcaatgtatgagggttccaatttctccacatccttggcaacacttattactgtcttcttttattatgactattattaatataatctccctagtgggtatgaagtgatatcttatgtgactttgatttgaatttcccaataactgatcatgttttccttttcgtgatcttttcatgtacttattggctatttgtgtatcttctttggagagatgtccaaatccatggcccctttttaaatcattgatttttctttttatgctggagtggtaagagttctccatgtattctagatactagacccttatctggtatagaattcgaaaatatcttcccccattctgtggattgtctttttacttttcaagtgatactctttgacacacgaaggttttaaattttaatcagttaatgtcaaatttatttttttcttttgactacttgtgcttgaggcattctatctaagaaatcattgcctaatctaaggtaatgaagatttatatctatgttttcttctaaaaggtttataaccttttttctttttttctttctttttttttttttttttgagacagtcttgttctgtcaccaagactggagtgcagcggcgtgatctaggctcactgcaagctccgcctccagggttcacaccattctcctgcctcagcctcctgagtagctgggactagaggtgccaccacacccggctaattttttctatttttagtagagaaggggtttcaccatgttagccaggatagtctcaatctcctgacctcgtgattcacccgccccggcctcccaaagtgctgggattgcaggtgtgagccaccacgcccagcctaaaaggtttataattttaaactgtaggttaagcatagatatttgatccattttgtgttcgtttttgtagatgtcgtaaggtgggctatgaaaattcatccttttgcatgtggatttccagttatcctggcactccattctttttctaactttgtaatactttataaaagtaacacatacagagaatatacaaatcataactgtacagttgaattaattatcacaaagcagacacagccagggaaccaacgacccaggtcaagaaatagaagctccttcctgtcttcctctgctttcccaaaagaaggaacctctgtgctgacttctaaccccataggttgcttttgcctgttggaaccttattcagatggaaccatgaattatacacatgatgtttatgagattcctcccattcttcccatgctattgctagttccctttcattagtgtatagtattccatcacacgatcacctgcatatgccacttgaactcatccttgagctcacatctttctcaaatcattctctctcccttttcctctccttcaaacacttttacctgttagtgtgtggtcacacctaccctgccagtcacccaggatgttacaaaaagtcacagaatagttaagagggctcagaacctattagcaagcaggaagagcagaattcttttttctttaatcatgacaccaaacataataagtcagaaatgtcagaattagtgaggaaataattacagttcttccatgcaggcagtgatgtgtctcttccactgaacattttcctagacaagatgatttcataaaagagggtgcggctgggacatcagaaagtttcattatacttcttagtcttttattatttctttgatgatcatatatacctattaaaaatgtgacagtgatgatatatcctcatattattttttccaaagctgcccaggagagagtaaagaacatgttaattgcttttgttaaaagtcaggaaagaccaatcaagcaggattggaacgaagtgttacagcagtatttgattgccctgataatttaatcaaatggttatatttcctaaataatgatttagccaagtgaaatagcaggttggtttgattgccaagatattttgtgcaaattactcaaactaggtcattgccaccgagaagcaggacagctgttaaataggacagctgggatcaagttcatcagcctgacatttatgccgggctctgtccactgtggaattacagaattgtcaaatctgggccctggaaaggataagtcagcagaaatgcagcctccaaataccgggagagcctgcttcagctcgcctttttcataagatgaaggcctactccgcacaacctgcttaaacacaatgaggatcatgccaggatctcactcatctctgtgatttcatattcaaaataaagcagaaaattcatggtacgttttttggggaagtagagttgttggagcaaaacttggattaaagcaaaaaacaaagcaatcactttcctttacttgcagtccaaatggacatgaactctgcaggcacctgcaacagagtagagaatactgaccgtaagcatctgttcagggcttgctatgagctgggcaatattctaagagctctacctacaggaactcctctacatagagctcctcttcatggcagcactttcttttgggagacagagtcttggtctgtcacccaggctagagtgcagtggtgcaatttcagcttactgcagcctccacctcccaggttcaagcgattctcctgccttagcttcccaagtagctgggattgcagacacgtgccaccacacctggctaattttttgtatttttagtgaagacggggttttgccactttggctagcctggtctcgaactcctggcctcaagtgatctgcccaccttggcctcccaaagtgctgggatcacagacgtgagccactgcacccggcccatggcagcactttgagttagttccattgcacagatgagacacacaaggtcaagtcactcatccaagtcagacagccaggaaaatgtggaatctaagcccagcagcctgtctccagagcccaaccttttagcactacactcaatggctgctccacaaggggtgatctacagggcttcttgtggctatttatatcacagctgcactccagctgttcatgagtgtgtccatttagactgctggttctcaaccttgtgtgcacatttgaatcacctgaagagcttttgaaaaatacatattaccaggtaaccccccacagaccaatatgtcatgatctctaggggtgggaccacaatgggataccagcttgcaagagaagattgttcacttttcaggagttttgcaagccagttgacatcaagttggtagcttgaaatcagccatggtaggcgtatttacaccacagaaaggggcaaacactgcaaatcagggctgtttgttgtagagggtggagagcctttcaccagcagatggctaggtaaggcccaggcatcagcatttttaaggcccccaggtgattccggtgtgcagtgagggttaagaactatgaatttcaacatgcttcctgccgtcatgctaaagggagatcacatgataagtaaggaaagatgattaggtccaagtagttattatttagctctttccccaataatctttcagcattgctattttctcagcttcggaaatgaattttaatcctgaactgtacacttattctctctgaagtaatccaaatcaaaatgagaatctgatcatgattctttgtagcaaaattttgtaacagtagctattataagagagaaatccctaaagtctgtaaatagcaggacatattggacatccttatctacatccatctagatgttctagtgggtcaggctggcctacacattatcctcttcctgagtgagtctaaatgaaattttctcctaacattaaatcccattcctcattcacacttctttaatgtgtctgtcttcatggatggaagatgaggtggggagagctgtagaacaaggagaaatttccctattgaacagggtaatatatacccaggacagctgtggaatttctgctccattttccaggcttttatttgaccacatacatcccaaacatatactgcttattattcagatataccaggagcagtcgggagttgagcactctaggaaatgggtacaagtgatatcagagtagaatttggggggttggctcttaatcacaatgttttcctacaaaaatggctctcaggtggttttgtttcccttgaaatttggaaaccacttttaccataacactgaattttacttcccagtgtaacattttttcctcgattcgagacatcgtatctaacatatttttttaatatgctatgaaatgaaccttaacttccaaggagtctaattcagttgttgaaatacaaagtgaatgagatggctgctttcagtgttattatgctagcgttaacaaaatacccagtcatacagaatgatctaaaaattacttaagttaaagaaatgggtatttcattttccttcaccattaagttgaatggatctctatttaaatgaaatttgggctgccataaagactcttctgctagaaaaacagttagtctatagtttgatcctagtggtcaaaagagtctcacagatgagtgtgcatattggggagaagaggaaaggcatttatggggttaaatattatagcacatcttcagtccctctcttttctaagtggtcgaactgtggcaaccatctgtttgaagaactgggagttgcaccctctcttccttgcctcagccagcaccacagaatggattctggcccacgatgtgcatgtagcacctgcctctgcttcccatgctgcattccaccatgtgcatatgaggcccgacactggacgtttccccacagcgcggccctccctccaggggccctctcagtgtcgttggctgcctgaccatcagcacggtttcctctcctgggtttcttctcctgggtttcttccagtgttctattaccaaaggctcatagcagctcttttctgcccctttaaactcacaaagacaaaaatccaattttgtataacagcagcagcaactcgttctttctgacatctcgaaggaaggagtcttcctggtggagacgagcactgctgggaacattgggttttggaacaagtggaggttcacagggtgatgcgcataactcagctctttttttttttttttttttttgacatggagtcttgctctgtcacccaggctggagtgtggtggtgcgatcttggctcactgcaagctctgcctcctggatttatgccattctcctgcctcagcctcctgaggagctgggactacaggagcccaccaccactcccggctaatattttgtatttttagtagagacggggtttcaccattagccaggatggtctcgatctcctgacctcgtgatctgcccatctcggcctcccaaactgctgggattacaggcgtgagccaccgcgcccggccataactcagctctttacatcttttgttcatgagtagctgctgcattcactaagattcattcattcaaatggcagaatgcattcctcatgcgccacgtaagagagattatcaaaaacacaggcacaaaggagagagccttgaaatctttctcctggcttaaagttgatggattatctgcctggaccatatgcattctccaggaagttgttaaacaggttagttttattctctgagctatgagtcttatgttcttacatttttcctagcaccaaggaaataatctctgaagaaacctcttactacatgaaatggagcaaaatgttggcttaagatggaggataaactgaaggaaaaacaaacatatttgatattacatttgagccacctataattatcttatcagaaataattcaataatagaacaaaacattctttaaaaatgcagaagaactaaaatatttaaggagccccttgtaggccaatgactatttgaatttacaaatcggcataatgtcttcagtacaaggcagttctgtgaaatggataaactatagattaaccccaaaaagttttgagaagagtacattatgtgtatgtgtatagcacgctgtatttcagtaatggaaatgctgaaaaatatggtacattctgtataacacagtgggttattttccacacgcctaaggtgtttctggaatttttaaaatcccaggtctgtgaagtgttttgcttcacctgggccatgaagaagccacttatgaaggtgtcacaccatcccagtgtttgttcctattgccttcataggtggtaactacctaattccaactgttgacgatggagttcgtcatgtagacattcagggccatggtaccacctgcaagggcaggcaccacagccatagagaaggtgggggatgcacctccctaaagcctcattaagggagatgagaacatccgaagctcccagtccttggaaatcagggtaacatatttccttctgctggcttcttaaattaaactacacagaagtttacacaaaattacatagaagtaacatgtgcttcatttgttaattccaatttctaggtgccattgaatataaaggcttatttgtgtctcttttctagaagtctcagcgcaaacggaaatctgtgacattcagcaagactggaagccttcattcctcagtaatgaagaattcacccagctgatgttggaggtgaaatgcactttcaaaatagcttaaacagttgccagttaaaatgtagctacttgttgcagataagtccctgtacccaaaggaaactactgttcttgatcctgggaagacttgactttgaaacagatacctccctgaggctctctgcctgctgttgcctatgggccatgtcaagaagaatcccaaaattgaatgtggtcacgtgttttcactacagtgaccacaggatgagccccttgatggtgtcacaaccagaggacaccttgctggggagccaggaagggtgggttcgaggtaggtagagagaggagaaggacagagggaagatgaatcagcttgcactgtcatttgactcagagagtcttctcttagactgctatgattatacattttttcccttagtagaaacacgttttgaaattaaaaattgtctttttaagatatgctttgaacttgaactcatgttacatccacatggcatacagatatcagccacagggatcccgtgcctccccatccagctcatgtcctttctgtgctgagtgagatgctcatgttcctccctctgggtcagaggccccatactcatctacagggccgtatttgtgaaaacctggctgatctaaatgagtccctttcctcaacatcatgtatttgtatatgggtgaaactcctcaatgcagataagcataagcctctacagaaacaactgccaacgtgctgtggcttctcacctggagataagttttggagtatatggatatggcagtgggtcagagaaagctccaggcatgacatatccacgcccgcaaccaagaggaggcaaactgggacagatgagctcagcaaaaggaagttagacgctggctgtgaccagtggttcctggcagggtgtttggagagtggtttctggggataaatctttctatctcatatcttatgtgcctatataagactgatgtaaacttcaatttacatagattaacttgcagaaaacagaaagtactggagtaagaaaatgccagaatgaagatgtccaaatattatgaaatgtaaacgcattaatgaacatttgcataagatgaaagatacttaaatctacatgtgaactatatttaaagaaaatacagaactttctgcagaagcaatgcatttttaagtatgttaaatttaaagcagcttgtgaaatgttgaattaatgtatcattatgctaatttacataaatcgatttatcttttaattcttatggaaaagtagttaaaacacataaccctatagcagcagcctttttttaagagcctgtagcacaaccttttttttttttcccagttagtttcaaactatcaaaagtatttgaggaaatagggcttttgtaaagttaaaaatgaataaatttcggggctagaagacgggactgagattcaggagactggaatttctagacaaggaagattgatatttgtatagtctttatgcactttcccttgctcccggtgtagactcctagaagccggtggaaaggaaatcatgctagatgaatgaattggatctgaaattaagcctgcacaaccagcaggccttctgggtgaatggcagctgtgagtggtctggaaagtccaccaactagtactgttgaccctgactgtgtcaggcttctcttccaacctgttgctcttcagtagacacagacctagtgctgagtgactggagccttctagcatctcctccctggtggcctgagccccagctgtggttgggggagatggggagctcccacggtgatgtcaccattgtccagtgcaaccttcccatagcatgggtctctctccagctgcccatctctctgttttttttcagagccatttcagagactgtgaagaatccaggtgccatgtcttagtggccaggatgttccctttctaaaatgaggacagagcccaggagataacccatcatgtccctagggaactgctaatgccctccagatgtgactcccgtcttcttccctcttctctctaagaggcacaaaaccagactccaggaggactcacatagctgtgaagtttgaaaaaacaaaattgacctggctgaaaaaacaaaattgacctggctgcagaccagccaagctggtaaagtatcagctggcaaagactgtggctaccagcattggagcagttgcactcaaaaggagccaaagtgcctgtggcctgcggaatagggagcttgtggaatttctgaattttaatcagaaaagcaatctcttctcttagcccagaggttgtcccaaggaacacaagaaatgttccatctgattcaggaatttgcagaaagggaaggtttcgtttccctctaatgtgtggcggttagaaaattctgggccattatggcacctttggaaacaccccagtcaaaatcaccattccatggataggggcacagcactttgcaatcacttgctgttgaatccctttcagatgctactgatgggacttccagaaccacagccagctttcttaaagcaatgactcagtgcagttctcatagagttgatggaaatgccaatgagctgatgaaagttatctcccgtctataaataccttcagctttttaacacccgcttgctttagacattcaggagggacatgggctcactgtgcaagacgatttgcactgcccttgcttttcccagctttccaatctgctttttccagaaaagtctcactgatgtcatcaacagtgcccttaccccttaaaaaaattcacctcctagagggcttcatagatgactttaaaacatttttagaaaaatacctgggaaggaaaagttactgggatgtacttcttcgtttactgtaactcaaatctaacccagcatttctcaatcttgcactatggtcattttggacctggtagttcttcgttgtggggactctcctgcatattacaggatgtttggcagcactagatgccaaagtcacccactccagtggtgacaatcaaaaatgcctccagacattaccaaaattgcccccagttgagaaccactgatgtcatccaagaggacgaggtccatttaagaaacgtacttgaatctgtttttcagtctaaatcctaccagctgtcggtgtaaaataataaatgagtctagtgttaattttcctggtgaaaagaactctttcccctttcggcatggtataaaggtgcccttcatgcactgctcgtggcctcttccgggttcccgctgccatgcacttcagccacaccctcctaatgtgaaagaatgaattgtccacacagattctcagacatcacgtgaccatctagttgagtgcatgcaacatgtttccagagctttctaagcacatatttcactttttttcctaagcagaaaaatgtccagattcggggaagatagtcaaagaaaaagtcagtgaaccgacagtgacaggtttccagtaaaagtctccctgagctattattcccttaaagacttgctttctggagaggtaggcttcatttctagtctcctccccctcactggcacaccctagacagccagttgccactgtgatcctattctctgctgaattatgtcgtctttattttagaaatcaactatcagatacatattgtgaaagcactgcaagcatccacacaaaaataaatcccaataaacaatctaaaaccagcaaaagtggctgggtgcagtggctcacacctgtaatcccagcactttgggaggctgaggcagatggatcacttgaggacaggagttcaagaccagcctggccaataatggtgaaaccctgtctctactaaaaatacaaaaattagctgggcctggtggcatgtgcctgtaatcccagctactcgggacactgaagcaggagaatcgcttgaacctgggaagcagaggtggcagtgagccgagatcatgccactgcactccagcctgggtgacagtgagactccatctcaaaaaaaaaaaaaaaaaaaaaaccatgagcaaaagtgtctgctttatgagaaagcattgcccaccttcaacctattatatcacaagcacccaggacagtgtgcccagcatagagtaggcactcagtagagactttcaaatgcatggatttttcagacattctgaaatgcttacggatccagttgagttacgcaacccccacacccacccagccctgtagagtaatgtgaatgttctttacaaacagttccttcagtgggcatttctcttgtggcaatgaatgtgagcagaggcctgccttggccaacaggcacactttctgtttttaatgcatctgttaggtctgatacctttatcagggcaaatgtttaccattgaactcaaagtgatggcaggggtagggagatgggaaccataaactatggctgatgttttctaatggcaagggtggtatttctgaatcaggctaataatatgcttatcattaaacctacttagggaatttccatggctaaatgttatttgattatgccactaggtcacatttttcactgatcctgtagtgcttttgcaaacacttttcctgggccagacacattttctgtaagaagctgtcctccgtggaaggccaagaagtgccgtgaggttattcatggaaatattctgaggattataaaacaaagccagtgtcctaaaatagtgtcctctgcatcagtgacatgctcctccataaacgcattgctaaggagctttcaaatgttgcattttccacaggcattagatggcttcattatcgcagtgacaacagacggcagcatcatctatgtctctgacagtatcacgcctctccttgggcatttaccggtgagtttccactccaatggcctttaccggttcacgttaccatgtttctgttgagaatcattagatctcagatggaaggtggtgcaggtgtcagggggctgcaggtgagaagagggcggagagtaaaggactgctgagttttggggacaggaccaggccgaggtcaaggtcccaggagccttccaggaaaagggcagatgcaggcgtgtgccatcctggaacaggcaaggcctggagtgggagctgtggctacagattctttttctgggtcagaaatggggactgatgagagagtcacagcactgttagtggagctcagagccatcatggaggctgacagacatccagggtcacctgacagctgatcaagggagaggacaacagatggcttgggttgaaacacggtttggggcttacttgggacatgtctgaggttgcaagtgggtagcaacacttagtggtggtaagggtttggcagcagggccggttcctgggggttgaactgctctgggaagactgatgtcttggaagaccttggggagtgaggagtgtctgggtggaccaggagagggtcggctttgcattccagaagtgcacgatggaagctccaaggtggcagaaggggctgtggtatggtcacaggccctgacagatgtccctccccactctttccctccgttccttcccttcttattccctcctccctccctccctccttccctccctcccccctttcctccctccctccctccctcctctctgcataagccttgctggctctctggtaacccccaacacaggatgaagtgactcatgggtctgcacctggctggtggaggacccaccgttgaggctccctcatgggcatctggccaggcttccatctcctgccacaccattgcctgttcctgttcctaggcggcagcttcgatctgcacacagcatcattgtgaatgacagctgtaccaggagcagcacgtgtgatggacaagaaaaaaacgtcctctctccgctctcctcccagtgagcccagccaaaaccttccccaccacccccgacccctgctcatccatggataggtggccagtttatgtgatgaaaagaggaaggcttgccctggattcacacataggaaagcttgggccaggatgatgctggaggaccgcggttccctctccttagctgcccctgcccagggaacagcgtggccttgttccatgggcagcttccatctgccttggggtgatgagcccagctctgctgatggcccagggctccacatcatcctgggtcatacctttccctggaagccactcccttatcccaccattagtgcaaatgatgctgtgtgcagatcgaagccgctgcctacatttttctttgcattcgctgagcggtggcccacaaaagcattttttatgttgctaagcagatgccttcccagtaggccctaatctaacctaatctgtctcccctttgtgttccagcccatttcctaaaacgagggtgcatcaggctggtggtggggagctggggggctctctcctcttgatagccatcagaagtggctcatcctcactcggcctgaaggaggaagctgagggtgcagctgcaccttgattttcatctctggccaggaagctagtgatggggctgacaccatgaatacagaagtgatccccatcatcaccccagagaagctgggctgatctgagggtgtctgaggacagaagaggagctggggtattctttggagggcgcttgtgttttgtattgaatggcaagggctcggcagtggtaggcactgaccgaaagcaaccacacgtggcctgcttattgacctgggaatgagagacaggagccagaactgtttgggtaaacaggatttgcactgttctgctttatgctcttgtaattatctgatgacccagttgctgtacgtggcagacgggacttagaaagtaagagggaaattcttctgacttgaaattatggagcaatttaggaccactttcataaattattttctaactctacaagggccagaaatgacccgactctaatttatcaatgctggacccacttgaatgcaaactaagactctgtatatatatacccatgcccagacacatacagtgagtcagccctcaactccctggtgcaggtgagcctgggccaggcagtccccaaatttaactgcaatttactttcagctttcattatccagttttcaccaggatcttcctttgcaagtgggtaggcaaaggctgctgaggatggaaacttccctggtgcaatcagcatacagctggttgggcagaggagcggatctgggagtcagacctctatgacttccactatggggaggaagccccaatggcccaggcagtgagaggcacagtggggcttaccccaggggtagctgactgcagaacccaggctggtcaccagtctgctctggtgtctttctggtgcccaggatttgggtcataatttaggaattctgattttggtttggtttacttagatgcatacttaactattaaatatcactccttgtgagcccaggtcctttccacagatgatgcaacatttcaaaacttgtgaggttgtctttccttttgcaattttgttgagagattttacccattaaaccttgggtgactaacactgagcacttacaatgtagcaggcaccattaagagtcactcacatgcgttaatatgtgtaggcgcatagaaccgtgcctggcccagagcgaggctgttttatatttgctctccttatccttatggatcctatgaagtacatagttacccagttcacagatgatgaaactgaggcacagagagattgaataatttacccaaggttccacagccagacagtgaagagctgggatttgaactcaggcactttggctccagagcttggtgcttaaccactcctcagaatcctatacgggacacagtaaagctgaatgttctcagagtgtggggctcagaaagggagaatgaggagctgagaggtggtggtcgctcctcgaggaagaggcggctcttgaggtggaggtcgggacacagggtagtcagggggcaggaggctgtgggccccagcagcaacgcccctcttggtgtcaggccaagcacaggctggcctgctggggtcccctcccatgccccttgtgtgactggggattggagagccattgtaagggggatgagagcagccagaattccttcccacttctcaggctgtggggcttcaagtctctctctgtttccttcacactgccaacatctcagatgtaacagaagctcatgtgatagattttcgtacagcaatttctgatgaaatagcctagaactttctttaccaaattggcagagaaaaaagagaataaaatagctgaaagtgaaagtgattttaagatgagaactggcaggcgcggtggctcacgcctgtaatctctgcactttgggagactgagctgggtggatcacttgaggtcaggagtccaagactagcctaggtaactcagcaacacccgtctctacaaaaaatccaaaaattggtcaggtgtggtggcgcatgcctgtagtcttagctacttgagaggctgaggtgggagaatcgcttgagcctgggaggaggaggttgcagtgagccaagatcacgccactgcacctcagccagggtgacagagtgagacctggctcaaaaaaaaaataacaataataatgagaattgttcagcagtggcagcaccagcacattttggtgtctagaattgacacaggcaaggaacatgagcaagacagacgtgcatacaatggaggccaagggctcacgggagcctctggaatgaaaaccttgcgggagagatccaaggggcatgagtcacgtgccttggacagaatggggaaagagtacggctgaggcagaaccaaatgagagaccaaaagtaggcataatctgtgtttcctgtttgggcttttatttgatgttttgaaagttagcttcctgggttactttctgatttgttcctagatgcagtgttgcctaatgagctggatcgtgctaagctcttaaggcagacatcatatccccagccctgaacatttgccatgtgcctaagtgttcattgaacgagggactgaattcataactggggttatgagcaactgcaagcagcttggcacgggtggggagtgccttggatgtgagaactatgtgcatggataaccctaccttccccaaagaaaacaaggcacaagtgttcataaaactggagaaatctgcaggccagaaaatacttctgtatcatgctggctcgccaggtacaagccccagcgagaagaaaatacaagaccagaatgggatatggagccaagttcctgtggcaggggcacagcaggaggagatcccaggaaaggaaagccaaagcccctggcctgtgttaacacaaaacacagcagcaaggccaaagccatgagacaccttttcaggaagcatccctctgcccttcccaccccaccctgccctcacctgctggaagctcccatctgattgatccacatcattttgtcagaggtgtccctgggtcggagcagagccctgacaggtgcagctgcagcttagagttgatcatggattaaaagattccaggcctctagttagattttttttatgccttttgatttttatataccataaatacagatgtgtgtataaaacatatgttcagtattaaattgaccaagtgaacatacatgcagctgtcactgaggtgagcaaatagaacatggctgggaccacagaagctcctgtctgcccctttttcgtcacacgtccaccttccacttggaggcaaccattttcctgacttttaaggtcattgtttgcttgttttcctttgtagtttcaccaactttgacttcactgctaaactctttagtatcgccttttgtttcaccgtgtataaatggaatcattgaaaatggactcttgtgacttctccttttgctcaacatcgtttgtgcttcgcatctgcctcacactggcagatgtagctgctgtgggctcttcttattgctgggtgtgttccatcgtaggaatgtgctgcaattcctgcattcatcccagttagggattcttggaaggtgcttccatgaacatcctgtagtgtttcctgatgaacgtttgcaagcatccctggaggactgactagatgtagaatggctgggttgagggaagttctgcctccacctttactaagtaacaccagaatgatgccatagtggtggcaccagtctgccctgcaccagcaaggtggagacgtcgcagtgctgtggcatcagaacttggcattgtcagacttcttgtttttgtcagtctggtacatgaaggtgtctcatggagttgtactttgcttttctctcgattaccaatgagattgagtgtctctttatatgtttgtcaaccatttagatttcatcttttccgaattacttgctcaggtatttggacatcctctttgattgggttttttcttgcaattatgagtaggctttctttccgcgatctggacacaagttgtgggcaggtattgttttaattacctctcattcatcccaccctagggtaatgcggatgtctgaagactccacagctgacactggatgaggccaacagcagttaattagtcacagatactcacagcccagatgaggaccacacagggccacagggggctgcacgtgggaaaagagtgaaccagcaggggctatgggaagcaggctgtgcagtaagaagagggtgaggtgacccctggtccccacaggaggacatgattgacatgtttgaataattccacaacctgctactcagggatgagcagaaactgtacctgtccccatgataagagatgggggcttggctgggggacctcatccatgggtctgtgtggggagggaacctgcagttaggccatttgaggcccttccaattttaccagatgccaaggcagcatataatttagaaccttaattttgggccataccacagacgtatgtgttgcaaataccctctctcactttgtggcttacctttcccccttttttagggcattttgatgaacagagattctttctgtataattggtaccttttatatctcaattaattcttactattacaaagtcaaagccattctctacactaccttctgaaagcttaaccatatggccgttagtttgactttgaatctaaactgaatctaagtggatcaaatatgcctccaacttcctggacctttagggagaccaaggccccagtgacttctcttaagccgttcttttctcaaggtgaagtttctccagggctgctcaccattgcctcttctcactgcagccagcacagatctcaagccaaaactgccagagcgcctcagggacactctgggaggaagtgtccatccagcctacttccagctcagcctcagtgtgcttttagtacaggctcatttaacatagctgggtgtccctgcactggtgctgctggttcaaggcccgtcaggcaattaggagagaggactgcccacctccacaggcaggtgaccttcccgatcgtgggactcggctgtaaagacggctgtggatggcacattccctcccttgtctccataattgctattattttaataaacagaactcagctcattcaagggaccgttcaactgccgatgtaattttctcacctgtaagcactagggttaaaaatttcaagttatcattgtttgtgttggttttcagcatgtggaagtagcataatagcaatgtactagcaaatacatgcaagagccaagcacagtctggggccctttctgtgtgttaattcaccatcctcgcaacctcccacatatcatacctgcccctacttgcatccagcgttcgtctttattctgtgcagaacccgtgtcctgatattggccctcggacctgtatcagtaaagttctctcacacaggtgacccggccaggcagccactcagccttgctctctgccacacccaccgtcaggggaagtggcttcagatggagccctccaagaagaggccatggagtcacttagttttcattttcaagtatttgaaatatctttatgaagaaagactactgtcatctgtgaacatgagtcatcttctaaaaaaactagagagaatgggcttaaaataaaaccaggaacatccgaagaaacttggagaaagccagaatgagaaatggtagcatagacgagagaggatcctggtagagtttcgtccataaagataaagaccggtgcgtccgagccagagcctggaagccatgctgagtccttcctttccctcctcctgtcctccgatcagccaccaagctgtgtccactgtcctcacacccaccggaacactgactgcaggcagggaggggctctgcctgcttcccaacgtgtcttccccatgcccaacagcggctggcacatggcggccctcagcaagtattgtttggactacgatattgatgagttgcctgggactctgtctgctcctctccactccttcccctgtctctcttgggaccctggccattgccagcctgacttccagtgctctctccttccagactacaagcaggatctctttaaaatgcacgagcagttctgccacccccttccttcaggttcttcgtggctcctcctggcacagggtcgagccctgactcctccgaggcctctctcatctgggccctgcttccctgtgcaacctcctctgtcatggcttctcgccctccctgttgttcccaccttcctgcagtgctgtcagggtacccaccttatgcctctgtgcatgctgagccccctggctggagcaccttcccaccctgtctggcagacactgtcttgtcccctggctcccactcaaggattcctccctctggaaattgttccccaggagtctcctctaccctttcattgtggaggcagcacaccatccacagtgttctccgggcaccttgttttaatgcctgtcatagtgctggccacgccattctttcagctggtcagttcagtcaccatcctggacatcagggatgtggtggtgaacaaggcactgggccctgctctcctgaagctcctgttggagagagggaggcggaatgctcaactcagcacatagctgtacaggaaaacgttactgtggtgcaggtgcccttgtagtcattctgtaactggtcattcagtgcctaatcgcacttggcatttattgaatgtctgccacgtgctgttttatcagcagtggaggcaggtgagctcatggaaccttcatggtttcctcaccttgcagctgaggaaaatgcagcatggaggggtagaacctgctttcaagcctgggctctgagctctcacgccttgccatgtcacctgatgtcccatcaagggggtcattgtcccctcagagccccttaaatcatcagtgggggtggagggtgtcacctggggctttctcagaggaagtgacttcaaagcagggacctgaaggttgcacagggcttcgttaaacacaaggggagggtgcagcatgttcctgcctgagggaacagcccaggtgaggctcggggagaacagaaggcaaactggaggaaaaaaggctcggaaggattagagaagtgctgggagctgggagaggcagaggctgagctgtgaagagctgtgaaattgtgttgagcagttgaggctttgttcctggagcagtcggaagccaagggacagttgtgacttgatctgttatgaggctcctctgactgctgatggagaacaaattgcacaggcactaaagtggatgtgggaagaccagtttggccaaatcattcccaggcaagagaggatgggggtctggactagggtggaagctggagaaatagaagtgaatggagcagagaatttgagggagaaaaatgggcagtactatggacactgtttggtttgagggtaaggacgagaaggagagaagacaaaggcgccaccagagggtctgggacaggcagatgaccaactgatgatactgttgatggagatgcaaacacaagggttggagatgatatgggtgggaaagaatgccgatgttcaggacatgtattcatctgtggtccccagggagcatctgagtggcagttggaaggctgaggctggaacatgagagagttggctggatattcaaacctgaaagtgtatacagattgtgtttgaagctgtgagagtggatgggtttattgagggaaactgaggaagagagaggtgcctgtctcctcggtccactgtgagctcctacctgcatatccaatatggtagccactagctacatgtggctgtttaaatttcaattcaaattaaatgggccaggcttgatggctcatgcctgtaatcccagcactttgggaggccggggtgggcggatcacctgaggtcaggagttcaagaccagcctggccaacacggtgaaacccgtctctactaaaaatacaaaaaattagccggccatggtggcaaacacctgtagtttcagctacttgggaggctgaggcaggagaatcgcttgaacctggaaggtggaggctggcagtgagccgagatcacaccattgcactccagcctgggcaacaagagcaacactctgtctcaaaaaaaaaaaaacaaattaaaattcagttccttgttcacactagccacgtttcaagtgctcagtaaccatgtggctagtggctcctgttacgggcagcacagattacagaccatttccatcatcacagacagttctattggacagcactcaatctgaactctaccttgtatttattttgtaaccacagtgccaaggcactcagaagaaaacgtgcagttccataacttaaagacctttacgaagtagactggcagccctttgctgccctaagggtcaggaaaggaaccctgtgggctctttggagccatttaaatcaatgattggcctcgcactgggcgtgcacaggggccatgctaccccagccaaaacgcaggagtgtcagcaaacagcacttctcaagcaacaggaggactcagtccttcctacatttgtctgacttcactcttagttccctccttggcccacagacaacagcacatatgcatttgaacaaatacagccctttaggttactatttaaaacaatggagtgataaactgagagtgtccacagaaaatcagatattgaactttccatttcagaaaccagttctgcgttgttgtgaatgttcaatttttgtttttgcttctgtttttcatcttcgttgagggtgtacctttgtcctttattttctttttcagtcggatgtcatggatcagaatttgttaaatttcctcccagaacaagaacattcagaagtttataaaatcctttcttcccatatgcttgtgacggattccccctccccagaatacttaaaatgtaagtttaatttttctggttttacaagctagaaagataagaattttgcttttgaaaggaggttagaatgaattaagaagggagaactaattttaagaataattttcctcatgactcagaacatttccaagatccttagaggtatattttaggtttaaagctaaaactggaatttggaatatgtaagacatttggcttttatgtggaaaatttgaaagcagagaactcaagaataataatttattttgtgtatatgataagatttctctttttttttgcatgagagtcttttagtaagaaacagtgcaaacatcagtgaacaatcagctcatcatggaggatactaagatactaaattcatataatatcaagaaaccaactgaaaacggaataattaggtcaaaaatccaaattctgtcctcctgaggctctcacctggttatttatatacatttttgtgttctgtggaattcagacgtttttatcaaaatatttggcaacctaggtagaaggctaaccttgatgcctcgtgaaccacgggtcacttaatgaagcatacacaattgcatgaggtagcaaagctgcttgcatcagtgcaagcctgtgtccattttccatgaataatctgtcctgtcgtacatctgattttacttcaaagcaaagcaaaaagattaaattaaagggagcagctctatatgagccgctttattttaacataccatatgaaaacagccggaactaatcaatgccaacattaccaaccacagacatctgggagcaaattaagactaattgggtccatgtatggaatgcaaaatatctatgaactatggaaggaaacccctgtgcagcaaggttacaaaccaggcccaaaagtcagtcgtagtgagagaactagcctggccatgtgtagactaaatcccataagagttttcacagagacgctacttgtttagagtctgtgcaatgctcacgacccctttctctcctcttcttcctttaacggcccagctgacagcgatttagagttttattgccatcttctcagaggcagcttgaacccaaaggaatttccaacttatgaatacataaaatttgtaggaaattttcgctcttacaacaatggtaagctttaattgtcatataattgtgacagtgtcttttctcatgcaaacgtgcacatgggggcattaagaatcgcccagggaggaggagggagaacgcgtgcttttcacatttgcatttgaattttcgagttcccaggatgtgtttttgtgctcatcgatgttctctcccattcaagaggaacacactcccacacctgtttgtgccagtgcacacagtcccactgaaacacacattattcatttatttatcttcgggctgatgaaataattctgtactgtgagaaacaacatacagggaataaagaacaggctctgccaaacaggccttcgtggtgacttgatgatccataaccttgccttccacactgtttccctcccgctgcagtactgtcatgagcgtattttagtagacctggtccgtaggtcttctgctcactgtggccctcatgcacagcaaaggggtcattttacaatgagccaggaatctgcattggatgaattatcaagcaggataagccaagtagcaaagtcttattttctgaaagtacccggttacctgattaaccaaactctggctacagagacaacaactctgaacgagactaaaacacttatttttacttttgaaccatgcaaaatggaaatgcaggcctgaggccaggaattcagaaaccaagtcctaagccaacttggttatgggctgagctcagcatggcctgcattttgttttctgggctcctccaaactcaacacaaaacaaataactttgaaacagctaacatttcataaagcagcaaagatggaaaaaaaataaaataaagcattgacagggaatgggggaaaaaagaggaaatgagaaaaataccaaaggaaacaaaaacagaaagatgagctgcagaaatgagggggagatgcagagagcagatgatgacagcattaacttctgctgcgttcttgaccactgtttcactctggacgtggtgggtctattccttcagtcaaatttgtcccagggtttctattagaaacagccaaagtaatggcaccaagtcctcacatctaaccaggatttttccttctacctcagatggtcctttgttgtatgttatttgcataaatatacatgctttgtttaaaaggctccaactagatgctaaacctttagtgtgatcctgccagcatgattttcaggtccagggtgcagggcttatgcctggatggtgggctccttggctgactgggaggcctttctgggaacagacccatccagggcttaagatggtcggaagtggtgggaagtccatcgtcccaggtgggcccctacatctgggcaaagtcagatgaggccaaggcctaaccatgcctcatcctactcatctgaaaggcttgtctaaacttcatgaaatgaatgtttaatgaaccacacaaagaagtaaatggaagctctcgttgggctactcagttaaagaaactgacctaagaggcaccttgtagagaacccagcatcgtactaaccctagcgcagtggttctttgggtgaggcaacttattaaaatgcagactctcagcctttgccctaaagagtctagctcaggagatgggagggtaggacccaggaatgtgccgttggggagtactgtggggttctggttccaggggctgtggactttgaaaagcactgtcctagtgtgataccagtgccattctgtggagaatgcaatggccttcctcccagacaactttatcattgagttaatgtaaacagtgatttggaatttgctttacgtgtgcactggttcctcaaaagattaaacatagaactagcatatgatccagcaattctacttatgggtatgcacgcaaaagaagggaagacaggaacttgagagatatttgcacacctgtgttcatagcagcattattcacaatagccaaaaggtggaagcaacccacgtgtccatcagtggatgaatggataaagaaagtgtgatatatacatgcactggaatattattcggccttaaaaagaaaggaaattctgacattctacaacatggaagaactttgatgacattatgctgagtgaaataagccaacagcaaaggacaaatattgtatgattttacttacatgaggtaccatagccaaattcatagaaacagaaagtagaatggtgagtgccaggggctggagggagggggaaatgggagttgctaaatggggacagagtttcagttttgcaggatgaaaggagtccttgaggtggatggtgggatggttgcacagcagtgtgaatatactcagccctactgaactgtgcacttcaaaacggttacgatggcaaactttgttatatgtgttttaccacaatttttaaaaaatgatggccaggcgcggtggctcacacctgtaatcccagcactttgggaggccgaggcgggcggatcacgaggtcaggagatcgagaccatcctggctaacatggtgaaaccccatctctactaaaaatacaaaaaattagctgggcgtggtggtggcgggcgcctgtagtcccagctactagggaggctgaggcagaagaatggcgtgaacccgggaggctgagcttgcagtgagccgagatcgtgccactgcactccagcctgggcgacagagcaagactctgtctcaaaaaaaaaaaaaaaaaaaagatgtgctttggccataatggcagctactgtgatagcaacataccccagtggcctcgtgcacagagggcaaagggcaaaggcaccctggccctcagggcaccaagactgtgggaatcataggatgctgctccctcttgccccatgacaacagtgcacacacttcgggcagatcacctgaggtcgggaatttgagaccagcctgaccaacatggagaaaccccgtctctactaaaaatacaaaattagccgggcatgatggcgggtgcctgtaatcccagctactcgggaggctgaggcaggagaattacttgaacctgggaggcggaagttgcagtaagccaagattgcaccatttgcactctgcctgggcaacaagagcaaaactctgtctcaaaaaaaaaacaaaaaaacaacaacaaaaaactagcctgtgattggctggcgaacagcagttgtatcctttgtgaatttacatttccatgatctcattaagatgctgctgaatatccctttgaagcatcctgtcatttaccacatcttggaggatttcaaggaaataggcaggcttcattctgaatacctgggactttttttttttttaactagcagggctctactttcactatgggttgagatagtgtttgtttgcctgaaagaatgtgtggaaattatgtgtgaggttttttttttttttttggaaactattactgctgtaaacacgcagcactgaatgtggcaaatttaaaagaaagagtgcggagtgtcttttcagagtctgttctacaaaccagcattgaagaggctttcttgagacaagagttccccatgtaactgtggagtacgtgaaatatcattctaactgggattaaaatagcaaaaattgtcagagacaaatgaatttctcaggttaaaccctataaaggccagatgcagtggctcacacctgtaatcccagccctttgggaggccaaggcaggagatcacctgaggtcaggagtttgaaaccagcctggccaacatggcgaaaccccatctctactaaaaatacaagaattagccgagtgtggtggcattagcctgtaatcccagctatcaggagggtgaggcaggagaatggcttgaacccgggaggcggaggttacagtgagtcgagatcacgccacagtactccagcctgggtgacagagtgaaactccatctcataaaaaaaaaaaaaaacaaaaaaaacaccctataaaattgccaacatttaaccaccgtgacctatgagatatgctttaatataagaactcaaatttgacttcataggtttacttctgaataaacattgaacaatgaggtaacaaaaaaagctcaccctaggagtgctttctaagcacccggcccagagttcaggctttgcattgatcgtgtaatcctcgccacagccttttgaggtggtttatggcatcatcccatcttcacagaggaggaaatggacacgtagaagggttgcatctatgatgtgtgagtgggaagtcaggggcccacattcacagccagaccctctaacccggagcccacactcttcaccccagtgcctgctgcctttcacacatctgtgtcggaatgaaacagacacaggcccgctccggcctcctggcattctgctgatccatgatgcctacaatgcctgtgcatgtcagatgccctgcacccacatgccaggctgtgtgaagggcacccaagatgtgttttaatcaaacacaaagacacacagtcatggaaatgactgtcatgaagggaaaggttcatgctctcgggtccctgggaacaggaggcacacatggcccaccatgcagggccacacagagaagcaccggggttggtcaggaggccgagggaacctttattgtcgattccaagagaaagaatgggtgagagagagtagtatgaataagtgtagtgggatctgggagggaggagctgtccctaattatctggtgtctgcccggggattggttaagtcaggggacagggaccaggacatgagagcctgaaggacctggttggggtgtgagctttaggtgcgttgctttgcatacgaaaggtacctggaaggtgagttgtttgtcctctctaggaattggctaaccctgggagaggcagtccctccagcaccagcaaggccccagatgtcaaagcatcaaaaacagaaaccagaaaatgtgggccaggcacggtggctcacacctgtaatctcagcaatttgggaggcagaggcgggcagattgcctgaggtcaggagtttgagaccagcctggccaacatggcaaaactgtgtctctactaataatacaaaaattagctgggtgtgttggcacatgcctgtaatcccagctacttgggaggctgaggcatatgaattgcttgagtctgggaggcggaggttgcagtgagtggagattgtgccactgcactccaacctgggtgacatagtaaaactgtgtctcaaaaaaaaaaaaaaaagaaaaaaaagaaaagaaaaaagaaactagaaaacatagctattacacaagcctccccatacaacttctccaactccaagttcccaggtgtggtgacagttgaaaaaataagatgtaatattaataataataataggtaatatgtgtagaagaaaaatgaccactaacatcatttttttgttttttttgttttttttgtttttttttggtttttttgagacggagtctcgctctgtcacccaggttggagtgtagtggcgtgatctcggctcactggaacctctgcctccagggttcaagcgattctcctgcctcggcatcccaagtagctggtatcacaggcatgtgccgcgatgcctggctaatttttgtatttttagtagagatggggtttcgtcatgtttgccagggtggtctcaaactcctgacctcaggtgaccccaccttggcctatctgctgtatttttataggacacttgctcataccttgatgaactatttaggaaacccaccttggtccattactgtgaaaagtcttagtgtttctgctgggcagtttagttagtggagtgttacatggtacattcttatttgatgcctgtcctttttatatatatgtataaataatggaatgggaaggacagcgacccttactgtacccgcttcctgggcctagcatggtccttacccagcacataaataagcagcggataaaaataggttgacctaaagtgaggcttgatcttggccccgggacacagctggtggagggcagagcagggttcagaccagacttgaggcttagagagcttccctaggagctaacagagctctctcctagaccagctccacaatacactctggggatagagtgcacttatatgcagaagagctgcagtcacttctttggccttaaatccaaagtggagattgaacacaggtgggtacgcactgggtaaactggattgtgtcactcctggtgccttgtgatttgtccacactgagggcctctgaagcagcagtgagtggctggggaagttcgtctgtgggctctgtgcactccccacccactctgtgcctcccaccacatcaagccgcctcctcacttcagctgcttgggtgtttggaggccagtagcccccttacctgatgtccctactcaggactccccgccccatgctcctgacaccctctctctcttttgaaaatattttcagttttttgtttgtttgtttgtttttttgagacaggatctcactctgtcacacagactggagtgcagtagcaccatcatggttcgctgtagccaccacctcctgggctcaagagatcctcccacctcagcctcccgggtagctgggactacaggcgcatgctataacaacctggctaattcttttatgttttgtagagatgaggtctcactgtgtttttcaggctggtctgaaacttctgagcctaagcaatcctcccgccttggcctcccaaagtgctgggattacaggcacaagccacgcacccggcttaacttttatttcagattcagggggtacatgtgcaggtctgtcacatgggaaccctgcctgacgctgaggtttgcagtaccaataatcctgtcacccaagcagtgagcacagcacctgacaggcagccagcccctcagccttcaccccctccttccttcctccctccagcctccagcagcccccggtgtccactgctcccatctttatgtccatgtgtactcaatatttagctcccacttaccagtgagtgcatgtggtattttgttttctgttgctgtgttaattcacttaggataatggcctctagctgtatccatgttgccgcaaaggacatgttttcattcttttcatagctgtatagtattccacggctaacgcgctctcttcttgctcctctgatcaactgagttggtccaagactgagagagtccctgggccaccactcaaaaatcacatcaacaggaagcctcaggccccaaaccaaagagagatgtgtaggttccagggcagaggagaaagggtgaggctgagctggagagggctctgtgtgagccttgaagcacacagacgaggatcccatcttgttgtctgctcgcccacatggctacccgggatttgtcaggctctgtacacaatgtgatggggctgagttcgtaggaatttgaggggaagggaggaacaaagcccctttgctctggtgaactaggtgacgttacactctccaactggacatgtccaggttccccagtggaggatgcccccctctcctctgcccccattcactttggcagtgtgaacacaccagccattgctcaggtccttcagccaagtggaattttcccctacttcaatgtttgcacattttggtcactccttagggcttcatcatttgccacagatgttctgggggcaggggagggaagacaggacttcacatctttaacctagatttttaataaatgtgaagaaatatgtgtcaggaaatgggacaagaaagtagtcttttttagaagagtttcacttgaggacagtttctaacccagtctgtgcaaagcctcttggagggctctgagctgggatatgtaaccccgtgtcctattctcttcccctgaaaagcccacgctggacctggccagccagcagcactggcatggaccactggtaggagcagcccttttcttcctctaatcaactgtttccagaatagagcttaacaagatgattttatttagggctatgtttgcttgtaacagatactttaaacaacaacaacaaaagagagatgctttcagacaaatacacaattccatctcttgcttctccagcgaaatagtgcctcctttctcaaaccccaggtgcccaagtcctgtagccccacctgaccactcttagtggaaagaaactggccgggtgattttcaaaggcatggggaaaggtcctgccgggcgcggtggctcgcgcctgtaatcccagcactttgggaggccgaggcgggcggatcacgatgtcaggagatcgagaccatcctggctaacacagtgaaaccccgtctctgctaaaaatacagaaaaaattagccgggcgcgatggcaggtgcctgtagtcccagctactcgggagactgaggcaggagaatggcgtgaacccgggaggcggagcttgccgtgagctgagatcgcgccactgcactccagcctgggcgacagagcgaaactcagtctcaaaaaaaaaaggtctttgctttacggggtcctaatatgcaggcttccagatcctgaaagataacttcatgcaagaaggcaatcctttctctgagcctttttgctcctcctccagacttggatgtagatgtgtgtctgacaaatccagaaagcagtatttcaaaagttgctggtgtggttccaaataggtcaccctcggcaaacattccactctgggctttccagaaaccacacaccagagtataaaagtttccctgccctcgttttacctactcgcctctaaccgcacaaccagatttgaaatactggcagaagtggaggcttttcagcttacaacactcgattttgtatgttccgtgggatttctggaggttgcctcattttatggctttggggtggtttgaattttttccttgctgagcttaattgagatgcctcagtaaaagggaacaaagcgcatgcacgccagacctcactgggaatggagacgcgagtgtggacggcttcgtggaaggagtgtctcatctactccggactctaagagtgggaagcagagtgtcccctccacccagcaaagaatcaggccgtccttcccctgcaggggtcagtgctgccagagagatcgcaggggagttaaaatcactgtaaaaaaattgtgccccaggagcgtcatcctgcacagacacctggggttcatattaaaatggaacaatgaggaatggtcaggcttttaagcaacctcatctttctgctcgtttcagtctgggagtggggggacctttcatacaagttgtcccataatcgtgataaaaatgtgtgtgagatatccactttgaagacaggggcgagggaagttcactttcctgaacatacaaataatttggcccatccacaccaaccgtctagtggatatcttctcaacgccattacactcttctggcccctaaaaatactcattttaattaataattgccagaggaaagaagaaatatttgagtaagacatgtagtttccctttagagtcattttttaatccagcaaattgcaaagccaggccaggcacggtggctgacacctgtaatccccgcactttgagaagttagataatttgagctcaggagtttgagaccagcctgggcaacatggtgaaaccccatctcttcaaaaaaaaaaaaaaaaaaaacaaaactaaaattagccaggcatggtggcttactcctgtgatcccagctgcttaggaggctgaggtgggaggatcagttgagcccaggaggtccaggctgcagtgagccaagatcgcaccactgtgttccagcctgggcaaagaaggagaccctgtctcaaaaaaaaaaaatttttttgcaaagccccagctctctcttgtggctcctgccttttctccaacattgctcttctctatgcaaaacacagctgaaacaaaggaaacagaaaggaaaggatcaaatatgccctgggtaaggtaggcagtgcccctgccaagaagtgggcaggattatcacggtgctctcctaggaacccagccacctggctattcagaacacattgggtcaagcacattgtgaagagagaaaaataagagtctgaaaatagtgcttaattagtgggagatgattcctcatgaatgtgcagaaagttattttcccctcaacattccaaagccatagcctgaatgttttggatgtttatcacgattgggacttaacaactttattcttcctggagcgaaacctcatcactgatagtttcatatcttctcagacacctgtcagacttgtttttcatttgtttcgagaagtgccgagaaagctatttgtcacttccttgtggactattagtatgttttcctccagccattgcaactaatttatcataagcaggtcgtctctgatgagaatacttaattgttctgatgactgagctggtaattcagtggaacagagccagacatctttctccagctctttgtattcttttgctgttaactaatgctattaccatttctgcatcttccttgctccttcctgagccctttgaaaaaagttctctaccacctgagatcttcctgccctcatagtcatctttttctcctcatcatggctgatttgggagctcacctttgtcatcagacagacttggaagccaaccttgggtgcttccaaatgaggcagacatgattcattctgagtcccagggactctcctggttttggaatcccaagaataccagcccaagacaaaactttctcagggtctttgaagttacagtgtaatgaaagtttcaggacgtgataacctgtggactgttttaatagaaagaccatcatgatagcacgaggccgggcacggtggctcacgcctgtaatcccagcactttgggaggctgaggcaggtggatcacctgaggtcaggagttcgagaccagccttgccaacatggtgaaaccccgtctctactaaaagtacaaaaattagcctggcattgtggcacatgcctggggcacagagcaagactctgtctcaaaaagcaagctagccctgcatctccgcaagcagaagaccacgccacgcacctgctctgttttccatcacagagtggtgattgccgtatgctgatttgcagcagtttccctgactgcagcaggcctcctgctgactagtgttaatgtatcagtcgggcagtgagctcacctgcctgccagtggaacccaggccatgtgctatgggcacctcccacagctggcagagtgaacgggccaccagcagcaccaaggtgggtcacactgcagaggggaagccaccttggggtcccaaggtctgtgtgctagttgctggcaaggatgagatggtgtcttcccgaactggaccttaagctaggatttggagatgagccgggccatctcatgggagagtcatctgataaacacatgttgagcacttgttgtgtgctcagaggtggagacagagaatgagccccagttcctgccatggggaaggctatatatttagctttcggcaagagtaaggtcaattttgagtaagatgaccctaggagggaaaatgtagcaagaatgagttgcttttctctatattgtgagtggtcagagatctgagcaaacagggctgctcctgcagttagtgggtaatcctgagagtctcaggaagccagttgtaattagatatattctttctattacttaaattgaaacaactaattgaatccttaattaatgtctttaaactaccttgggatacaaagtgccagagaagttattctaagtgctaaatatgactaggaagtcccagggagcagtttgcacctgtgttgcctctagaatatgcaagaagactcgtgctgcaggaaaaagttatttcaaatgcaactggcaaaatgttcaaagtatcttctttgccttagttttccccaaggttttctccttggcctctattaaagcattcatccttgatttattatcacccttgatcatgccctcagtttttttaagttttttggtgggaaaggcatattgaagagagaagttgccccgttctggacatctgtaaaatatctagctcatcaaatgcaggctacaaacaataatgaaacttccttttggggggtgcatttttatctttaaagacttagatgctataaaagggcagataaaactgcattatgggggcagccaggccaacagtaagctctgcaaaaca[450 bp omitted]attcatttgcaatagcctaagccaacttgtgacagatgtaagctctccagagaccactgttttttattttgcccactttatattcatgtttggaaacattagtatttatgtgaatgaattcagagaatatgtttggtaaaatgaatttattcatgttagtggagagaagaccacattatagaatcttttagaaacctataaatatatatatttaaaaaaatgattggaaagctaaaatccaaagaaaatcttgcagatttcattttataatgatttagctttctgatgctcgatatgttcctcattaacttggagaacatcatgatattccagttcagaatgtgcaggatataattgtgaaaaacgcagcacagattatcagccctgggatcctcagcctggctgcacactggtgaacctgcagagcctttgagaaggccagtgcctgggcttcaccccagagtttgtgaattagctgatctgtttagggcccaggcagcggtgcccagggtcccaagggaaccccacccgtggacgactttgagagttccacgtacgtagtaaattggcttttctcctatttaacagggttctttatcccacctaaaaaactccatctaaaagtaactaactttttctctggcccagaaggtcagtccgttctccacagttgccctggaggcagggaccaagtcccacagagaagactctgccgaggctactgcaggtgtgagacggcatcatgatgtgggcccatggctgtgggcctaggacagtcccccctctgccctgttagaaccctgggcctagagcccaaaaacttgatggcatccctgctgttatttctgagtgaccgtggttaattatagaaccattccgggcctaggacagtaatgccctcctagatgtttgagaagatgtaagaagatgcgtgagagcagattttgtcacctgggccacactagggaactagcaagttttgttgtaggcgttgtgttcctctgggggtgacccctaaatcctgagccctgtctcctcagtggcccagacccaacccctgtatcagcctgggctcccaagggggagtttcaggacagaggcccttgaaccccaggtatgccagccaagacaggggcagggaagggggtgtcaatgatgccgagacacccctactttccctgggaccatcagtatcaggaacactgattatagaattcaccttaaaacactggctggagtattcaaaccgttactgcagaatgaggctgtcttctcttttttttgtttgttttgttttgttttgttttgttttgtttggagacagagtcttactgtgtcacccaggctggagtgcagtggtgctaacttggctcattgcaacctccgcctcccaggttcaagtgattctcagcctcccaagcagttgggattacaggcacacaccaccatgcccagctaatttttgtttttgtttgtttgtttgttttttagtagagatggggtttcacagtgttggccatggtggtctcgaacttctggcctcaagtgatcttcccgcctcagcctcccaaagtgctgggattacaggcgtgagccactgtgcctggcctgtgttctcattttgtagactatttttcccagcattataagccatagggctagtggaagtgagaggcagtgctgaatgctggtgaccagcatgggctcaaatcccagctctagcaagctttttggtcttgcacaagttacttccctctgttcctcggtttcctctttttgcaatgggaataatagttgacctacctcatccagttgtgaaaatgaaatgagttaatatactctacataaaccctgggggcagcgcttggcttacagttaagtgccaactagggattggctgctgtcaccagacagggctaacctatgtgtcctcttcttcccaaccccccagtgcctagcccctcctgtaatggttttgacaacaccctttcaagaccttgccgggtgccactaggaaaggaggtttgcttcattgccaccgttcgtctggcaacaccacaattcttaaaggcaagtacctgagaggcagttcattgtgcggagctgttatgattgactcacattttgttatatgtaattaatggtcttttgggagggaataaattgcagtgaagttgtcactggctttgaaaatcgaagtgtctggcttctgtgcctgcacacacgccctttcccctgccccgtttcctgcaagtggttctctttgaaggcagcatcgcttgctgttcagcccgcagaagtgctgtctgataactgtaaatcttcccacctttcacaccggcgttaataccatgcaggccaggcctgggtgagaaccgagtgttggagcgctgggggtttgtctgccttctctcatctgtgattgcttcaacatcgatggcatgaatgttgagttaaatgagtaattcagattccgatgaaaagccattttccacatgtttgccacttctcgataatgggaagggatggtgtgacattctggctcctaggtatttttccctagcttgtgaaataaatttagtatcagctaataccgaaattagctacagatgatgagtttcagtccaacacgacttggagacttgctcgaaatgattttaacttctgttacccaccacgcgttcctcttgaacaaacctagggtgagcatctggcacccaagcaactttttttttttttctgcttccaatacaggaaatgtgcatagttgacgaacctttagaggaattcacttcaaggcatagcttggaatggaaatttttatttctggatcacaggtttgagaaaagaaaaacatatttgggttgggcccttctcaagtcttgtttgcgtgagccaggctctccttgggagagaagagtcggccctggtccattgaaagaggaggactctctggcactaggaaaagtcgtccctgccaagggtgggtggtttccctccaacttcatctgccccatcgtgaatatgttctgtgtttgggtctgatggctcagccccgggccatctttgggatgatcctcacttgaggcccttcccggctcccagtaaggcagcagcaagtgtgagagaaatctctcatctcatttttttcaacatcctttgatcttttagcccaatctttactgtttcttttgtaacattatttgcagttgaagaactccaaatctcccctccccaccctttaatttatattacactttggtgttgggctgatccaatttgtagctgtttttaattacccagtagtgataaagcttattgttatttgggccaagttatgccaagggaaaggagtatctatatgccaaaaaaaaaagctgagccctttggaaaacacagcctctctgattttgaccattacaaagttatttttctccccttgttcttgagaaatgaggcctccatgttgatcattatggaaaggcatggccaccagggtgagccctgcagggtgtctcctccctgatgacaagtcctccttgtccttgtgcagagcacctccaatcataggatacctgccttttgaagtgctgggaacctcaggctatgactactaccacattgatgacctggagctcctggccaggtgtcaccagcaccgtgagtaccactgcccagcccaggcatgggggccttgcgttcactccactggggcccagcagcagggctctgggactccagaagcctctgctcgttacctggtttctttttaaggtgaggaacttggttttctctgagatgatctgggggcatggtggaggccccttatccgcgtctacccccatgtcactggaattcacttggccccaaaccctagcaccttcccactgtcatccagataggcgccctgtttaaacctaattaagaaattaaggtgatgcagggatttttttttttaagttatgcaatacatttcagagataaaataccgaattctcataactgttctttcatcagcagataagtattggtcactaaccataggccagatactgagtaggctggcatatggggatgatcagtacctacttgctgtcccgcagggcaggtcttctgggaaagccagaaatgggtgactttgtgggatgtggtcggtgcattgaaggggatgtacacagcatactgggggactcaagaggaccctcacagctggggttcagggaaggctctttgccacatacgaggcgaacacattagcaaatgtatgggggatgggacttacgatgtgggggagtgagaattacaagcttgtccgagttctcacttagcaagtggtttcaagaattaaccacttacagctgtattttcagtgccaactcttaacttgaaataggaacactgacctattgatcctaatgcatgaatcgaccactaacattgtgctttaaaagatgcctcacctgtagtacccattagaacttttttttttttttttttttttgagacagacagattctcgctctgtcacccaggctggagtgcagtggcgcaatctcggctcactgcaagcttcaccttctgggttcaagcaattctcccacctcagcctctagagtagttgggattacaggcgtgtgtgccaccacgcccagctaattttttgtatttttagtacagacagggtttcaccatgttggtcaggatggtctcaaactcctgacttcaaatgatctgctcacctcggcctcccaaaatgcttggattacaggcataagccactgtgcctggctagaactttctcttctgtggagagggaaggaagaataggcttgagttccatctggatcggctgttagaatttaaagctaatcattaaaactgtaactccttgctcctcaaagcgtggtctaggaccacactgcataggcatcacgggaagtttgctacacttgtagaatcaggcctactcagagtgtctattttaacaagatcccgaagtgaagaattacattcagcaattgaaaggcttctccatggcttgggcaagacctccttgccctgtggagcccacaccctcaatctgctgggcttatctcctcttcagataatcacattctccaagtcagtgtcctttttttttttttttttttttttttttgagacagagtctcactctgtcacccagtctcggctcgctgcaagctccgcctcccgggttcacgccattctcctgcctcagcctcgtgagtagctgggacaacagacgcccgccaccacacccggctaattttttgtatttttagtagagatggggtctcaccgtattcgccaggatggtctcgatctcctgacctcatgatccgcctgcctcagcctcccaaagtgctgggattacaggcatgagcccctgtgcccagccatcagtgtccttttgtagcgttagtttcctagttgagatttctcttaaccatttacctaaagaggtgctaagttccaggcactatggcaataaaacccaaatcattcttcttccttggatccgtagtccatctttctgccctgcccaggcttgatacaccatcagcatccattctgctctggacacccctagaaaagccaccagcagacatcactatgggggggctgcaagcagctctggggaagggggaagcctggggtggaggcatctgtccccgactctttatttgagaactgtgtcgactgggcatgaactgctgactggcagccacagaatccgtccagaggttgctggctggcaggtctgttttcgggccaattctggatgctctctcctgggctcctgcagctccaaagacagctctgcctgcggcgggaggatgagcaccaggcaaacctgagcctctgtttcattaaacctgcagtttgaaaatctgtctgcatctgcccttatctgaggatctctttaagcgtctgagcatttgggaaagtatatggatcactcttccactgtttaagaattcacgacagtgtaccgtgatcctgacagtcacttaaaatacagggcaaccggggaaacaagccatgtttggtattgtctttttttttgaaagcttatctttacaataactcttggggaaaagatcattttcatattaacattggttatatgcggaatccattttctaccgacagtgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcaggtaccgcgcacgggcaggggtgcggctgcgtccttgtcgcacctgggggaggggtgcaggatggcgtggcccctgatggccaagtcagatcagcagtcactcaggtgttccccatttcgaagatgaagcccaggccatcccctgccgttaacagcacaattcccagagctcagctcgcttccaggcaccactggctctgccctcccagggctgagactcctttcaagctctcagtcaggcccctttgaacgcctcatggactctcgcaggctgccaggatattacttagtaagtgactgcttcactgacctacttacatattttcccatctctatccagcccacagccttcccttgttcctgctttgagtagaaaatttaaattttacctctaaataactcaaacacatattcccctttatttttaatgctttaaaaacccctgctggcaactgaggcagtgttgggaaaacagcctggctgccagtgggcgcgggttcctgggaggtccctgctggcctcagggagccctccacccagggcgggtgagcaggactttaaagagacgcggcatgcccagggtttcatagatgctgcctttgtggggtcactgttcccaaggatgaaggggaaaatggtcttctccccgactacggaaattttaagaacgtaaattagttttaagctggcctacagaggagccttggagaagggcaaagaaagaaaagttggaaggacagcatgcctttctttttttttttttttaaactttaagttctgggattcgtgtacagaatgtgcaggtttgttacataggtatatatgtgccatggtgcatggtgccatgcacctatcaacccatcatttaggctttaagccctacatgcattaggtatttgtcctaatgctctccctccacttgtcccctaccaccacccctgtcaggccccggtgtgtgatgttcccctccctgtgtccatgtgttctcattgttcaactcccatttatgagtgagaacatgcggtgtttggttttctgttcctgtgttagtttgctgaggatgatggcttccagcttcatctatgttcccgcaaaggacatgaacttattctgttttatggctgcatagtattccataaaattagaaaaacctacttgaaatttcatatgcatttcttatatacagccacttgctgcttgatgatggatatgttttgagaaatgtgtcattaggtgatgttgtcatcatgcaaacaccatagagtgtactggacacacctagatggtgtggcctaccatacaccttggctataccgtatagtgtattgttcctaggctacacacctgtacagcatgctattgcactgaacactacaggtagccatagcacaggtgtaagtgtgcacctaaacgtatctgaacacagaaaaggtacggtaaaaatacagtgttccaatcttagggaaccaccaatatgtcccataagcacatgactatatatatgtaacagacagatgtagacagacagacactacacacactcacaccatacatgtatcaggtcaccaaatcagccattcttccttaacacgcagaagaggggagaaacactagttttcagcagcaaatgaccctgattctacttgaccacacttcatgccttcgctcagggacttgatcttggattcccagcctgccactgggcgtgcagcagcagtggtctctgactccatggcagccgcctgttgccacccagcctggtcctctgcccaagggccccctacccccagggaaggctgggcagcactcacccctcacccttcaggctgtgccctctaccagctcttcttctccatcctccacctctcaaatccttggaagaaactctcagagaaaggaggaagagaacagagtgaatgaatcaggtggcaggcgttccggaggcccaggagccacgttgctttccaaggcctcttgccccagggtctccacactcggggcagaggcactgtagggtcagctgggcgtccctgtgttgagttgatttacccacactgctgaaaagtgggcctgtgggctcatctacagtctggatttggctagtccgggttggtttgagaggaaactttctgagaaatgtaactactaaaaaagttttgtgtcactcttccatatgcacggtccagactgagcaggttttaagaaagccttctaattatttaaaggcagaagcttatcccatagacgaaaatgtgttttttaaagacaattacaattggagatttcagggaagtaaaaagaatagtaaatgagaggggaataaagacatcctggaaataaaaagattttgaatgtaatattataagtcactcaggtcgaatttaaggcagagaacgacgctcattccttccaacaagtcacaggctaggctcctctgtgttgactgttgtggggggcaggggttacgtagagaacctcgatgtaccttgctgtctgttcaggtggtgtcatcccttcctggaatgccccatctccactgtggtctcttaatttcctgtacagttacgcagatgtccgggtggaaaggaggcaggagctggctctggaagacccgccatccgaggccctccactcctcagcactaaaggtacgcccatccctgccagatggatacggcaaaggttggctaggaagaaaatgcagccaaccagtctctgaaacaagggtttcttttcatcaatggaagggtacaaccaagctattcaggaggctgaggtgggaggatcccttgaggccgtcacattgaggctgtggtgagctatgattgtgccaccatactccagcccggatgacagagtaagactctatctcaaaaaaaaaaaaaaaaaaaagagcctgcagagctgggctagacacagcccctggactcaaagcacggctcggcgactttccagccttacaagcatgtctccagtgagtccactcggcatctcctccacagataagacactgggggagttcctccctccccggctgggttgtggaggaattccagagtccctggtcttcctttgcttgagggccgtggcactgcctccaggacccaggcaccctatggggagactgccctcacgccactctccctgtcacctgtgctttctatttctgtgtccaggggtgttagtgaacatcatgctggagccagctctgggtcagcgagccctgctgtagaaaggccttccctccacagagtctcttccatccttccttccacacactgagccctctactcgcctctgcctagccagacgtctctttgtccctggtcctggtccatcacacagcttcagggaaccttggggatcatctgcaagtagaccagagccctgttcctcggagtccattcttaaagcagacacaaatgttgggagaaaaaaaaaagcaagaaagggagggagtgttgtatttcatcaaagttaaggaaggtgtcaactggaagatccatatgaatttttcttttttttttttttttgagacaaagtctcactttgttgccccagctggagtgcagtggtgcaatctcgatctcggctcactgcaaactccacctcccaggatcaagcaattttcctgccttagtctcccaagtagctgggattataggcgcccaccaccacacctggctaatttttgtgtctttcatagagacagggtttcaccatgttggccaggctggtctcgaactcctgacctcaagtgatcctcccacctcagcttctcaaagtgctgggattacaggcgtgagccactgtgcctggcctccacctgatttctcccactgagagaaaaattgctgccaaccaatctctgaaacaagtgtttcttttcatcaacggaaggacacgtcttaatttcagaagtgttcaaatgtgagtgctggagaggggagtacctcttagaactggtgaagctcaacttccagggtgcccagtgactgcgaatccagagccttgggccagaggctggtgccacagcaatggtccagtctttcaggctgtctgtggtccaacagaagcatctctcacccctgaagggccaagttgggaggaaggagaaatcacctttcaagatcagagagcagtgggtgccttggcagagcctccccggctgctgtgccatgtggtggtgtgttccatggcaattcatcaccagcacgctgataggacgcagctgacattgtttattacccagctgtgtcacaccatacattatgtatcacgtcatagaagggaattcagctgctaataggcagatgttagacacaccatacatcatcgctgaagaacaggtgtagtgtgtatcatccagtcggaaatttatcattgaggtttctgatccttggggagtcctggagccctgcgaaagaatgtcttctcatcaaaatgcatatatgtataaatacaaacgcaatcgccgggcacggtggctcacgcctataatcccagcactttgggaggctgaggcgggcagatcacaaggtcaggagttccagcccagcctgaccaacatggagaaaccccgtctccactaaaaatacaaaaattagccgggcatggtggcgtgcacctgtaatcccagctactcaggaggctgaggcaggagaatcgcttcaacccaggaggcagaggttgcagtgagccgagattgcgccattgcactccagcctgggcaacagagcgagactccgtctcaaaaaaaaaaaaaatacaaacacaatcttgggcactgggttaagaaatccctttaaagtaaaagctcccaaactatccgtggtattgaaccagtttggtttttatagcttcgctgtctgtcactgtgcagtgcatttgtaaaatgcagattcccgtgtgtggacgtgatgtgcagagatgtcaaatgggcatcaaggttcctccgggcttattctcgcttcctggaccgacttctctgctgactaggaacacataattcacaaacagccgtggtccagggaccccgctctaaggagcctggtcaaaggcaaactgtaaccaagcagcaaggtccccaaattgccatttacctcagcacatccagccacatctggtatttctgttttgcacaaaggcctgtaggtcacatgtcagtcacttcattcctactgtaggtgtacaatatccacccccactgcagccgtgacacaaaagacaaaacggccacgcagacgcacgcatgggatttcatacccaaggccatgggacacagaccagcccattgacatagcccagagatgctggcagtttccattcttctaacactagctaggaatgcggctcaggagggtaatcactgttttgttttcttctttagcttaaaaattatcccaacctttgtttggtttattattatttttttagacagagtctcactatgttgcccaggctggagtgcaatggcatgatctcagctcactgcaacctctgcctccgaagttcaaaccattctcctgcctcagcctcccaagtagctgggattacaggcgcctgccaccacgtccagctaatttttgtatttttagtaaagacgatgtttcaccatgttggccaggctggtctcgaactcctgacctcaaatgatccgcctgcctcagcctcccaaagagctgggattacaggcgtgagccaccgcacccagccccaacccagcccctgttttcatgtgcctataacagctaagccacagaggatggaaaaacggtccttcggagtcagactgtcacagctgctttctcgtcacactgtatttgaagcagagacatcctgggagccagggtcagtcaggagcgagaggtcgaaagacaggagaccccttgccctccccggttctccactccaggggacactgaggctgcagagaatgagtaacaggagaaagcctgggaaggacccaggaaggtccaaaggcacctgtcccagtggatgagtttacagtccactgccagcagcaaccttatttctagaacctccttcccccttcttggaaagtcaagatgctgggtggtgaggtgacaatgttgaggaaataataaaatggaaagtcagttacgaaaatgtaaataataaaaacaaaaggcgagaaagggtaataaacgctgcttttcggctgcaagcctctctgaggctttaggttacgtatatgtatatactctacccaagcatctttggaatcgtccccaaacaactatggtatttgtctcagcagcttctgaggttgtcgacatatttagaactaaagtcacgcccactgattctttcctcttgatgctgacatgaggactgtttgatgtgtgtgtttcaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctgtgagtgcgagtccatggatggggagtgggatgtccacatcagaccagagggacagccccacagagggtcccgggcccaagtggaatcagggcagtctgtgcctccgacagaggttgccgtgcagtttatactcctcctttcctttcccagacttcccgcctcctgatcacctctccacactctggtatccattcattgccaagcaaagacattgagtgggttgtgcacagatctgatcccttgactgcttttagtaattctggggaggcgtctgatcaggcagctcattggaccaagcagccgaaatgaagtttagggagtgtttgtggtgtctcctacctgctcccaggctgggcttctgtggttcagctcaaccctgcatggtggacttcctttatcagagatcccaagcgagctcttgtactgtgcacaccacggtcatgggtcccctcttcggatgagtacatgctaagtacatggaagttagaaggtcattcgttgctttcttacagccactcccaccaagctgatggcagaggccagcaccccggctttgccaagatcagccaccctgccccaagagttacctgtccccgggctcagccaggcagccaccatgccggtaagtgtgtgaccccaaactcctccacgggtgtacgctacaatgtggtgggggctgcagagccaggcgatgtgctgcgtctccccagagaatccgttttacttagggattgagagtgtagggtggcagatgggggtgggaagttaagtaatttaattggcaactaattttaaacatttgcatgacaaaattaacatggatgcatatccattagaatacaaaatccaagtgaattttaaggattaaaggcaaaactgcaaacccggggtcataccctcatacccccagagcccctggggctacacaattaggattcttctgttttgaatcccctttcatgctggtgaaaatatttgagcagctcagtgtcaacaaaaatgtacctctgcacatatcaggtagcgtccccaacatgtgccagatccttccagaacatcgggatgtatggccctggctatatgtaaagtcactggcatgcaccactctggtcatctattgccaggtagcaaactacacctaacttagtggcctaaagcaaccacatgtatgaagttcatggagtctgggtcaggaattcagaaagggcatcatggggatggcacttctctgctccttggtgtcggggatctcgtgggcctaggctatggaatgcacccaccagatggtgtctgcacatgaatgtccagcagccgggctgggtggctgagggctgggctcagctgaggccatccgtcattgacttgcatgggcctctcaagccttaggcttctcctggcatggtggtggactccaggttccaagaggagacacctggagacgcaggcaggaaccatgcagacctctgtgacctagccacggaagtcatatagtatcaccactgccatacctcttggtcaaagcagccctgagctcacccatgaagagggatatagacctccacttctagacgggagaagtacccaggaattttaggggccacctccagatagttgccaaacccctcccacccacacttcactgtcactttggagatggagtgaacgtgccaccttcctgcttgctgtctccataaaggctgtgcacaccctgcttgagaagcttgggcgatgcgttttattttcaagtagaatgtggcaaagaccacttactttctctccagccacctccagatgcgcttgcaagctgtgcctgccattcttccagactctcctgtccagtgtgactcactttgccaacaacggaggcccagagtgcttctgtctcctcccagctgcgcagggaaacagaacccagaccagcttctggatcagccctgtgcctgggatttctcactgaaacaaggtctcctggtgtcatttcctcccaatgctgtcctgggtgacactttccatttgagctgcttttttatataggccctagcaactaggggccgtgtcggaataacttcagacgagtcctttcactgttctttaaaaaaaaaaaaaaccactagaaaaccactagcccgtgaagcagagtgtttcatttcttgttactatacattgtctcccccacccacccgagtgatcagggagcgcagatgtgactcagctcacttcccaggagtctcttaaaaggttctgggcagaggctggtgaaactgccccagtcctcactgcctggatgagttcatggacaaacatgcatggcgtgtctgtccatctgcattagcgctgagcagaaaagatacggacgcacagcagctcatggtagcagtccacgcacgtcgtcctgcttgatgacaccgctaagaattaatccatttgggaggagagcaaccaaatccacccagggcggagtccaggacagcaggcaagggaagggaagtagagctgagctaccaggcttgggcaggtagcagcagcctggcagagcacactgtggtggggtggaagcctgcaccagttgtgcaggggctctgcccttgtgccctgcgtaggaagcagtgcagccagggaacagacacctatactttctagaactcttgacttggagctgttcaccccagtgcggaacgcagagaacccaccggaccaagagaccacatccctgtcccctggaatggcagaagcagtggtaacaaagcccctttctctcccacaggcccctctgccttccccatcgtcctgcgacctcacacagcagctcctgcctcagaccgttctgcagagcacgcccgctcccatggcacaggtgagtctgggacccaggaaagggcagcccctctcaagccagaagtccgcagtgtgctgcgctgatggtcttgtacacttaggtcccaaccaaggccctgacgtgggggaatgtccctcccaatgtgtgtgtggcctgtgtcgagccatgaggttccccccacacccaccctctcgtctccaagttcttttttccagtgtctggggttttctttttttaaatttcagtagttttgagggaacaggtggtgtttgattgtatggataagttctttaggggtgatttctgagatttgtgtacctgtcacccgagcagtgtacactgtacccaatatgtagtcctttatgcctcacatccccccacccttgccccaccagtcccaaagtccatcatttcattcttatgcctttgtgacctcatagtttagctcccacttagaagtgaaaacatacgatatttggttttccatttctgagttgcttcatttagaataatgacctccagctccatccaagttgctgcagaagtccagagtctgtttttttaattcttttaacagtctctgttcacctctttgccacttttccacattcctcttgttctttacgactccaaattggccatggtattttagaaaaggtctgaattgggctgcatgtcatagaaagactgaaaggatctaaaagccgtgagtccagcactataaatatcacatttgtttaaaaaaaaagaaagaaagaaagaaagaaagaaaagaaaaggattacggctttgctgagtaattccatccttgtttcaacaacattcggtgagttactatttgggtcagtcagtgagcgaggtgttagggatgtaaagatgtaagtcagcccttgcttttagttctcagaactaaagggagagacaggcatgtaaacagagacgccgccgtggcagggcatgcgtttttatagaaccgtgaaggaaatattctacccagggaagtctgacgtggcttcctggaggaggtgacgcttgagttggccccggaaaggtgggtaggaggttgccagatggtttggcagggggacagcagggatgtgcttcagcagggagttctgaacacggggagtgacaaaccctgcccaggcctgagctctgacttcagttccctcataggagacttagctctgcccagaccatggccacaggctagagctgcgtcccagacggcagttcagcagcaggtgcccctctctgtcttggcacacatctgtcaccactgatgaaaactatttcggaacatatgccctcttagtgggggtctctcatgcattcctggagtaagacacatgctaacgcgtgctgcttgccagagtcaggcttgaagattggtgtaaaaaagctacccttctggaatctactcattaaaactgcctatattcaccctcattaggccaaaagaaaaaaaaacctgaatactgtttttctctttaaatttccaaggcctatttggtaagaaattagtaaccttttaatccaaaggggcataaaatgaaaatgtctttaacttctgggtcttgcattatgaagaatgtctgtgtttacaagacacgatggtgtgatgcagtctcttttggaattctgatttttcatttattgaacttcttagtctgtcatgtgtactatatttaataataactatatatatatatatatatatattttttttttttttttttttttttttctgagacggagtttcactctttttgcccaggctggagtgcaatggcaccatcttggctcactgcaacctccacctcctgggttccagcgattcttctgcctcagcctcccaagtagctgggattacaggaatgcaccactaccaggaatgcaccactacacccagctaattttgtattttttgtggagacggggtttcgctgtgttggccaggctggtcttgaattcctgacctcaggtgatccgcccacctcaacctcccaaagtgctgggattacaggcgtgagccaccacgcccagccaataactatattctttaagacatccctgcataatactgactttccaagtcacacagttcttcccacttcatgtgaaatacccacttcatgtgaaacaacgagattctgggatttttctctcactcccctcacccttcagggaaagaagggaaaaatgaaatccaaaatctgaggagcggttatctgggtaactggtggttttccaaaaaagcctctttcttcatactatggttctaaaatgtctttaaattagagtagctctctttatcaaaaacatcaccatcaagaaggtaaggagggcctaatgatggggtgtctgggaggccttgaaaaaatccgaataacgtgagaggcagccaccacctcctaacccagcccatcgccactccctttccaagccaactgggcaccgatgagccgcctccactgcaggtggaaggggcaacgctgagtttcccgacttcgtagaacctgccagagaagcttttgtgtttcgttaaatacttggaatagctcgtttgctttctccgttgaattccctttcaaaatcctcacagagtggtctgattagtcacaatctgactgggatttttgtgagtctgggatagcgcagggttttttttaatttttgttatttttgtttatatatatattttttgagacggggtctcactctgttgcccaggctggagtgcagttgtgcaatctcggctcactgcaacctctgcctcccggattcaagcaattctcctgcctcagcctcccgagtagctgagattacgggtgcccaccaccacgcctggctaatttttgtattttttagtggagatggggttttgccatgttggccaggctggtctcaaactcttgatctcaggtgatccgcccacctcggcctctcaaagtgctgggattacaggcatgagtcaccgccccaggcccagcacaggtatttttaaatgcatgggtagcaacagaaccttccttttaaaggaagtctgaggtcaaagccactctggtcaagatgggagtgtcttgtgggcaaaacttcttggccttgctcagctcctaagacttgggatttacatgttggtgctgccaccatctcgctgtgtgatttccagcagggtgcagcctcttggggtggcatgggctcgtcgtgaagcacaacacacgtacctctacttgcctggggcagcagctggcacctgagggtctctgcacatgtcagcacctgctattcttactcttactggttctttttattattattttgctgcttcaaaagctatgctttcagttatttcatcctgtttctcaactctcctgctctccttgcctccctgtgtctgggaggtcaaagggcagaggaaaagagagaggccctgggggcatttgcaaaagacagcgggcaggaaacagactagggagattgttgggctagagattgagggagtggaggttaaatcatggtaaaaagggagaaagagaaaaacagaatgaatctagcaaactcatttgcctcaagatatgggagtcatagccccgaagagcccagagcaggggctgcaggcccctcctgccatccctcccaaacagtgtttcctggaagcggaggagcctgtgttgagggagacgggacaggaggcagagactacctgcaagtttcctaaggccagcctccttccccagaaaggattaagggtccaaaggaaggggagacccaaaacaatcaccgtgtctttaccccgaggtcagtcacactggagagggggccctcggggcaaagactgggtgattgttttgttcgttttttgcacagatttccgagacgtgcatagtagcaagtaaggctggagaggggagggtgagggggaatgaaaagttcttgatgatcccaggctgttttggagagagccaggatcagatttaggataacgaccggacccaaaaatgcctgtgaagctgtcacgtacaaactgctatgccctaaatgagggggaaaagggactctctgatgtcctgcttttgacattcatctccagaaccatttgttcatctctctaaatttggaatatcagtttgtgaacattgcttacaaaatcctgtcccaattctgtggccctcccggactgcagggcagtaagtcaggtctgcagattcaggtgggcctgctgtcatagccagcctgagaaagactggtgcaggggcccccaggatgcccagacctcatctgcagcccctgttcactgcccaggacccagccgtgggctccttagggatgctgggaaagacggctaagggacggaaatgaagtgtacagaccgagcagcagcaagatctgcctgcaaggctgaaataactctttcatctgattatgtttttcggctccaccttgaagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccaggtgatccccttcccgggctggcctctgtccctgctgctgtgtgggaaggggtcctgccgccatttccgggcagccaggacttcctcccaagccctgtgaactgccctgccaagccccatttgcttatgaaagcatattgcagtctctgcaaaggacaaggaacaaatcccggtccccatccctgcctccaggccacacccctgatgtcctcttccctcgcccctcactctgacaggcacatctgctcactgcctccacctacgtttgcacttgtgcacttggcgttggattgccctgcatggatgcctgcctcggtcctgggtagtacctccctgcacctctataactttgctttcctagctcccagcccaggctgccatcaggaggagatggaagcagctctgttgtttctcatccaacgcaggcatccagggagatgtgggaaatgatgatatccatatcacagcctactggagactgcagagggagctgggtggctccccatttgtggtgtgccagcagggaagctctgcaaagcctagcagcagcagctctcactgtgacccccagatattagaattgtttggagaggtgttgttttgttttgttttttgttttgttttggaggaaaacctttacatattggatctcttttaataatatataatgttttacttacattagtccaggactgtgtatcttcagaagtgcctgattctgacccagcctttgattgtaaatgtaactctagctaaccttggcgtctgccctgggagcactaagcatttggagacccttagaagggacagaaagaagcagaaataacatctctgctggagcactgtccctgttgcttcccccatcaccatctacgcagaccctcccctggccacacagcttctgaagtgcagccacacctaccataggtgacaggcgggttctgtcggggcacagcgccgtgagccggtgcacgctgagattaatacacagtggtgcaggtgtctgggggcttagggagatgctcatttggccatcctgcctcgctgaggtcccagcagctccgcctggccctcaggggcactcctggtggctttctagatgctcactgtccctccccttcctgcccctgcacaggcctctcagaggtggctgctcaccttaaagagaagagccccgccctggacaggccacctccccacctgctcccctcaagacacggcgtgtgcgccttgagcaggcttcactcagacagcctgggccatgccagagccctgctgctctccccacctcctcagtgcacccttaaattgaccagaaaaaggctcggccttctcgtgaaaagaaatggagtcaccgagctgccattccaccttttaccagaataggtaaaaagtggcttttgacttacgccttcccagctggaatatttttctcactgatccagggcctgactgggagcccaatgcttgcctgactccaattactttaatggaatttttacactaacaggaagggggaaatcgagccagaaactgctaaaattgaggtaggcgtatgaacatccccctcagtgcctggagtttttctacttcctgccttttctgaattttaaaataacaggcagcaaggttatcgctttcactcctgttataacaaagtatttttcctccttgtgacctatgcctttggttaaccccaaagtacctatgccacagtgcactgagggatgttctgagccggccggcatgggaattgcaccctccggtgccttcctgccctgtgttcattcctgaggccttatctttgcagtggaattttccagagatcatggaaatccacagatagtcgagacagaggatatttcctcaaggagcctgccttgtttttttgtaagacttaaagaaatatgttccaaaatgtgatatttgttttttttaaactaaactgtgtgattcaagtgtgaagaataagcaagtagaaatgactccagcccacccccaaaagtagagggatagataaaataagaatgacaaaacactgatgattgttgaagcctaatggtgatgccaaggtttcattatattacttgtctattttgtatacttctaaaatgtcctgtaatgacaagtatttgtagaaataagcagataacactaatgaaaaatcatctgtgagtgtaggattggtttgttcttgaaaattagaagttgttggtttgttttctctgataacttttcccacttggagaacttttttttttttttatgttttctataaagttgacctcagagcccttttaagtcaccatctccttaagccacaaaattctactttattgttgataaacagaagtacggctgtgcccagcagcaaaccaggaaccagtcccccacccagtggcctttatcccaacctcagtggacttgtgatgctttacttcattgcttcaaaactttcgtcgaggctatatgtgcctgtgatgcttactatttttttttttcaaaaaaaccttgggttatgaggaagaagtcctgaagggctgttggtgtttgcacctggatggggtcatgaaaatggggctacctggacaagagctgttgtgctgaaaggcccatcgccccctccaaggctgcctcttgctctttttgagagcatgcgcgccctctgctggctgctcaaaggaatgcctagaaggacacctgtagcaatggcaaatgacgtgttcctcaactggttcatccatccatctatccatccttccttccatccagccatcatctatccatccttccatccgtccttccttccttccatccagccatcatctatccatccttccatccagccatcatctgtccatccttccatccgtccttccatccagccgccatctgtccatcctttcttctggccaccctcccttctatacatccttctgcccgtcctttcttccttccatccatcctttagtccatccatccatctgacagacaccctttatttaccaggcacgtggttaagcactgtgaggatacagaaagataaacagggcagggtttctactgtcagaggatatacatcgatgggacagagtagcacaccttgctgttacagtctgttacataaataacaccagcagacatagtttgcccttctctgagtgaaagcaccattcatatgtttattcattcatacatgcatttattccattcattcatttatcaaacagtttttatatgcccaaagaggcgaaggaggaaaaagctccttttttcattttgaatgttattatctgacattcattcagtacttactatgtctcaggtcatttatatgcattaacttcatttagtccttaataagatatatgctcttaatgtcactatttttttttaatgtcactattttttactaatgaggaaactaaggctttgaaaagttattaaaattgccgaaggccatactgctagtaaatggtagggtgggaatttgagctaagataggtctgctttaaggtaaattatactgcctctcatcaataaaggttggatttattcaaactctaatcaaaaggtaaattgtgtcctaccagaaaaacgcatggtaattgggtttgactactaggtttttgctgaagtgatgaagtataggttgccctatgtgctataaatgagtcttattttaatagggagctgggattgcatgaaacatgaatcctcaaaatgtgtaaaatgatggatacccagaaaattcttcttaatttctaaagtgacaaggagtcctcatttcaaaactgcaggcttctctgtggtgggtggggcatgagaggagtttggggaggtcccgtgggatggtagaaagatcagaacccagccccagctcagccacctgcccatctcgggcctctggtaagtggctcgaccccacccatgaaacagatgcttgagcgaactgatccgtaagtctccccagcgcgcctgcatggtgggatcctcgcctgcctctccaaacctgcgctgacactcagcagatgtcagcctgtcggtcctgtactgcatatgaggtgggactgcactgagtacaggaatggggtgaaaaacgtcagatgctgggagccagagagccttccccctaaagaactccaggctaagggcctgatggactggaacagtgtatgttgagaatcatgatagacacagtgccatctgatgtttttaatacccaagaggtacttttgtttaaaaagccagtttcaggtctgtcattaaattattattaaaattacaaaagttgtctttcttaaaactttagagtcaactgacagattccgttttatttatgaatctactaatttggtctaaaaagagcaatgctctaactagatttttatttatgttcaattagttgataggttgattgtgaataatcaacattatctaccaaaactattcatttacacatttaatttatctgaatctttcaagcattttatgtacctaacaaggcagacttataaagctaagaagtaaaatctttctaagcacctaaacaactgttttatttatttattcatttttaagacagagtctcaccctgttgcccaggctggagcgcagtggcacgatcttggctcactgcaacctccgcctcccaggttcaagcaattcccctgcctcagcctcccaaataactgggattacaggcgtgcgccaccatgcccagctaatttttatatttttagtagagacagggtttcaccatattggttaggctggtctcaagctcctggcctcaagcgatctgcccgccttggcctcccaaagtgctgtaatacaggcgttagacacagcgcccagcgtaaacaactgttttaaatcaaatacaccaaacttatttgaactaaatcaggattctcaagaacacctcaaattctcttaaatctttcaaattaaaaccaccaagctaatatcccatggccttttaaatgtctctgagacaccttaggtaacaaaacacagagatgatcatgatgattacaaaacttgaacataattttaaagtgcatggacttaatgttatgtgatcatatccatgttattggcctgcctgggtatgtggttccttaattaatgacagatctgccatctcagctgagagcactggattgaaaattctcaacagtaatgtgggtacagacacgagtcactggtcagagattcaagggcaaacacagagcctggtcctactgcgagggcaatgtggcccatgccacaggtgagccatccctctgcccctatatcatgaggcaatattatcatgactgcatcatgcattccactcaccaggtatttctcccttctaggaagaagctggtaagccaacctcgactctaaacaagtacatcacattatttagagaacatctgggtctaaacagctttcacattgttaggcctcagtcacttgcctgtaaccttcatgaaggcagagagagtgtctctccagcccatggctctgtggccagtgcctgacactgagcttggggcatcacaggtgctccatgtccaccagtggagtaaatgaactatttctaggcagctcagagcaagaaagttcttactggcacagggaatgcaaaggaggtgcacactggtgaggtacccatgaccccaacttcacaggcatttctattctgctcccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccaggtaaatgtgctccttgccagcttcactccttgcctctagagcagacaccctcttgcagtttgggacatacttgattcctgcagcctacgtgaactgaggcctactgccctgttccgttatggactgagggtagatttgggagtgagccttcttttccttcttctgttaaagtcactttgaaaccccaagttgtattggcttccttctgtgttttataaatgtccacctcagtcccttgctctcgtgcttaaagatatcactcggctgaaatgttcacctttgatgctgacttagggttggaggcagatatggccatcccagagacccactggcagctgaatgtcccaacactcaacgtccatggtccccgccatctactctggttttaaccattacccacatgagcagccactgctgttcactgtcccttgccccaggtgccccctgctcctccaggcgccccctgctcctccaggcccccactgctcctccaggtctccctgctcctccaggcccccattgctcctccaggtctccctgctcctccaggtccccctgctcctccaggcccccactgctcctccaggcctctctgctcctccaggcgccccctgcccctccaggcccccactgttcctccaggtccccctgctcctccaggcctccctgttcctccaggcgccccctgctcctccaggcccccctgctcctccaggcccccactgctcctccaggccccccagactctttgccaaacccttgtagccatttccacctattccaagccaccagtgaccttgcaattggacaaaatcgccagcagataaatggcactcaaatggaatggaattcagaagtctggagcagggcttctggaggataacagatgggaaggcagcctttcctccagcctcacattcccatgccctcgtggctttggtaaagtcagctgagctcctggaattcaccaagacccaggggaacaatgatgagcaagagttgtcctgggcctcgaggagcctgtagtccagtagagaatctgggaacttagataacctgcagtacaatacagataaacacacatatggaagtgtttaggccatctttcttcaaatgtaagggttttgcttgaaaatacagccttttgatttaaaaggtcatcagaaaaataggtgagaagagctaagaaaattttggaaaagagaaaactgaggaaggatttatactatctgatattggaaaattttgtaaaaactaagaatgagagcactgtgttatcggatgaatggacaatcagtgaaatagacagaaaacccaaagcaggtgcaagcccacttcctcactcatttattatttcactcagctccctgcgtgccaggcactaaattctgagcactgagggaaagcagtgaacaaaaaagaaaaaagaatttctgttccaagtgaggagagagacgaacatgtgaaaattatagtatgtgcaatggtacaggaatgctggtgagggccaggaatggctggaggtgtaaagaggtagccaggtaaggccttttgaagaagataatatttgagtcaagacctgagggggtgaaagaatgagccatgtcaatgtcaggggaagagcattctacagagcagtcagctcgtgcaaaggccctagggcaggagtaggcctggtgagttggagaaacagccaggagggccatgtgtctgcagtagaatttgaagcagaaagtagttcagttcaaggcacatttgctacttgcctgcctagagtccggcactgtcctaggcccaagggattcaaatacaatccaatggggaagacagtcacagatcaaagtaattcagtagttgggaggttctgatttagaggaaaggcaagggtaggtagaaggaggagacactgggaggtttcctggagagatggcccagggttgagtccaagtcttacctttctcattgaaatgatgctccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggtacgagactgcccttgtttaaaggataacccaggcatcattttaccccattcatttcagctctactttctgctttagacggaggcagagttcagacagattctaaagtgtccacagttgatctcagctaaggaagcagaggacagggcttgggatcctgaggtccaggggaggttacccgctgcgtccatcatcctcagagaatgaagccaggagagtggggattagagtcaaccataaagggtccagccaggctgagcaagtgctgccacgaccagtgggtctgtggttcaggtgctgatcagtttcctatttccccacctctgcttaaaggctgttgctgagccagcccatccagcccatgatgcccgggtcctgtgacgcaaggcagccctcggaagtcagcaggacgggacggcaagtcaagtacgtggaccctggcgggaggcaggaggcaagcgctggtggaatggttccaggctggccagactcacccgcctgggccagcagcactcacatgagccttgcgctaaaggcaaggtctgagtgtgcccacagctgtgaaggggacgctgcccctcagcttttcttctaccgtgtcccaattaagcagaaaaaactcagcgctccatgcttacagcagcactgaatgaaacaattcacaccccaccgtttgccatcatcttccgacttccttacacctgtaaagccctctaaagccctcacccctggagacatcccccttcccaaggaccctcccccaggctccagctgacatgccgcaggcacacttggtgctccgtgcttctggcaccgtgctcgggcccgtctctcccagacaagcagccccctctctgccttccccagcctcctctccactagcaccggtaggaccagaagcagctttactcagctacttaattactagggacaacggttactggagacacggggaatagtttaaaagctgctggaaaacagtttctagcccttgggaatgaggcagaaatagagctatcacacagacatctccttcatgttaacactggttgactttgtgtccagaactaaccaggacagtgctagccgatcaggcctgggatgccctcatgtagaagcctcgcaggcacccccaggcccctctccctagaagtccttcttctgtgccctccttcagccaggacagagagtaacggcagatggttactgcctttctgagggtcagggtctgtatgttcattatttaattttatcccgataaaaaccctagggtgtaggcacatgctcggtctttttttgtttgtttgtttgttttttaaaccagtgaagaggctgggctttaaaggggttagattacattctcgaaggccacacagtgcagatggtggggctggaggccagctaactccaggccacgggccccttgggctccctgaatcttcaaagtccaccttgttggccctgtctggggtctccctatgcctcaggataactttctaggcagcctctgcccctgagactttctggccctccctttggtcacaggagggtaaggagggacctgcaggttgtggggagccatctgtaaagttccgttcatgtctatcattaggtgggaggaagtgggctggttttgcttctggattttacctgttcttcctaaatgatccaaataagtggaaataggctgggcgcagtggctcatgcctgtaatcccaacactttgggaggccaaggcgggcggatcacctgaggtcagaagttcaagaccagtctggccaacatggtgaaacccccatctctactaaaaatacaaaaattagccgggtgtggtggcacgtgcctgtaatcccagctactcaggaggctgaggcaggagaatcacttgaacttcagtgctctgttggtgggaactgtccagtgctgcagccactgtgttaaatgtcggctctgtgtccccaccaaaatctcttgttgaattgtaatccctagtgttggaggtgtggcctggtgggaggtgattgatcatgggtggggacttcccccttgctattcttgtgatagagttctccctagatctgtttgtttaaaagtgtgtagcccctccccctcgttctcgatctcctcccggccatgtgaagttacttcctggttttttgataatcaccattgtaatgagtgtgaagggacatctcattttggttttgatctgctttgccctaatggaatggctactgatgctgagtatgttttcatgtgtgtgttggccatttccaggttctctttggagaaatgtcagccccaatgcccattttttgattgggttgtgtgggtgtcttgttgtggagttgtaggcattctttatatattctgttatcggtctcttattagatatgtgatgtgcaaatatcttcccctactctgtgggctgccttttccctctgttgatagtgttgatagtgtcttttgatggacaaaagtttcttttttttttttgctttgagacggagtctcactctgtcgcccaggctggagtgcagtggtgtgatctcggctcactacagtctccacctcccgggttcaagctattctcctgcctcagcctcccaagtagctgggactacaggtgcccaacatgacacctggctaatttttatttatatttttagtagagacgggggtttcaccatattggccaggctgatctcgatctcctgaccttgtgatccgcctgcctcggcctcccaaagtgctgggattacaggcatgagccaccgcgcctggccaaaagtttcttatgaagtccaacttatttgttttttctttgttgctcgtgcttttggtgtcgtatcaatactgctttcttaaaggacctgttttctccttcccacgtgaaacaggtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtgggtgccacggcccagggggcccccgtgcaggcctgggagccgggccacgctccacacccgaagtctcagagatattttattcccttgctttcaaggttgttctatccctagtatagaagtaagccccagaaagattgttatttgattgtttttcatgcttaaagtttatgaagtctatgtctacagagtacatgaaattacgagtcggctattatgccttatgtggttatgtgctaaaaaggttcttttttaaaaaagtagtttctactcaaggatttgcatcttgatatgttcacagtttttagagcaaaagtcgaaaaacattgatgactatgttggacttttcagtgtgtttataaagtcctatataaacataaagttaaatcacatttagttaaagatccattaacctgccttcataaatacagtgatgtgtgaaattgggcttgccaggaaaatttggagctcatttacatgtggtcactacttcgaaggcaaaaattacttcaagcaagtgccaagtatgtcaaaagcagggagggtgagagccactggtccgcaggttcacgtgggagccacacgtctgcgtctgccaagctgcagaagggcctggccttccctcacccatgtgcagggtgcccctcttcaccccagcccttccctgtcctgggggggcttcctccctggcctgcagccccacctgcacctgcaaagccatggagaatgagcagtagctgagacctcttgagtactgtagatagtgatgaagatagctgtccttgaagttctagaacgtaatttaattccagtgccgctaagccatctgtgctataattttcagatctccctgaccccacacatagtgggagtcaactcagactttggctttgcagatcttgtcagttctcgagacccagaagtgattttggatgggaaatgagcaacagacaagtttgcatgcacctgttgcagacaagatgcaggctatgaatacagagagcgcttcggcccactcactgcccttaggggcttggggtggggtgcagagaggtgggttagcacagaatgcagtcaggctcggatttgggaacagtgggagtgctgtggtggggaagcctttgtggaggaagggacttgaggagagggagggctcagaaggcacccactgcagagtctgatgtccaggaaatgcccgaaatgtgggtgagggtgaagataaagggacagtgttccagccagacagcctgagcaaaagttcagggcagctgtgcctgggcagctttgagagcaggggggtgctgggttacttgcaggaggagatttcatggaagggaatagtgggtgataagactgaagtttccaaagtcaggctttggtcagtcaaagcttctaaacttccaatcaagatgctcctagtaggtgctggtgaatctggaggtagctacgggatcagggaccagcagtgaaaagtgtacaaactgtatgtgtgtttggattctgccctgtcaactacctgcatgtggcctcaggttccatcatccaaaaacattgtggctacatgtagatcatgtgcacgtgtttacgaaaccattccccatagccatagccacaggcctcagtcgattgggccagaaggtgcccccactattggcggagaacttagcttcagaattcaccctaaggttcccttagtccccatccccaccacacccccaggtcttgccagagccacctctccccacatgaccccccaagaaagacagccctgtagtctaactcaacctgcagcatgccccgcactgccttgtaagacagttgaggagcggacatcagaaccacctctgaagccctttgttcttttttttctaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataatgccccggcactgaagtcgggacacaatcagctttaaccaatggatgaggggggtggccacaggagatggggagaggagtctgaactaaacccctggcttttgtgcacactgcatacgtttcagaactcctggatggtaaccatctctggagtgcagcgcttgctgcagtggaaatgatcaggaatactgaccgtgtttctcttgcctccgaggttcttgggcacactctatagccatactggacaggaaccaggtgccccgtgtaggcatcgtcggtcggtttgccgtcagagatggcgcatctcgctgcatcccccgagagtacaccggttgctctagccacctgcggcccgcccatctgcgctagctggccttcacgctcttgatcgtctttcctttgtattggagaaggactgggtcagagatctgttggagagagagaataaagagattatttttcattatttttaaatggttgtttttgttttaatttgcacagctacacagaggaaataacttaggcactttctgttttttttaaaaaaataataaggtctcatggcttcatttagagaccacagtaacaacagcagcccaccaatcagagaagctggttgttattaaccaagctacagattcacactttctggcctaaaccctaatgggatgaggcttttcaccccaggccatgctggtggtgattttttagcccctaaataaaacactggactatttcctgtttacttcattgattgcaactacaaaggtggactcaaagcaaagcacaatcatgccagccaacattccagaattctgctgagaactccaagtctgtgaggggagaggttttacaagccagacaggcctgggggactgcagtccccaaggagaccctgccacatgctggccctttgagtgagaatgctgcatctttctacatatcttcatgagaatactgagaattggattttccttttcaaaatgcactttgctttttttgtatgttttgttatgttgagatgtttctaaagaaaagattttatgtaattataagatgaagcgtagtgaattgtacagctgttgtaataatgacctatttctatataaaataaaattgtatggcttatgtgtaaattattttgtatctgagataccagttccttttcccaaatataaaagtataaaagttttcttgtgtttttctgtgagtgaaaattttgtaataaattaacaaatttgtacaatttcctctgtcccttgttatacatccctgcatacatcttttcaccagtaattctttttttctaatttcaagatgtttgaaggataatcaaagatacggaaaagatgaaagcaagccatcagctttttgagctgcaatatgtgcatcggcctatcaggttctgatctttgtgttaaagtttgtgcccgaaaaacaaatggtttactgtagaagtgacagcaaaacaaaacagaaaaagtttctggaaacatctcaatcttttttttgtttgtttgttttgagacagcgtctctctctctcttgcccagcctggagtgcagtggcacaatctcggctcaatgtaaactgtgcctcctggttcaagtgattctcctgcctcagcctcccgagtaactgggattacaggcacccaccaccataccccactaatttttgtgtttttagtagagacggggtttcgccatattggccaggctggtctcgaactcctgacctcaagtgatcagcccacctcggcctgccaaagtgctaggattacaggtgtgagccaccacacccagccaacatctcagtcttgacacaggtaaaatccatggaggtgaccaagacattctccaccaaagcattcatttatagcccatcattaaactcagcctggaattacatggggtttcgccaccaacacttagatatcagtgatgtgggcagcgtatgtgtgtctccatataagatgtgtgcacatatgccacgttgagggtgggggcatagccgcagcatctagaagatttctgccaactacagacagccaccccatcatgaggcttcatgggctgaaggagggtaccctggagtactgtggttgagaaccactgcaacggcaatgccccttccaaaagcattggcccaagagagcaaagttcctttccctgctgcattgctatggctctctgctcctactcctcccatgtagaatggggatggctcttcccagttctatgactaggatcagttttggatggcatgagagggtgccatataaatacatccaaaaagttttattactcacacaattgttctattcctgagaaaaaggtaagtgaaaatattttgcacgtactaaaacactaactctttaaaggaaccagaaatgaacccccttcttaaaaatgctttgtgaaactggattaactatttttaaatgttttataaattcaaaggtttctagatctgatttgcctgtaatagaatttgtaatttaatttgctgtcagcatttttttaagcagaacaagatttttaatggacagcatatttattgtcctaggattttctagctggaagtcattaaaaaagggcagagtgtgccttgctactaatttgatttagctttgcttaaatcttacacttgttcagaatttggataaactcagaaaacgcgtgtaatatttctttaaacccacatgcgtcatgggaagtttaatccctaaacttttgattcattaaagtttgctcattaaaaggctattttgcaaccctgtcctatttccagaaaaaccatgacctttctgtttgtaaaactataaagtcttggctcatgtgaaatgactgaaacgcgaacccaagtacactaagtttatgatcttttcaactaactcagtttactgtctctaattcaactaaaattcattacattaattttaaaatgttgtttgtgcatgcgacatggggaactagccaactgttctaagccatgacattttacactcttgtctaaattatctggtaaaatttgttttggtacaagactgctttggtttctctctttacttagtgtaggtacagcctgaaggtctccaagtctgccattaatgtcccagataaataactaatttggatcctctagagatacctgttagcagctttttgggcagacatgcattaatttcacactatgcatacaaacagctttatttttctggcaaaaaaagctcactggaaacacaaaacaactctcgtaggatttttccctaaccacacttaggcacatctatgatattgattcctttttaaaattacaattatcttttttatatttcgtgttttattttaagcatgaagttaggaactcatggccttttatggactcaacttttctaattgaccattgttatttatttcatgctcaaattggtacaacccggccagtgagagccagctcctgtgtttggctcttttctctttttagcattgcccatcagaaatcagattccagatttccttctgggaacaacacaatcaaggcccatactgatttatttatttattttatttttcctctctcaaagcatgcaggcgactaccctccaaggagtcctgattccttttaattaaaaaaaagagattaaaatctggacacctagagtaagactaagagctggtattgggtcaagcgctgcctctgttgctgttattgggtcatcctgttgtgatggagctgaaaacattttcagtcatgaaatcacattgatttctgcaatgtaatatatattataccgtagtctacttttctaatgtgattttgttcagcactttctcctaaactgacattccatatgaagtcagttatgaactgttgattttaatttcaaatacttcttgtgccattcctctcctttctgtcacattagttgctgcctcatttgggccccatttaggctgggtcacagaaacagcctccacactgacctcccaggcctggtctacccatactacctctttagcacctcttcaccaccacgcctctttccttgtaaaaatctttcggtggcgcttcttgggaagtcccattggaccttcctggagctcagtccaggatgaaactgccaaggaggactcctttagccccttaggtttgttgcccctaaagctggtggacaggaatgcaacctgtctactttcttgctgccccgacagggaaacattcagatcttgtttcattttatggattctctgctcatcagtaaaagtaaaaagacgtgagtgattagcccagctaacaaacaccagagagttacaaagttcctattatatggttctggtctcttccaggcccagtagtcactggcctggtccctggggcgtgggagggaaacagaagctggaagagtctgcagagccccaggcaggcaaatgattttcagtcctcaaacctaacagtctttattatatgtctgttcaacctttatgtaaggcaggagagttgacatcttagggggatgttttgtagattcccactggaaggatctatttatttcaacaagtggtaggatctactcacatttcgtcagttatacggaaacttgagtcagctggcaccagacttctttctgatttattacagtaacacttttactacctctaatggatggtaccctagaaagctgtcccttaatccctctctaggtgctgggagccagatagaaggggcaagatcacatcttcagagtgtgattgcagggagtcaggatcagaacaatgatcccaaaagggccatggggtatgaaaggcctgaggcaggctttagggtgcctgagcatgaggaagaggaggcagaaaggagatgagagcaagcatcatttggttgaaacaaattgtgccagcccctcttcttctttgttaacagaaccccacttctgtgcattaaaagcaacgtgtctatcttgtaatcctagcactttgggaggccgaggcgggcggatcacgaggtcaggagatcaagaccatcctggctaacacggtgaaaccctgtctctactaaaaatacaaaaaattagccgggtgtagtggcgggcgcctgtagtcccagctactcaggaggctgaggcagaagaatggcgtgaactcggcaggcggagcttgcagtgagccgagatcgcgccactgcactccagcctgggcaacagagcgagactccgtctcaaaaaacaacaacaacaacaaaagcaatgtgtttagcccaggccacaaaatacacaacccatcattaggccaaggtaatcgtgacaatcccatttgcttttggcaggcatgtgctctcccagcctaactgaaatggagtccctagtcctaaccaatgacaggcagaaatctactggaggtttctggaaaggcctttggagtctgataagagacatggggggaggcttccttgtccaccaccatctcttgcctttgaggactgctgggatacctagaagtgcaacatctaccctgatacaggatgcaaagattcctcatgagatcagagtccctgttccagccctgaaattgcctgcctccagtctcgtctgtgaggtcttgaaacatgtccattgctgaaaaccctgttagtaggttaggggtgacttggtccgggcattttcccattcaccaaagtgccaggcattaagtgggccctttcaacttggaacatcaagctccttcgttctgggaaatttccttaaattcaaggtaccatcgtcatgaaatttctgaactttaaagagaagatcctaaaatctttcagagagaaaaaaatgacgcatcacttctcaccacactgaaaaactgaagacaatgaagcctgccttcaaaatgctggggagaaattcttttcaatctagaattccatacaagccagaatttaaatttgagggttgaataaatactcaggtatttgagggctcataaactttttagctagtgtactcatcttaagaaaccactaaaaatggtgtgctcctgtgaaagaagggagttcgacaagaaaaaggaagacatgggtccatagatccaactgtctccgaatctctagactggtgacacgcagttcccagttctctggggacctcctcagatctccctgtcgtgtcatctcacatctgtcatctctcaggtcatatccaacacactgggccacccacgcacagggacgacgcgacagccctgtggctccaccgcacaggacagccacgactggcaatcctgtgccggccctgctcgacgcaagcacctccagcgccgggttgcgtcttagtgaccctgggaccgccagccaggcaccgcgcccgacgcaggctcagtcagtgttggtcggatgcatgaatgaatgggaaaaacgaagtctctctctccctggccctgctcccatacatctgtaggcctaggtcttggttttatccgaagacttagagaagggacgcaagttccttcgcggagccagaaggaatccgtcgagaagcgggacctcaagctcgcggcccaaaagcgcggccccgccacgacgcctgctagctggccccacttcggcgcgcgccgcttacatcatagctcgcctctccccttccctagccacacccccttgcctggcgacccggaagttgtacttgcaactgcggctttccttctcccacaatccttcgcgctcttcctttccaacttggacgctgcagagtgagtatgggtggcggagtctgggctcctggaatccagccccatcctcctttgggattgtgctaactgggaccgcaaaatctctcccgagccagcccggggctccggttgtggggagatgggaatacaccctgcttttaaaggctcccagagcctgaggaagaaagtgaccaggcttaggggagccggagcggcagggatttccgggtcggaggcatctgaggggcgcaggggcgcgggtgcgtgggccactgggtgaccgacttagcctggccagactctcagcacctggaagcgccccgagagtgacagcgtgaggctgggagggaggacttggcttgagcttgttaaactctgctctgagcctccttgtcgcctgcatttagatggctcccgcaaagaagggtggcgagaagaaaaagggccgttctgccatcaacgaagtggtaacccgagaatacaccatcaacattcacaagcgcatccatggagtgtgagtatccctctagccgccctgggtctcgaactcacgcgtctggttgttaccgagagatgtgccgaatcacctccaccccaatcttttcctcttgtggccttccctgtttcattcattggcaatttaacaaatcctgtgggctctaccctccgaatacattcacagtctgaccagctgcattggtctttctgaccgcccccattattctttcttagccgaatgcggacagcagcagctccctactcctgttcccttccctacccaaacatgcgtggtctattctcagatcctccatcggccttctatcttaggttagaaatcaagagttcttgccatgatcccacattggctgacccgcttaatcataccgggcatgcttttgtttcaaagtagctactttgttgaatttttaccctttttttccctatgcctgaatgttttttccacaaataaatgcttcgttgccttcagactttgagtccaatatcaccctggccatctgttttgttttgttttgtttgagacggagtcttgctctgtctccagcctggaatgcagtggcgcgctctcggctcactgcaacctccgcctcccgagtagctgggattaccggaccccgccaccacacctggcccaccttggccgtcttatagaaacttgcagtccccttccctaatgctttattttccctggtttgtctttctctgtagtactagataccatctgatgtactcaataggttgcttacataagctgtgtgaagaacaagggattgccagctgctgttatttctagtaccgtttacttctggatgttttaagtatttaagtgaagtgagcttgcttgatgggttcatagcgctaactactgccattcatcatactcaagaagcgacctgcctgcacacttcaggcccctgctctttaagcatagatgaagtcaatagcattgaatgatctgttccaaaaacatgtcctgtcttaagacatgacatttaatcaaatttagtattttgattgaggacttcagaaagtggattatgcatcttcttgtcctaagtgttatgctaattgctgggcattgcacactggtgggaaaaaaggattgttactgcctagtttaagggttggtttaggctggttttaggaggacataccatctacagtaagtcttcactgagctttaagcacactggcctactgtatgctgtaaaaacttggttttgttacataagacattgcttaaagtcagtttccaggagcctatcatcgacattgaggatttctcacatgtacctaatttagttttgtgctcctttaatttgttcacttatgtttgaatcgtaggggcttcaagaagcgtgcacctcgggcactcaaagagattcggaaatttgccatgaaggagatgggaactccagatgtgcgcattgacaccaggctcaacaaagctgtctgggccaaaggaataaggtgctaaagttatctgtattcgaaggtgaacttttgcaatgacaccagcttcacttaaccctgcaagagcccatatcagttcagtaatttggttaatgcatgtggaagtataaaaaaaaaaaatactgtgaccgtgacttagggtgtgtagtatctgcagggaagccccttaatttagtggcttatgaactgagacccaagggaaggagccagcagtgtagggtgggaaagagcattgcagagagaggaagcttggcaggatctgggagcggggtggtgaacgcaggtaaagtggaataaatcactgtgagcccagtggaggagggaggggtgagggtcgctctagacatcatggcaagtccaccaggagagaagtggttcttggcctgcggcagttttacctgtccttcccggggttgtggcgggggtggggggcagtgttttttgtcactactgagggatactgtgggccagggactactaaacatcctacaactcatggggctgctccctcaacaaaaaattgcctagctcagatgttagttctcatgttgggggaccctgctctaaagtggaaccagaaagcaggggaggcttgtgctgtaaaggacgtcatgaggtgccagaacagaagtggagtgaggggcagctagaggaatgatgacagtgtggactagttgattctggaaacgggttgggggaggactgtctgcatctgtgtggtatttaaaccttaggattaagtgagatgaacaagacagggacctgagacctagctcttctgtgggtggacattgaagggtgcagcaggagaggtgtcctccgatgcctgccttgggataagaggaatgggattacaggagccaagagaagtcctgagtttataggaatcggggcctagaacaatacccggcatcgatagaggaaagagaatcagctgtgatgctacggagagggtaagacaggacaaggggattgcatgtggaagatagagaaatagagtatgcgcctgtggcagagtttttaacactgttttttgttcgttttgagatggagttaatgttgcccaggctggagcgcaatggcgtagtctcagctcactgcaacctccacctcctgggttccagctattttcctgcctcagcctcccaagtagctgggattacaggcagccgccaccacgcctggctcttagttttgcatttttagtagagaggggttttaccatgttggccagggtgatctcgaactcctgacctcagatgatgcacccacctcagcctcccaaagtgctggggttacaggggcaagccaccatgccgtttcttcatattttaatgtaacagaaaaatcacgtaacaaagtttctggtgatagacaaaagactaacacatttggaccatttggacccagatatctgcttaggattaaccggttgggtatcaatggtggctaccttaacatgtcttcaaacaagcatccctcctgtggtaacagcatttaatgttcacctgggggttatgtttcattttccagggaactgtaagttctaggttggtcagagtagagcaaaggacagcattagaagcaggcatatgagatatgtgaatacagctagtggctgcttggttgaaaggaggcattgacttcagcaacacaattatgtttttattaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgccttcatgtttttgttctttttagttgcaacataatgtacttgtataccctatcctaattatgggatcatttgaagagcttttcccaaattgatggcctgtgctgccttctccccatcccctggggttttaaagtgatttcaaactgcaacctagttttagaaccactgttctgggtagttgggatactgaaggcatattgttaattattctacttgtatgttttgctaattctaagataagcatttttccagaaaccaggatgtagaatccagttgccattgacatcttaacattttaggaaacaactttaaaatgatatactatctatctatctatctgtagcatcttaaaggtaatgaaattaatgtggcagtaggtcttttaagcttctgcctacatccatatt

SEQ ID NO: 330 - DNA, 59509 bp, Homo sapiens
gcactgatttccaatggattggggctgatgggcggggtggggggccattgttgggagagcagaatatcctcatgaatagagtttctcagtgacactgttaacattttggaggataatcctttgttgtggggggctgtcctgtgcatcgtaggatgcttagcatctgctcagtagatgccaatgatattatctcagatgtgacaaccaaaatgtctccaaatcctgccaaatgttcctggaagacaaaatataccctctactccagtgtatagaattactgtactagaatatcagctttttgaaattgattaaatggttatactttctcttcccaactgctgatttgtagctggaattttaaaagtgtggtctttgacttacttggtaggtggtagcttcttaaaattgcaggttcctgagcttatcctagacctactgaatcagaaacgctgaaggtagaacccagagatctgatttttacaagacactaccttcccacccccaaccaggtaattctgccctaggcttgaccctcctgtggcataactgctgcattatctacatttttttctcctgcaagtcttcctggtgttccagctttgcttccgcttttggccccatgatgccaacacaaataaggaggcctcaggttaccaagacaactggagcacaggaaactgtacaggctcagtgctcccacaagcatcatggactgtgattatgctggcttgctttctccttagggactcagccatacttccttttccccatccccaaaactacccagactggcagagactgaggcccaagccacagatcctgatttcacagacctggtagtagatttatggggtgggtaggataaggaatgatgaatgaagctttccttctagcattgatatttcatgtcattttggtgataattgaatttgtaatcatgagaactacatttccctgggagttggttgttagatgcaagttttggaatcaggatgcttctctttatttattatgttatttatgcctgcttcactggaccttgagtcttagatgtttttgcatccctagctaaatgtctttacaatttgctttgggccaaaaggtttggcaatctacttctagtacactggaagcagctaatgttcagtaagaaaagaatatttttagggccaggtgcatggctcatgcctgtaatcccagcactttgggaacatgaggcagatggagtgcttgagtccaggagttcaagacctgcctgggtaacatgacaaaaccctgtctctacaaaaaagaatacagaaattagccaggtgtggtggtgcactcccgtagtctcggctacttgggaggctcaggtgagagaatcacttgagcctgggaggtcgatgctgcagtgagccatgattgtgccactgcacttcagcttgggtgacagagcaagaccctgtctcaaacaaacaaacaaacaaacaaaaaaccccaaaaaaacaaaaacaaccaaataatgaatttgggttctatttacacttagttatcaaagctagtcattttttaaaggaggatcatctggcttgattaaattaagtttccttaaagccacaaataaatgaaaacctacttgcacttagatgctttaaaatactgactctgactgggtgtggtggctcacacctgtaatcccagcactttgggaggccgaggcaggcagatcacttgaggtcaggagtttgagaccagcctggtcaacatggtaaaaccccccatctctaccaaaaatacaaaaaattatccaggcatgttggcacatgcctgtcatcccagctgaggcaggagaatcacttgaacctgaggcagaggttgcagtgagccgagatcagtgtgagattctgttgaaaaaaaaaattcaacttgatccaaaacaggagcaggctgcctccatggtatattcatgtcatgccagagcaagagcaagggagaatacaaggaaataaggcagacatgatagctctcctcagacaattgaaggactgtcatgatgaaggagcaattagatttactggtttagttccagaagatagattaagaacttttatttagtgatggaggacaaattttggcttgataaggaaattttgactcatttgaggaccccaaagtggaatgaactgaattgttaggcagtaaattttggccatattgttcatatagaggttagatgaccgtttgcacaagggtcggatgaggttttagacattaaattgggttcaacctgcaaggagaagcaggcagatttaggaaaagtcaattcgccctttttctgtcatatgattctgtggcactattaaattcattattatttttctaggcacctctgtcaattttaccccctcaagtaattgataatagagttgatagtaaagtctttagagatttctcaaactttgttcctcagccctctggagatttctgaaggatgcctcagaagtggctgagaagggtgaaatgaaggctagctggggctctgagcccttttacctatgcttcaaccagaacaatcttgcttttatttgttttacaaattaaacgtactggcttccttgaagattttctttttaacggaaaaaaaaaaacagttctgctgttaaaaaaaaaaagttaaaggctctgatatttcaaggtgttccttttattgaaagggaagctgagatacggaagaagtgtcttgccagaggtcacacagctagtaaatttcagagctgggattcaaatctagctcttctagttcaaatcttttgtttcttccactctacaagtctgccttgttagaattcaatgaaagcttctctccattctactggccaccactgtaatccagaatctcatttcttctaatttactattctgtattagccacttaactagtctccttgctgtctaattctgttctatattatatatactgttgccattttattcttcttggaacattgttttcgtcctgagatttccctgtttaagaaccttctccctatctcttagaacttttcaggctaaccttgtgttagcattctttaggatcctcattgttcagctgaatgagagcctaaatccatcctattatgagtaattaatgggctatataatagtgagattaacggagtccctccctattcctagacttcacctttggcaagattttcatgtgtacagttttaatcaggcatgacaagaagatacaaaagaaacagaaaatcacagcccataaaaagcaagttacataataatatgaataatacaatcctatttatatctcacatgcatgcattttttaaaacaagaatgagatatatagaaattgcctggaagaaaacacatcagactgggcgcgatggctcacgcctgtaatcccagcactttgagaggccaaggcaggcagatcacctgaggtcaggagttcgagaccagcctggccaacatggcgaaaccctgtctctactaaaaatacaaaaattagccgagtgtggtggtgtatgcctgttatcctagctgcttgggaggctgaggcaggagaatcgcttgaacctgggagatggagattgcagtgagtcaagatcttgccactgcactccagtttgggcaacagagtgagactccatctcaaaaaaaaaaaaaaaaaaagaaaagagaaaagaaaaaactcatcagactgatgacagacattaactctgataagagagattgagaaaggagagagaggaggggaggaagagggacttcctttttttactcaggaggctgaggtgggaggacggcttgaggctaggaggttgaggctgtagtgagccatgatcatgccaccacactcagcctgggagacagagtgagaccctgtcttgaaaataaaataaaataaaaagaagaagaagaaaaaagaagtgaagtgttttgttttcccacaatggagatcttttgaagcattatccttttgggaaaaagttaatttcaattcttagcacttggtctgatttttaaaaattcgacttaagctaatgatgagaagtgtgcatattcacactctttaactcctgtggattggataacaaattaacctccatttccactggacagagaactcattcttccggtatgtttcagaaggctaatggagcaaggataaccttatattactaatgggctgcttaatctctataatgatttgttggccagctactattgataacaaaaaatacttttaaataactgtttcaaaatacttttttcaactttattgaaatataatttatatacaggaagatgtacccatttaaaatgtacaattcagtgagttttagcagatgtatatacctgtgtaatcatcttcccagtcaagatgtagaacatctctgtcaccaccccaccactgcccccaaatttccttattaccctttgcatttactcctcactcattgcaatccacactgatctggtttctatcactgtagatttgttttgtagagtttcatgtaaatggagtcacagagtatgtattctgcatttggcttctttaactcagcacactgtttttgatatttattcatgtttttatgtatattaatagtttggccaggcacgatggctcactcctataatcccagcactttgggatgccgaggtgggcagatcatgggaggtcaggagtttgaggccagcctggccaacatggtgaaatcctgtcttgactaaaaatacaaaaactagccaggcgtggtggtgcacaccagtagtcccagctactcaggaggctgaggcaggaggatctcttgaactcaggagacagattgcaatgagccaagatggcgccactgcactccagcctgacaacaaagcaagactctgtctcaaaaaaaaaaaaaaaagaagtccatttttattgctgagcaataattcattgtatggacatacagcagtttgtttattcattcatctgatgatggatatttgggctgttttccacttttttggaagctgctatgaacactcacatttaagtctttgtggacatatgtttgcatttttttaagataaatgcctagaagtgaaatcttagatcctgttgtaagtgaatgttttacttgataaataaaagactgccagtttggtgcagtggctcatgcctgtaatcccagcactttgggaggccaaagcaggcagactgcttgagtccaggagtttgagaccagcttggacaacatggtgaaaccccatctctacaaaaaatacaaaaattagttgggtgtggtggcccaggcctgtagtcccagctactcgggaagctgaggtggtaggatcatctgagtgtaggaggcggaggttgcagtgagccatgatcttgcttctgcactccagcctgggtaacaaagcatgaccctgtctcaaaaaaaaaaaaaaaagttactgatttattcataaaataagataaatttttaaaaaagagaagtgccatactgttttccaaagagtctgtaccattttccacttaccagcattatatgagagttccagttgctttgcatccttgtcagcacttagtattgtcagtttcttctttctttctttttttttttttttatgagacagagtttcgctctgttgcccaggctggagtgcagtggcatgatctcggctcactgcaaactccacctcctgggttcacgccattctcctgcctcagcctcctgagtagctgggactacaggtacccgtccccatacctggctaatttttttatttttagtagagacggggtttcaccatgttagccaggatgatctcgatctgaccttgtgatctgcccacctcggcctcccaaagtgctgggattataggcatgagccaccgtgccggccttagtattgtcagtttcttaaaaaaaaaaaaaaaaaaaaaaaatctagtaggtgtgtagtgctgcctcattgtggttttaatttgcattttcctaatgtttaatgacattgagcatctttttatgtgctttcttgtcaccagtatctcatatttggtgaaatctattcaaagtatttgcccatttaaaaaactggaatgtttggcttcttgttactgagttttaagagttctttatatattctggatacaagtcctttgtgagtatatgaattaaaaatattttcccctaattggtggcttgcctttttattttctttatagtgtcttttgaggagcagaagttttaaattttggtgaagtctaatgttttgcttttttcttgtatggctagtgttttttgtatcctgcataagaaatcttcccttacaccaggtcacaaagatttttttcctacattttctcctatatctaaaagttttatgatttcagcttttacatttaggtcttttatgtctatgatccattttgatcgcatgcttaattttgttctcactgcacaaaagacacagtaggaaaggaagaatctggaataaagatgactgcctctttcaaaagacaggttgtagaatagaaatattaaacttttgttctgtgtattatattatcttcatctaatattgattaagtagtaactgttcagtagtaaaatatatatagattacctactctgagtcaggcactggagatacagtaatgaaaacactagacaatgtccttgctcccttggagtttatatttgagtgggtgaaattgtgtttttattataatgagcctccattgtatatacagtaaagtcaagaaaaatgttgttgcctctctgtgatttctcaaaacctcagttgaaggaagcattttagattgttggtaatcttcttaatattattgtatgatagagcatgaacctctttccaaaaagagtcactgatctgcagagaaaagggaatctggggctgcatacggccaactataatacaatgtgtcatgtgatagagcagtactgcatgcagaatcatatcaaatgatctcatgttcctgttactgttgaggtgtaatgaccagccttaatgctcttttctttggtttaagcaaattggtttttttttttttttttttttgccgaaagagttcattaatactacatttagagaactcttagatctcttttctgatagccagaggaccagataccttctataattagccattcatgtgttccttaaaatgagtcatactatgtgttaatgataccaccattcttcaagccacttcaagtatcaaaaataagttccatttactattaacatttataaactaataccaatattaaatagccaaataataaatagggttaaatcagagcaggatgagctctatgatctagtcttggatgatgagtaggatttcagtagatacaaataaagagggcagattaatttatattgatggatttgaggaaaaagattacatcagcaaatacgttattcatggcttgattcctttatcatctatccatagcagacatcattaaattcatcatggcattctttcttgctgagcctggacatagcctggtaagactagaactagataataggaaaagaaatgtagacattaagtggacatttgttgttgttgttgttttgcactctgtcacccaggctggagtgcagtggcacgatctcagctcattgcagcctccgcctcccaggttcaagcgattcttgtgcctcagcctgagtagctgggattacaggcgcccaccatgacacccagctaagtttttgtatttttagtagagacagggtttcgctatgttgaccagactggtctccaactcctgatctcaggtgatctgcccgcctcagcctcccaaattgctggggttataggcatgagccactgtgcctggccagattttttttttttttctttaagacaaggtctggctctgtcgctctgatgcagtggctcactgcatcctcccacctcaccctcccaagtagctgggaccacaagcatgtgccaccactcttggctaatttttgtgttttttgtagagatgaggtttcaccatgatgcccaggctggtcttgaactcctgagctcaagcgatccacccaccttggcctcccagagtgctgggattacagatgtgagccactgtgcctggccgtggacaggttattttgaaagagacatcagtgagactttatggagatgtctgaccctggaggtcaagatgtggggcattccctatgtgcaacagggaagcccttggcacagagactatgaagggtttctgttgcatgcatctgaggggtgcaataggtatcacaaccacactcagaaaaaatagtgccaggggaagatggtgcaatttattctgccagagggtaccactcaggctatctccaggctgagagagaccctggagttatactagcacagagctggaccatggttgccagcagagtaagcagcaaacaggggcaaaggaacattggcctggagatcttaagaagctagaggagcacttcctcaagggttgcaactttttcctgctgctatgaagtccccttcccctgatatatccagatccatctcaggtagataagcaggagaggggttgctatctgagagactgagcagtttttattcaggagagtctgagcagtacctaaaaagacattaaatgatcagataggactacgttaaactggtttgggggcttaagagggacaatgtaggcaactgtgaagatgcacaagaccttcatgtgagtagagggtgccctcagctcacccaccactttcgataaactgaggcaggactgaatgtggaatgaggcaggcctgtttactgtgtccaggagggactgattgggcccatttgagataagttaggtagcaagcggcctagctgagcagggggctaggtgcactcagctgcaggggcactgcgtgcccatgtgtacctgcctcagcaccaccagtgtcacagccctggctgcacccattgccaaggaagaaagaaccatgtggttgaaacacatctactgtacctggccctgtcagacttgggaggacaggttcttgtcttgttgtccttgatgctgtttccatcagcatccacctgttatctctcctcaccctgaggagctcaacccaccctgattttgtcattcattttttttctcattcgctcattcttttattgagtctgttatgccatgtactgtgctaggcactgaggacacagtattttgtagagataagggaataaacacacatgaatacaatgaagtttgagcaatattaagcttcagaaatattactgagaaaatacagagtcttattggagtacacatatttgggagaacatagtttgtaaaggaagtaggaaggtttgtgctgtgatctaataatgattttgaggtaatcagatgaaaagtcggaagaaagtttcaggcagaaggaacaacgtgcaaagatgagagaaattaaaggaacaaaagttcagtgtgtctagagtgtagaggatgaggaagagggatgtgacgtgagatgaggctgaagagaggcagggacctgaccatggggcaccttgaaattcaggatcagttgtttgtatttcatcctaagcacaatgggaagctattcaagagttttatgcagaggattgactttgccagcactgcattaaaaaaattaacttaaaaattttaatgtagttcaaatctgcatgtctggttcatttcagctccttcactgccaaacctgggggcagggactgcttcagtttctccgcctaagattcttaccagtactgcattttgaatgttttatagtgtgggttggagtggatcaacactagatgctgggagacaagttaagggattgttaattagtccagatgaaggatgatggtggtttgaactgcatagggtagaggtagtagggaagatagatttggggcatattttggaggtatgtccagcaaggcttagatgtggagagtagtgagggagatggagaattcaagaataactgaggtttttggctgagcacctatgtggatgatagtgtcctttgctgagtaggagaacactgggtgggaagatattttggaggaaaatcatgtgtcttgtttggatgttgagttcaaagttcttacaagaccatcaagtgaagatatcctgtgggcaattaggtatatgatttgaaagctgatagaaatggactggtgattcattcttggcacatagaaattggttattggagcaatgggcataggtattaccatggagagagagagagagagagagagagagagagagagagagagagagagttgagtggaaaacgaaatctagaatagatccctgaggatcatcaatcaacccaggggcaggtagagaaggaagggtcagtaagagactgagaaagagctgccagctggttggaagaaacctggacagtgtggtgtcatggagggtgtaccactacagtcagctgtaggggagtgttaagagtgtttggctgcactcctggagatgcttaggttacttataataattgaatgagtgagtaggctacagaggatcagaggagcacacctggagctcccagcctccgctaagcatctccctaataaatagagcagccttctgcctgtcaaatctgaagaaaacctgaactccaggaagtagcaggggttcagaggaaagaacaggtactcacacaggcgtattatatcttcagggtaaacctttaacctggtgaggtttggtaggatcagagtgaatttcagtctctggatctgaagcatcccattaattttgttgcccttttatcatttctagaagctgaacttaatttttttctctgtctttgcctctatctttgcccctctgattctctagcccagttgattctccttggctcttgatcttggtttagtttggctagcactccttttctgaggagtaacttccgtaacaaatatttatagtaacccctctgcttggctggcaagtcccggaaccagtgtccttacacactgtcctaaaaagcagtcagcccggagcacagccagctttattggcctagatatgattagatgcttcctttaccccttctggaggtgttagtggttctgagccttggaagttctgttctccttaaccatctccttctctcccgttttgcttttctgaaacatatttattagctagatgttaaggttagtagttctacccttcagtgaagattgatgaaaaattagcccaaaattgctgtcttctaattccaaaaatctataatctctatgttctgtgaattgggtctgaggctagctcttagcttatttcaggacctaaatttaacataccctgggtttaagtggtgggttgtaatttctatgtaggagaagcttaaggggagaaatctgattggaagagaagggaggcagttaggtttgccttaaagctgagtacacaagagtaatctggctgtaatccagctggctgggactgactgccagaaaaattaaaaaacaaagatgtgattgataaaaatgtgtactttgttcatgtaagtgagttttaaaaatgtagactctaagaccttttttctctatcttccgtttgccaattattgcatttacatagtttcttccttccttccccaaacaaggtataacaccataaacctgagaattttagacacatgctttgctcactttttttctatttatgtattatttttatttggtttgcttttgggggaggggaggcaggagttgccatttgtgccaacaactctttctcaaatattccaagcaatcttttccttggggagttgtactacacaattctattaattactgttgtgcaatattgagataccttacatatgtagcaacagtgacacatatgcccacacccagtgaaacaaggtcattttctactgtcagttatatgcatcaaggtgacaggtgacggcatggttatggattaactcaccaaggaaatgagtgtggaaagaagaatgcagaaatctgaggactagagcctggagatggggagcttcgagctcagaggaagaagaggatcttcatcacggggagacatcagctggatattgagatggaaggatgactatgagtatgagctattatagaaaccatggtaagagttttaagtagatgacagtaacatcaaatgtgactgatgtgtaactggaggaacttactgtcatatgcaaactaacaactccactgtattcttcttcatccagatcatttgtaaaaattttatactagaggccaggcgcggtggctcacggctgtaatcccagcactttgggaggccgaggcaggcggatcatgaggtcaggggatcgagaccatcctggctaacacggtgaaaccccatctcctaaaaatacaaaaaattagccgggcgtggtggcgggcgcctgtagttccagctactcaggaggctgaggcaggagaatggcgtgaacctgggaggcggagcttgcagtgagccgagatcggaccacggcactccagcctgggcaacagagcgagactctgtctcaaaaaaaaaaaaaaaaaaagttttatactagactattcaacaaatattttttgagctgcatactaactgtggtggggttgtataaatgagctataaagttgtgttttaaagtaatatgtcttcataaacaaatatgctggtaatttatacataaaactctcaaactttactggtgtatttgttaagtggagactacagacctatttcagtgacatttacaaaaagtcctttggtattcttttatccttgtggtaccttaaaaaaacccatatatagcttcttattgcaaaagtaatacataattattgaaaagtacagccaggcatggtggctcacacctgttaccccagcactttgggaggctgagtcgggaggatcacttgagcccaggagttcaagaccagcctgggcaatatagtgagaccttgtctctacgaaaaataaaaaacaaatagccaggtgtggtggtgaatgcctataatcccagctactcaggaggctgaggcaggaggattgcttgagcccaggaggttgagcctgcagtgagctgagatcgcactactctgtcagcctggatgacagagtaagaacctgtcttaagtaaaaagaaagaaaagaaaagaaaagaaatatatatgtataaattctaacacatactattcctaaagagacagtcactcttaacattttgatttatactgttccaggtttcctttttctttttttttttgagacggaggctgctttgtcacccaggctggaatgcagtggtgctatcttggctcactgcaacctctgcctcctggattcaagcgattctcctgccacagcctcccaagtagctgtgactacaggcgcatgccactaggcctggctaatttttgtgtttttagtagagatggggtttcatcatgttggccaggctggtctcgaactcctgacctcagataatccacccaccttggcctcccaaaatgctgggattacaggcgtgagccaccgagcccagccccaggtttctttttaaaaattatttatttatttaatttttaaaataaataaaagagatggggtcttgctatgttgcccaggctggtcttgaactcctgagctcaagcaatcctcctgccttggactcccagtgttggggttgcaggtgtgagccaccacacctggcccgtattattatttctgaagatctttttatatgtgaaaaaacaatccattgttatttcagttttatagccactttaaaaaatgtgtattggtgcacaaactttattctctgatgataaatttcattaaaacagtcaaaaattattataagttggttgaatgaagtgaatggttaatctgggttattccggttttcgttgaatgtacatgggactctgaaggggtcataccccagttctaccactgctgggtcctcaggagactcagcctcagcaccttgctcccccatggcagcaaacgcctccctccctgagagactgactgtgctcagctctggtcagggcaggctgcacaggccttttgctggatgacccggtaggcagactaagtgtgtgcctttagggtcccagcaaagcagtggtactaaatagatttggaggaaaggatgttgctgtgtttttaaaaacatggaagtacttggccgggcgcggtggctcacgcctgtaatcccagcactttgggaggctgaggcgggtggatcacgaggtcaggagatagagaccatcctggctaacacggtgaaaccccgtctctactaaaaatacaaaatagccgggcgtgttggcgggcgcctgtagtcccagctactggggaggctgaggcaggagagtggcgtgaacccgggaggcggagcttgcagtgagccgagattgtgccgctgcattccatcctgggcgacagagcaagactctgtctcaaaaacaaaacaaaaaaaaacatggaaatagttactatggggaaatttgaatttattgattttatttttatttcttttttggaggaggggagtactataatcttttcagtgtttttggtttttatacaggtcaattcccctctttgactcatcccaaattttggtggggggggcttcagtcacatccttgtctttttcagcagcctcctccccatattgtctcgaggattgggaagcaggaaatttataatacccttttctctctgttttctccaaattcattttctctcctgtgttcctttgggagaaaagggaaatcagttctgtctcttcactcctctatattactccatctggatggacccacactgatagcagtgaaccttgaacttggcagttttggagccagggtctttgccctcagtgcagtaaattcatttttttttgtttagctgccagatttagggtccaaacaggaaaacagaactcactctaagcatttaaaccagagggcatttaatccagagaattagctggctgtgaatatggtggaagagctgagaagcctttcaagggaaggtgaggcaatgcaggggaagattagcaaccgaaccttctattctccctaggctgtgggaaggaggggaagtgcaaggggcagggtaacttagaagccggaactttgggggcctgttctagggaagctggggccaaagagtgcctgtccagatgctggccaaggctgggagagaaggggaagagatagtctggcttctctcgttcagttttctgccagtgcctccctgactgagctcagcaggaagccatctgtggagggaatgggaaggagcgccaccatttactacacacgcttccacataagcttgcgtttgtctcttcctagttagtacacttcttaaggatattgaactaagttgaacagtttctcttttttggtcatatactactgatcagctcttcttattagacttttcaatgaagagatgaaaaatttgaaaacctttacacagtgtaaaaacaagcaaactcttttaaaaaaatttttgctttactcttccagaatatggtcccaaactgctgatggtgggatgtagttcaattttggatatgacggacccctaataattaccataataatggacatttatataatgctttacaatatacaaggtgcttttacatttattgttactgcaaataggtcttaatctggggattttggagcctgtttatttgacctctaacaggttagcttaaggcctagatttgaaagaaaaaaacagtaatgctcttttcttgttttcctctgaatcacagatgataggcaaacttctttgacctttttgttagacagtttagctaccctcagtagtgggaggtgttcttagctgtcactggtgggagaggctggcatcaaattactcctctgtttttctctcttggtgacccagcaggtgtttaggacaatgacgactactcatgtggaacctttgcagtcatatagatcatgcctgttgtttttggcctattctccttctccttcttcttcttttttttttttagatggagtcttgctgtgtcatccaggctggggcgcagtggtatgatctcggttcactgcaaccttcacctcctgggttcaatcaattctcctgccctcagcctcccgagtagctggaattacgggcgtctgcaccatgcctggctaatttttgtattttcagtagagacagggtttcattatgttggctaggctggtcttgaactcctaacctcaggtgatctacctccctcggcctcccaaattgttgggattacaggcatgagcaaccgcatctggccccctattctcatctaaataaatattttatttctttattttcaaagtgtcatccttggccctcaaggaagagtctaagtcagccctacagttcatcttgtctagtgtttgatcaagatttgctttgtgggccaggcgcggtggttcacgcctgtaatcccagcactttgggaggccaaggtgagcagatcatgaggtcaggagatcgagaccatcctggctaacacggtgaaacctcgtctccactaaaaatacaaaaaattagccggacgtggtggcgggcgactgtagtcccagctactcaggaggctgaggcaggagaatcgcttgaacctgggaggtggagcgtccagtgagccgagctggcactactgcactccagcctgggtgacagagtgagactctgtctcaaaaaaaaaaaaaaaatttgctttgtggaaaatcaaaataattgaatttattcttgggccagatataccccaaccaatcttagctttgtttttatgacattatacatgaagttatctaaatcaggtgtttttcttttttttttttttttttttgagacagagtcttgctctgtcacccaggctggagtgcggtggcatgatcttggctcactgcaagctccgcctcccaggttcacacctttctcctgcctcagcctccccagtagctgggactacaggtgcccaccaccatgcctggctaattttttgtatttttagtagagatggggtttcactatgttagccaggatggtctcgatctcctgacctcgtgatccaccctcctcagcctcccaaagtgctgggattacaggcgtgagccactgtgccaggcctaaatcatgttttgtggttttttttttttttgtacttgtttctttcatttatttatttttatatatatagagagagagatagggtcttgctatgttgaccaggctggtttcaaactttggcctcaaatgatccttccatcttggcctcccaaagtgctaggattacaggtgtgagccaacgcgcccagcctggtacttgtttcttgtaagatgttctagttctaactcttcttcttcagacctactgatcttggattatactttttgtaatactttatcttttggttccaaatgactggttttcagaaaagccttcttagctctgatgttaccgttctgccctttgatgtttttaatctccttgctacagctatgagggattcaccatgtgtgtttatctattaaaagaaatcccatctttccctttgaggtcccattgccatcctttaaaacattcaagatatcaagcaccccatatcaatgacatatttttatgctttcttgtttatgattaagattcatttttaattaaaaattttgaataggtcatacttgcacacctgttacaaaattaaagctatacaaaatgggccaggcgcggtggctcatgcctgtaatcccagcgctttgggaagccgaggtgggcagatcacctgaggtcgggagtttgagaccagcctgatcaacatggagaaaccccgtctctactaaaaatacaaaaaaattggccgggcgtggtggcgcatgcctgtaatcccagctactcgggaggctgaggcaggagaatcacttgaacccgggagacagaggttgcagtgagccaagatcatgccattgttctacagcctgggcaacaagagcgaaattctgtgtcaaaaaaaggtatacaaaatgatagataatgaaaaaactgtctctttcatcttgccctttagataccttgttccccttcagggaggtattcgctgttaacagtttccagtccaaaagctacgttttaaagcataattaaatttctggccccttctctaaagtccctcaattattaatcatattaactctgtagaaggatgtatcacaacattatactgaaaaataagctgaatatacaaaagtgttcaagcagtcagaatactttggaatataatatgacatgtcaaactggtgtctgacatggatggcttctgggtggatgcaagtccctaaatgtccagccttccttttgtgcattggctttgcctgcctacatacccactccctcctctcgaatgcacaaataatgcacattcgccttcctgtttgctttctcttaagcccaaggcttgttaatctgggatcctttagctcctagatccacgtgcacctgaaatgatatgtaaaatgttgtggaataatatgtatatgtgctttttatattttaatggggaaaagagagtatacatggctttcatctgatgttctatctccagtctatctctgtcttctttattctgcctgaactttcaaactcctggttccttctgtcactcaaaagatgactttgcttccccattgaggaatgcagttgagctccttatttcatataaccttcccttcatttcaatatattatagaggatgttgagtaaggtttttttctattgccctggaattggtgactagggtccaaagctgggacaaagaggactaaatactgcacgttctagagagagttgctaataattggatcagagctcctctccagggcttacaaagaggtagcagaagtggccctgcaacttccagccaacccataccttaccaccccacctccattcccaggctatataagataaaagatgactgaagggaggctgtcatgagcctagcagggagtacttttccctcctttccccccttaaagtaagcaagggagtatgaaagagatctacatgaaagagagattgatttctcattccttggttaaactatctgtttagacagtggatttgttcagctccgcacctgtctgagaagaggaaaggcaattagagaaaggaggaagggcagagtaaggggatagtagtggaatagtctgcattcattctgtttggcttagcaagggtatgtgagtttctgtgatcaaagggacactgaggaagatcgccgggcttgagccatcatgctggtaacccatccaaaaggctgccactgaacagaagttaggagggttaaagagatggcttggatcaggattctctgcattagggcacaactcagtggagaagcccagtaggaccttctaaagaactcacataactgtctcataagagagccagcatctttttttttaagatggggtctgttgcctaggctggggtatagtgttgtgatcatggcttattgcagcctgaatctcttgggcacaagtgatcctcctgcctcagccttctgagtatctgggactgcaggttatgtgccaccacactcggctaattaaaaaaaaattttcttagagacagggtctctctacgttgcccaggctggtctcaaactcctgggctcaagtgatcctcctgcctcagccttccaatgccttgggcttacaggcatgagccaccatgtgcaagaaagatagcattttgacatctgccaaacaacaggttggcatggtctgtcagcaaacagtggtttgtgataactaccttgttaaataaaaagagagttgttcttttcctccctgccctcctcctagttctcaaccaccaaggagctaaaacccttctagagaaccttccagagaactagaagaggagaagcagaatcaatagaagggatcatattcttctctccaccgcaggttccttaagccatggcttaagatgagttctgcattggacctgagactggagttttaagccatatcggactgagtctttaaataaccaaaagggagcagagtgttatggactctgaccatgatgttgtgaagaggtacaaaggagacatttgtcatggcacagatgaagactgatgggtggcaggttatgtttatacctgaccaagctcaatgctcaacagataagttaaatttatccgtcacgaaatctatccctgaatccattgttccacctttccctgcagtctcagaggaatttctttttcttttaaagtgaatccctggctgggcacggtggctcacacctgtgatcccagcactttgggaggatgaggagggtggatcacttgagctcagcagtttgagatcagcctgggcaacatggtgaaactccatctctaccaaaaatacaaaacaaacaaacaaacaaacaaaaaacaaccaggcgtggtggtgtgcatctgtggtcccagctatttgggaggctgaagtgggaggattgattgagtctcgggggatggaggttgcagtgagccaagatggcgccactgcactccagcctgggtaacagagtgagactctgtctcaaaatatgaccaaataaataaaaataaagtgaatcccttcatccatactcatatatccattgagaaaacatttatttgaattctaaaatatactgccaatgtaaggtacaaagattaaggacgataaaattccttctcatggaatacacaatctaatggggcagaaagtacctactttaaaacaaatgtattaaattaaattgaaaagtggcctgagtaagcctcaaaaaagactaattagaactcaagggaagagaaaacatttcaggctgacagaaaacccatgggcatagaataacatgacccacttagaggactatagatagctctatatgtttagaaggcatatgtggctgcagaggaggctggagaggaagatggagccaggaccacctggtggactgagattcttgttctccatcctgcaggctagtggctctgaacagcagtagtacttttcctggaggggcattttggtccgtggtgggtgcgcaggagatagtgggggtggggggagggggtgggggggcaggcaggagggggtggaggggaaggggcattttcttggttgctatagtgatgagagtgggtgctactggcattgtagtagttggaggccgcagatgttagactctgcaatgtgaggacagttccacataattaagaatgtattccatgagagaaggaatttcaccttgttttggttgttaatccttgtaccttgacactggcaataccttttaggtgtcaaataaatgtcctgaattcggcatgatttagatatcctgagttctgcacagtcttcaaatattccaccaaacagttgtgtagggtgttatatataaatatatatataaatacatctgttctgttattgcttatcctaacactggtgtttaatccagtatctttctttatggagtggcttcagatctcttaaatcaaaatttattcattccctgtaattagatggaagcatctaattacaattagctgagtgcctcctttggtgttctatcacagttatatccaaccatttacatattgaaatacctgtttttaaaataagttattgtcttttatttctctcgtttttttttttttttttttttgagatagagtctcactctgttgcccaggctggagtgcagtggtgtgatctcggctcactgcaacctccccctcccgggttccagggattcttgtgcctcagcctccagagtagctgagattacaggcgcctgccactatgcccggctattatttctcttctatattacaggtaggaaattttattgatgttttgaaattatgtgtagagataggttgtattatctatgcattttattttaagttagtaaaggtgccgttagaaaataattattagaaggaagatttaggtttggtagcatcaagagtcattgtttagtcactgattttcaaagtgttattttgagctgcagagctcaaatatttttgttcatgagctccttaaaataaaacactcacacaattttaaattgaaatctaactttattattacaaggttttttgtttttgtttttgttttttgagacggagtctcgctctgttgcccaggctggagtgcagtggcacgacctcggctcactgcaatctccgcctcctggaatcaaatgattctcctgctcagtctcccaagtagctgggatcacaggcgcgtgccatcgcgcctggctaatttttgcatttttagtagagacggggtttctccatgttggtcaggctggtctcaaactcctgacctcaggtgatccaccctccttggcctcccaaagtgctggaattacaggtgtgagccaccacgccaggccagataaaacagacttttaactattttattgaataaagtacaccaactatgaaataagttacttaatttttttttttttttgagactgagttttgctcttgttgcccaggctggagtgcaatggtgtgatctcggctcactgcaacctccccctccccggttcaagcgattctcgtgtctcagcctcccaagtagctgggattacaggcatgtgccaccattcctggctaatttttgtattattagtagagacgagatttctccatgttggtcgggctggtctctaactcccaacctcaggtaatccacccacctcggcctcccaaagtgctgggattacaggcgtgagccactgcgcctggcccttaatttttttattcatttattcatttattcaacgtagctgaagtatttttctgcttgtaaaacttttcagtttaattttctctttttattttatttttaattgacaataattatacatacttatgaaatacaatgtgatggatacatgtatagtgtgtaattatcaaattaagacaattagtatctcaaaaatttatcatttctttgtggtaagaacattcaaaatcctctcttctagctattttgaaaaatacaataatattgttaaccaaagtcaccctactgtgcaagggaacactggaacttactcctcctgtctatctgtaactttgttggcccacctcaccccatctacccctcctgcctatgcttcccaacctctggtaacaattattctactctgtacttctaagagatcagtttttgtttttttttttagattccacatatgagtgagatcctgtggtataatgtcctccaggctcatctatgctgctgcaaatgacaggaattcattcttttttatggctgaatagtattccactgtgtaaatataccacattatctttatcattcatctgttgatggacacttgggttgattccatatcttggctactgtgaatagagctgcaataaacatggaagtgcagacatttcttcaacatactgatttcatttcctttgcataaatacccactagtgggattactggataatatggtagttctatttttaattttttgagaaacctctatactgtttttcattatggcgatactaatttatgttcccactagtataaaagttctcctttctccgcatcctcatgagcgtttgttaatttttgtctttttgataatagccattccaactgggatgagatgatatctcattgaggttttgatttgcatttccctgatgattagtgatattgagcattttttcatatacctgttggccatttgtatgtcttcttttgagaaatgtctattttgcccatttaaaaatcatattatttgggatttttttttgctattgaattgttgagttccttatatagtctaggtattaaccccttagatgcatagtttgcaaatattgtcttccattctgtaacttgcctcttcattttgttgactgtctcctttgctgtgaagaagctttttaatttgatgcaatcctgtttgtctatttttgctttggttgcctgtgcccagtccaatgtcatgaagggtttttcctgaatttttttctaatgctttcatggttttcagtccttacatttaagtctttaatccattttgagttgactttcgtaagtgatgagagataggggtgtttatttatttatttagagacagagttttgctcttgtcgcccaggctggagtgcaatggcactatttcggctcactgcaacctccgcctcttgggttcaagtgattctcctcctccctcagcctctcaagtagctgggattacaggcgcctgacaccacacctgggtaatttttgtatttttagtagagatggggtttcaccatattggccaggctggtctcttggccaagctggtcttgaactcctgatctcgtgatccacccgcctcggcctcccaaagtgctgggattacaggtgtgagccaccgtgccctgccctatctctatatatttttaaaatagaagacagggtctcactatgttgcccaggctgaatttgaactcccagtctcatcagatcctcctgccttagtcttccgagtagctgaaactacaggcacacaccacccctctcagctgaaaacaccccatttctaatgccaagctttactcttcacagaatatggatatggtggggaaagacaggaagccccattcctttaagacactttgattcaccttcacaagtttccccagaccaatacttgatttatatatcctttttcttggtgctccaaaggtttttacaccctaaaataattcatcataataaaatttggcttggggtagggacatgcctttctgttgtaaactgggagggttgttgtcagcacaactgttgtgagcacaggtcattctcaggcagaacagttttgggactgagtacataaggaagttcagggtctggagatggattcccttaaagccatctggacaaacatagtccttggaaagcctttttgtgctactactgtttgaaggctgctgcgcagaggttccctgaaggtgcctcaggggttctgtttgagaatgaggtgaaggcgaggggtttctgggcccacccccactgtttcatctggagcagctgggcttttttttttttttttttctgttttacatgtacattttcatttgaaggaatggttttgctgctaaaaataacagtgtgaaaaacatagcctccaagggggaccatttaaagattttaagcagtgatgtgacataattaggtttttgtttcaaaaggtcgctttgacacctgaacacatcgtggaggctggactggagggaagtgagactggagagacccagagagaaggcagagcaagaactggctactctgggctccatcccagggtcagcatccactttagatggcgccggggttcacggcttgccagtctccacctagctgcttctcccattcatatttcctgcctggcccatgaccacctttgcctttgcaacccctgcctttgactgtttttcgtcttgtatatccagtcggccaccaaattctgttgtttcttccctcagattacctcagatttgttcctctctccattactatcccatcatcctagattagacacttcaggcttgggtttctccaggaacctcttcacggttcttcttgctttcagtctgtctgcccaccaatcttacatcgccactgcttagcttctcttggttcttcatgacatattgcagtacagttttgtacatttttgtttcagatttctcctcttcttcccagtctttggcttctgtagaaaattctaagcagagcagaagattaaaatagtgactagtgcatttccagtctctagaagcagtgataaccatgtttcctttgcctctttttatgccagatatttgtagagttagcaggacttaaaaggcaaggggacacctttccctcttgccacttgcctcttgccactttttcctcagtgaaagattttgtgaagaagtggaatttcaagttgagtgggtaagattatttcagggaatattatatttgagacttcatgctatcggatgctcccaaagggtggtaaataactactggggttggtaataatgatgaagggtggtaataggaaaatagggaaactatctatgtacctaggaagattcttgggccaagtgtgagagggcagagaagaactggggccttcctgggcactcacagaggtgctggtccaggcccagatggagcagacaggtgaaatatggttcacgtggagcttgaatcatcaaggaaataaatgtatgtggttgcttctcctgacaattcttaaatttctctcttaggaatctttggccatctatgaaacaatttccatgggaaaatgacttgtttggactgtattttcacaaagctgatatttctggcccttagaatatgatacctgtttgtctaaaaaacatatatctattcaggtaagttggaaactgagatctgatttgaaaacattttgggctgggcgtggtggctcacgcctgtaatcccagcactttgggaggccgaggtgggcagatcacgaggtcaggagatcaagaccatcctggcaaacatggtgaaaccccgtctctactaaaaatacaaaaaaaaaaattagccgggcgtggtggcgggcgcctgtagttccagctactcgggaggctgaggcaagagaatggtattaacccgggaggcggagcttgcagtgagccgagaatgagccactgcactgtagcctgggcgacagtgtaagactctgtcaaaaaaaaaaatttttttttttaaataataaattaaaaaaaataaaaaagaaaatattttgaacttacaaagatgtatatgaattcaaagtaaaaacccttgaccctttaaacaatcacagcagcgcccaccgctgccccctttttttttgagatggagactcactctttcccccaggctggagtgcagaggtgcagtctcggctcactgcaacctccacctcccagattcaagcgattctcctacctcagcctcctgagtagctgggattacaggtgcctgccaccacgcccaggtaatttttgtatttttagtagagatggggttttgccatgttggccaggctgatcttgaactccttacctcaggagatctgcctgccttggcctcccaaagtgctgggattacaggcatgagtcaccatgcctggcccacagcagccctttgaggctgttgaatatctgtgagaagatgaactggatcttagatctacaaccatactgtgcactgctgcgtggctgggagggaagtaggagttggaggggaactggaggtttgacctaatttcaggattctgtctctcccttatggggctaaaataaagaatgcagaatttgagtaaagtctctatttgctttctatatactttgctacatttctttttctacattactttctccttttctattgagatgtgttgtgaagtgtatctttcctgccttatttgatctacctttctatggctgttctctgccctctgttggcaggttctcttggacctgtccgtctgtgtgcaggggacaattgcatggagtcaaagcccatttctgctagtcaggtcagcagagaagatattttgttttctggaattctgtaggcctgggaggcatgatctggtgtagaacaaacctgaggatccagattcagctgcacaaataggtttgttataaaacgtttaatgctgtcagtttggggcatcagagcctatcacgaaaattagcatgagcccgaatcccatggtggttgcagagctcaactagggtcttgaggcacctttggcctgagtgtaaccaggattaggatttcttttgaagaagggacagggcagcttggaaaccataggagattctagcagctggccaatttgatgctctgcagtttagttctggatcagaaataaggtgtttggggccgggcgtggtggcttacgcctgtaatcccagcactttgggaatctgaggcgagtggatcacttgaggtcaggagttcgagaccagctggccaacatggtgaaacgctgtctctactaaaaacaaaaattagctgggcatggtggcgggcgcctgtaatcccagctacttggaaggctgaggcaggagaatcacttgaacctgggagatggaggttgcagtgagccgagattgcgccactacattccagcctgagtaacagagtgagactctgtctcaaaaaaagaaaaaaaaaaaaagaaaaagaaagagggtgttgattgaccctatccagaagaaattatagctggtatctgtttgtggattagaagaaggccatgacagtgctacaaagagaaagttggaccctagctggttgctgcttaggccagtagaatctagatttcctaggttttctatgtattgcagcatggtcaccaaatacagccaaaatattattgcccatatcaatgacagcagtgatagcttggatagtgggatatatacataaccgaagttctcatttatttaatattttcagctttccctcaaacatgaaaaaataaacaccaaaagcctttcactgtgtgttaataaaaaacctcattaggggatttatcttttatctccccactccttcccacttcccttttgtcttttaaattttatttttagtttttacttatgttttcttttcctttctttctttcttttttcttttgagatggagtcttgctctgtcgcacagtggcgcgatctctgctcactgcaatgtccgcctcccagattcaagcggttttcctgccccagcctcccaagtagctgggattacaggtgcccaccaccacgcccagctaatttttgtgtttttagtagagacgagatttcaccttgttggccagcctagtctcgaactcctgacctcaaacaatcctcctaccttggcctcctaaagtgctgggattacaggcgtgagccactgcaccaggctccttccacttcctttttttttttttttttttttgagacagggtcttgctgtcacccaggctgcctctatcctctgggatcaagcgatccccccacctcagcctcccaagtagctgggaccacaggttcgtgccaccatatctgattgatttgtttggtttttaatagagattataggcattacaggcaagagccaccgtgcctggccccttcctactttctagttaactggccaactgggaggaaaagggaaaggcaagatgcttgaatgtttaatccctaacataatgaagaatagtccttaatgttcagaataatgacatatgatgcacttgtacttgcgtaggagtctgggtgacagtggtggctgatcctcactgagggctgcaggtgttccagagagacttgcctgggtttggtggctattatattgtaagcacagctttctacagtaagttccatgagtcagcaaaatatctataaagagcctctccttggagaccatgaaacctgcattttaatctctcttttgcaactaaaaagccatgtgggattgggggagaggagcaagtaaggacactgcgaccttcctctctgggatttggttttcaattatctttaaatgagagggctaaacaatatatttatatgatcctcttagccctgccattctgtaattctttcaggaattttgtcattttggatttgcttgtctcataaaacaatgtgtagttgcttaaaaatcaactattctatttggttgacttggtctaaagtatttctcatgttgtctcgtcattcttttgactgttccttttttttttttttgccttggccagataggacaaaattccttttcactgcagtattgggagcctggaactagagttaccaacccctctgcgttaaagaaggagctgtcctgaggcttccatctctactgggcttgaggcaagaacattgttagggacggcctgctcttggcctctgtgccccagggattgcaaatgcatgttcctcaaaggtaagggctgtatcattcggctttctttgtattcacaggtacagcttgtgctaggcagccggtgttcaataaatatcgtgcctaaggataaagtggcattgtccttaatttcccccaccaaaccactaggtgtcgccttcatctcagggaaaccatgcccgtcctcgccctatacactcccaccccactccagggctccaggagcgctcttagcttgtgatttctggagaaatagcttgaaggggggagagaaaccgtggctcttagcgcgggcagagaatgggcttatgtgcatgtcctttatgacagttggagaaaaatccccaaggtcccatagcagtccctctcagccaccatgagatcatccctcacaagctgttcttggggtcagattggcactccagatatgagggccctagggagagcttcctaagggaagctgggagcaaggtggaaccccaggagagcgtggatgggcttccactgcggggagtgtcccgccggtccgttacaggctttccccaggcgccagcctgcgctgtgcaggagacaaaagaaaatcgaggccctgactgagcagatggtgcggaggaagccgggcgggctgcggtgggcctctgaggacacgaggagggcagggggcatggagacagcggggggccgagagttgagtcccaagcaagaaggagcctcgtggactttctaaggactggtgggaagtgtacagcaggggcccctggctgctggaggggcccgtccagggagcgggcatggtccgcggtggagtaagccgcactgccgtcgggagggcgctatggtttgctaggtgagggggctggtgaggataccacacgtctggggatcctcgactgcttcctggagactggaaccactgagggactcagggagttcagaggggagacccaagaagaacgggctgagcgagggggagaggacaaaccctggggtcgctggcgtgtgtgagatggaaatggaaggaggggcggcagggggaccaggggcgtgggggagaccagggtaggccctgagagtgagggagcgcccgggaaccctgctggccggcgaggccttggtgcggagcccccaagtgctcaccggggtgggtttgggacctggcggtcccgagcgcccgggtggggggtgggggaaggcagccggcgccggagggtggggccgggagggaggaggagaggcagcgggggaggggcgggggcgggcggcctgcccgggggagtcgcactcggccgccggcgcagcgagcggagacgggccgggccgaggcgacctgacccggacgagcggcgcgcgcggggcccaggcggggggcgggaggaagcgccgggcagcgccggccgccagggcccaggagaagcggagcagagaggagcggggacacgggcggggccgccgtagctccggatgggaccagcgcccgggcccgttagtccaagcaggagctccgggagaatccttcacagggagatttacccctgccttcccctgccctccggcccaggcctcgcttcgctccccgcctgcccatgatcccagtccttccgcggcgcgggcaccctcccaccttacccccttggtcctatgtggcgcagcgccctcctgccctcccggccctttcagctgtgaggttcccccaggccgtttctttgtaccacccgccccccacccccaccccatcccagtcccagatccccttttccttctcagctttagatttatcaggcttcttcacctcgcactgtccccatcctggccgcaggccccctcggtccctccctccccctgccaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcagtgagtgtggcctgggctattttagggtcatgggaggagggtcgctgtgtccctaaagctcagcactggggaactgtagatggagataggcattgagcagctgtatgtggtggttgggatcaagaagcacacgtggacagagcacctgtgagagggccaaggcttcatcatgggagcttgtgaacaccctaggcagatgcaaacaaggaagaagagagcatgaggggtgaagccttgtatcaaggtggaatgtgaaaatgaggggatattaagtttcgggagcaatgtttgtgccctagagtagtgaatgtgattgatagccactctgaaatgtgccctgtctgtgatcagagctaccacccagactgggcgccaagaccccttggtggtgtaaaaataatgagggctccatgaacggactcagggctcagcagatttgggaaagacagataaagctcatactgagaaatctgtgctgtctgtgcctttgagcccagggaagggcagggaagagtcagggagcaggccggttgggtggggagcagcaagggaggctctgggaaagggaggggcttgagagtgacagctcccttcctctggggtctggacaggctctgacttctgccagatggtccatatggccccagggtacttatggtggactccaagaggggtgggctggggagcatctgctttggggttgataggttagggcactctctttcttgctgaagagggacatcccagtgattcagagagggggctgtgtgggggacctggataccttctcagggtgctcctctgtcatgtacctgctcccagttgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcaggtatcatttgagccaaatctgaaggaggagggggaagaggtgcttcgctggaaattctctctcacaagaccctaaagaaaccctaggaaccaggcaggaattgtgagccacaggagtaaaatgaacagaggcattctgagtctagtgtcaccctttcttacttctctacttttgtgactcttagtgtgcttgctgccaagactgactttggctgcctccaaaatcctaaaacactgactttcctaagtgccagtagtaggctatattgtgggggagaaaagttcaggaagagatctgatcctagcccttgggtgggcttccaccctttatggagaggtgaggcatcgttctggtacagtcagacaaagtttgagaaaggatatgattatgtgtcctggaacagacactaagaactttagtggctcagaggaggaagagtcagtgtgggctgtgtttagggaaggcttttacacaggaagtgagaccgtattgtgactttaatgatagatgtcatattcatagtcagagtgggagaggagatccaagcatcctgagcaaagagaaaaagataggaatgggcgtgtttgagagaccaagaagatactgacccgacaagaatgaggggttcacttaaaggagatacaggaaataaagttgcaaaggtagaatcagattaaggagagctctaagtcttaaggcactaggacttgaatttggggtccttgactttttgtgtgtgtgtgtgtgtgtgtggagataattatacagtagtgacagaattcaggattagaagagggggagacctggggcagtgagaccaactgtaacagattagaagggggtgaggtgatatagcttgaactagtgtgatgatagcaggaatggaaagaaacgcatttcagatttcagaaaatttgtggggaatgttggcatgactctgttcatttcactcctgctcaaaactttcagtgacttgtgttctagagaataaaatcctgactccttattgtgacatttaagaccttctgcagtctgttctcaaaccactttttcagtcttacctcctggtaccctcatgctgagaactgcagcctaccaggcctctgagttcccccaaccccagggccttcctgcccctgtgcctttatgttctttttccttttgtctggaatgctcttccttccctcatcccaaatatctgcctctcaaaatcatacccatgaatcttcccgattcccccgccacttttttactaaccgtgcatataagtgtttcccgtgtatttatccatatccctccttttttccaagaaggattggaggtggcttatgggataaccttaaagtcctttaaactctgggattatttggttcgaagtagctgtgtataagggctggacctgggtggccattcttctccaataaggttttatgtggctgtgattatatatttggttgcgactgacgagtgtgtgtctgactgagaatgacatagctgtttgcatgcctgagaatgagtctgtgactgtcacacttgaatatgggcagtggcagggcaggttttgtttatgccataatgttttcctaaaacaatcttctcacctttgtctgggtaatgcttccatattctttaagactcataccagttattttcctttctaggaaatgatcccagaatccctaagtgggactgaatttcctactcttttgcttaactccatctaccatagaactaaccatattattcagtctgtgtttgatttatttgaaggctgactcatttcattagtatttactgagcacctatcatgtccagtcactgtgctaggtactggtatacaagggagagcataacagactttgttcctgcctttttggagtttacatttggtaggatgggcaggcaataaataagtaagcaaataaatacaaatgtaggaacatattgtgatgtgttactaaaacataaagaggaaaggaatagagtgttatgaaaagagaagaacaaggggattgtacttcagctggtgtggactgcagaagatctgtgaccctctcagatgggagcactccataaccttcctggttatatcctttttctttttgagacagctctgttgcccaagttggagagcagtggtgtgatcacagctgctcactgcagtcttgacctcccaggctgaagcaatcctcccacttcagcctcccgagttgctgggactacaggcatatgacaccatgcccagataattttttattttttatagagatggggtcttatcatgttgcccaggctggtctcgaactcctgggctcaaatgatcttcttgccttggcctctcaaagtgctgggattacaggcatgagccactgcgccttgctggctgtattctatttgtggaagaaaagcctcactttcttctgtgagcattattgcccagccaagagtccccagcattaagggtagctagaggagggatctagtcatccaataatcagttatatcaattaactctcagttctccccctcactgtgggcattattcagacagagaaataaagagggaatctttgctgcaacacaagagaagggaactaggcaccaggaatatgctgatgggaaggtcaaggctttgggtaggtggggctgaggggtgataaggtgccccgccccccaccttccaatggggaagcaggggagagtctgagggaagttgggcagttagctacagccaagcaaggatgaaagagcacagagcctttctcccagagacactggccctctgaggtcccagaccaggccagcctggaaaaggtggcaatagaggaaaggaggccttgacacagatgcccacagcttttccaggagggtatcatgctcaaggaaaggccttagctcatgccgtatcgatactggctactagggagagagctctgaaatcaagtatgttgatatgatttttctctcccatttagccactagctgctccagggcagggatcatgctcatcttcatattccatatgtctagcatgtagtaggtgtttaacacatatttgctgaattgaattaggggtgtgttggggagagggggataggatgaggaattcacctagacaggagtagagctggcaagtaatgtaaactaggtgatcaaccaggatagggaagaaaagattgagtggaactaaataagcaatgaccaggctctgaggatccagaagcccaggctggtcaatggaggactacagggttagaaacccaggcagaggtcacaacctacatgaccagcatgagattgggttacacacagggagcaccagcggcaagaatggaagaaagcactaaaccaagggcttggagatcacttgtctcattaggccactgttgaccactctccagttggccagggcaagtctcagtgggcgggtccacagatagaggcaggtgcctcctgagggtgcacatttcctaggtgtgctcctggcacccacccaccactgcacccatttgtggcggactttgcttgttttttccacctggggtccactgtgaaatgggacacaattatcctccttcactttctctcaaacccctgagcaagcacagaaactgtttgaggttgggtttttttttttggtttggtttttcatttttgttttttggtactacaactacaactagtaaccacagcaaaaacagttctagcatagcagtttagggggaccatggggtcaaaactatttaaaaataatacaaagatcttatctgctttgtcacgcttgttcttttgtgattgtgtagggaagttttccagaggttacatggcatgatgatgtcatcacttggacagctatggaaggtgtgcttgtgtgttcttgcgttttcaaaatttatcagttttaatttctaagatggtcaatattgatagatatagtccacataaacaaactttatttggggtccttaataatttttaagagtataaagcgattgtgagaccaaaagtttgataactgctagcctaacaaactagccaaacttagtgttgagaattagtgtttaaaatgtgttaaaaacctatcatcagcctttattgaaatataaattgtgttgaacctgatcttttctcgcccttttcctgactttttacattgcttgtcaacaatattctacctctttattttattcttggaacaggtgctactgaatgaactatttcaaccctttcctcaattcccttctctttttaaaaaaattttacctgagactgggagaatgttagaagtgtgtaatcaggcagctaaatgctctagtaagaataatgatatcttgaggcaagctgcagtctaatataatataatgaatgcatattagaaatcgactttattatttcctatctctaatgaattgatacataataggccatatgtgatgtgtctagtgcagcgtatctctatggtccacatgtactttctatgacaagaataaacaaaactgggagaaatgaccggattttaaattatcatttcacaaagtcatgtttcataaaatatattgaactgaagtctttccttgaagttgtgatgccagtttcctgttggagcagaagttggtctcagtgactatgtggcctgaggcagggcctgagactgggaggtccagcagctcaggaaggggaaatgtgtgagactaatgggagccaagcaggcactttggtgagagacagagatgctgactcatgcgccagtgagatgtgtgcatgtctgagatcacatgtgtcatttgcttacctgtgaaatgtgtgtgggcatgtgactgtgtgtttgtccctgtgacacatctattactcagtaagcaggacagtgctgtttgtggtaggtgttccacacattaaatggatgagcacacagcttttcacaggtggaatcactgtctcaaagtatttccctcagttgtcatagggcctgaaatctctctaattcactgggcggagacactgtgttcaagtggccgaaatgacaatgttagtattttactgatgacattaacagtgattaacatctcagagaggagctgttagtgggtgttgtccttgatcataagcagatacccagaaagcatgggacagaggagccgtgtgagctgtggtggcctggcaggaacctggatgctggaagggagctctggaagatgttgggctgggctttggggatggggttgactattatttgccagtttccaccttcccagaaccagtcctatctacctttcaggaggagtgccactccctcttcccagatgtatgcaacacaacacacacacacacacacacacacacacgcacacacacacgcagagagagagaggttagtagccctttcaaagccttcagactcacctgtgtatattttatatcatgtatattttaccaagtttccctgtcctgcatcttctcttcccataatgcctatcttgaatcctgttcactcttccccatatgctgctggtacagactgtattggtgatcacgtaccgagaacccccaaatcctgagtatcaggaattccagaatcgtctgctgataagagcccgggaagactttggtgtggagctgggcccttccctggtaagtagatctctcccttcctgagagtcaggtcaagctttggggaagggcttctctcccaaactcagcatcaagtcttggctgtggagcaagcccaactttggggggtctccgcttctgtccaggatttttccttctgccctatggagtagttaggaagggatggcactttaggaataagagggaagaaagcaaaccagaagagagaataggtagaagggagaccccagagagaggggaaggggccttgcaggacatttggagagtactgctgaagttgccacccccagatgaacctcatcgctggctgcttctatgatgggatcctgctatatgctgaagtcctgaatgagacaatacaggaaggaggcacccgggaggatggacttcgaattgtggaaaagatgcagggacgaagatatcacggtaatgaagaggggtcaatgggggtctgagggctgatgtcaggaatagagtgggctgaagaagaaacagatgtcaggatcaccacagctttagtgggggttagtgaatatggcagagttgcccacacctcaagatcggggaagggtagactctgagggagccgtaggcatgagtgagtgggagaggagcccagggtagacctcaaagaaaggacactcttttctgtcttaggtgtaactgggctggttgtcatggacaagaacaatgaccgagagactgactttgtcctctgggccatgggagacctggattctggggactttcaggtgatggaggaggaggcagggaagagagtgtggccctgcaaaatccagctttcaagggttcagtcggggcagaaccaaaactactagatgagggatttgttttctctgctggcactgcatcctggctgggtggtaggctggggagaaaagcagcgaaacagctggggtctggggaggaggctggtgggagcaggcctgtgggcccagctttttgcttccttacagcctgcagcccactactcgggagctgagaagcagatttggtggacgggacggcctattccctgggtgaagggggctcctccctcggacaatcccccctgtgcctttgacttggacgacccatcctgtgataaaagtgggtgtgtgcagggactgggagcagctttcctccctttgctttccattcatggcctccaccctcactgaccctccactcttaactgtgcttctgcctttacgtctgcatccctccctcctcatttcttcctactcccaaggagtctgtctatgcacctatgcaccccgttctccattctgccaagtccgcacacagtcttcctcagggtctctatttccccttcagctccactttcaaccctggcaattgtggctctgggcacaggaatcaccttcatcatgtttggtgtttccagcttcctaattttccggtgagttctgggtttcttgctgacctactccctgcccccattgccacacaacctctggctgaagccaggtggtccctataatgtgggatagggtagtaggtttcttaatttgctggttgtctcttagatccaacagcgtcttcctctctagcctttctctttagttgtcgcttagcctaggtgtttgttccacttttggtcctagactggatatactaactagtgtttttcagtggggttaagatcaaaggtgaattttccattggtcttcttttaggaaagaactttcacccccagtctctgtgtttgttagtgagcatagggcatgtgccagatatgccgagaatgcagccttatcttccagccctgtctctcaggtgtaacagttgcagcttcaggagctgcagggaagcccctgcaaccctgctgttggcttgggggtggcaggattcggcttgccagtcaactgaggtgtgcagtccttacagaaagctgatgctggagaaggagctggctagcatgttgtggcgtattcgctgggaagaactgcagtttggcaactcagagcgttatcacaaaggtgcaggcagtcgcctcacactgtcgctggtgagcccttgtctcagctgttcctctgcctccctctgagttcctgtcccttcttaccctggatctctcccagcacattggcttgtaatgatagcccctgcactaccaccatcatctaatgttcctttcatccttccgcctccatgttgcccttggccccagcggggatccagttacggctcgctcatgacagcccatgggaaataccagatctttgccaacaccggtcacttcaaggtgaacagtcatttgcttgttctggtccccaccatttcatcctgtctcatccccatctgccacctctgcccctgaacctctgtccctcatacccgactctctgtgcccagctgagctcctgggtgcttccactgctctctagcatttccttgtacccagaacttctgatattcactttcctttcccctttcactcccaccatcagggaaatgttgtcgccatcaaacatgtgaataagaagcgcattgagctgacccggcaggttctgtttgaactcaaacatgtatgtaacagaggatggactctaacatgtatgtaatggaggagtggggaaaactatgaaatagtaaaattggctagatgggcaaggggttgatttataaatgattttaaaatcgtagatacaactaagagaaaggtcctcttatgtagtggtaagtttctgtatctaatttttaactctttcaattttcttatccttcccattgtttttttctgccagatgagagatgttcagttcaaccatctcactcgcttcattggcgcctgcatagaccctcccaacatttgcattgtcactgaatactgtcctcgtgggagtttacaggtgagggataggtgtaggagattatggcaggggtgggaaggatagacccaaagttatactgactctatgctgggtgatagctggtgggaccaggacagacagtctattccatgtcacttaccaggatattctagaaaatgacagcatcaacttggactggatgtttcgttattcactcattaatgaccttgttaaggtgagtcttccccactccttaaaagttcatccactttaaatcacttccactgttctttgattgtggtttttctccttctagtcctctgaagtcctgttctctcatctccccttattcccatggtctggtaataatgggtaaacaaggagtctggggcttataactgggacagtgagttttacctgccacaaggagtcctgtgcctgtagagagtttctatctttctgtcttaaatatctcaggtctctttccatcatctcttttacctctaagaactcataaaatgagtggagtctctgaacatatttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctgaacatatttatctcttgtttttcctctcattattttactctccgaacatatttatctcctgtttttcctctcattattttactctctgaccaatatttggcatgtctgcccttttgttcagaaaactgaaatttaaaaaaggaacatttactagtagaactaagagaaaccaaggaagattgtactaaaaacctttggtactcttctgttatactaggttttagctatgttcaaatgactcagaggcccatggatttgtggagcataaaatagaatcttgcatgagttggacaggttttctgaaataagtctcatagccaatgagcatcccagtggatcaccccacactgtatctgaaactagctttggttttctgctgaattctcatgaagttatttaaaaagtatttttttgtgtgtgaaaatttgctatcaaatgagagataaaaatattagtaaagccaatgtcatgctcaactagaggtgtgatgataaacataagacacgactcttgagagaacagtgatttggtggaaaagtgatttacaacaaagccagaagcctaatcctgtgattgttgaaggcatcctttgcacagtttccacacaagtaaattcacaacttcagagattcccaaaagttttgttgataccaaaataaataaaaaggaagaattcatagagattagagttatgaattaagtccagagctaaacatttagacagaaatgttttttgttagcatattgaaccttgtatcctctttctgtctcacctgaactgacttgggtggctcctagggtttcatttttggggagcatcattaagacttttttttttttttttctgagacagggtcttattctgtcacccaggctagagtgtagtggctaggtcactgctcactgcagcttcgacctcctgggctcaagtgattctcccatcttagcctcctgagtagctgggaccacagcgtgtgctgcagtgcccggctcatttttatatttttggtagaggtggggtttcgccatgttgctgaggctggtcttgaactgctgggctcaagcaatctgccagccttggcctcccaaagtgctgggattacaggcatgagccactgagcccggcctttaagactgtctttcagctcctcggaggcaaaggtttttccctctctggacccacagagccagcagttttaggcttctgcactggcttagcagattttgtccattttccaggtttatgatgttctgcactttctctctgatccagcattccctctagtagatcttgttcctcctctaccccgacttgcccacctccctctagtagatcttattcctcctctaccccgacctgcccacctccctctagtagatcttgttcttcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacttgcccacctacgcctggttatgcattaaagtttacaactggtcttccttggtatatccagctactcttgatacctgggtctcaagtcatgtcttcctaattagtagccaggtatctgaggccaccatgggtgttatatcattttggtcttcacccaagttctgttctcttcactaatcaagaagattgactgccctctccagggtagtcatttgtagctccacttatccctctttttaagcattttccctgtccctggtggctgggtgcctgtgtcctgcttatgataccaggaacagatgactcttctgttcttcctgcttccttgggtggaaactgcaaaggatgccttccaaaatcagcttattatttttgtggacccaagatctgtagacagctagccagtgcccatctcatggagagagggtattctaagccagatatgatccaatcccatgacttgatctgtaccctgcagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccagtgaggcccacccccacaacccactttttatattgctcctctttccacctagggatggtgggagagggaggtggagtgacagtaatatagggatgagcccaggtgggcttgggggtgccccatttcgggggacctggccagccggtttcctcttttcagagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaaggtaagagtcaatccactacccacagcctcttcttcctgggggaactctgttcttcatccaaacctttgatcaccctcagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaagtgagagggcattatggggcaggggcttcccagggatagaagactcattagtcctagtgcatgaagtggggcaggtgggaccagagggtgggttggataggaagtcctgggaatcttcagaatcttagagcaagtgccttatcctggcctccctctagggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccagtgagactttgtcccccttcctgtattttcttttgggattctgctctgttgggctctgcctcatcaggcacctgagaactcgcctccccaccctcagaaccctgctggccacagggagcacccctgcttatagattatttgctgtcattctgtctccacatcagctatgctgccttcttactggctgcccatcccttcttcttaagaccctgctctaccacacccttgcttcagcaagtgtatgtaaaacagtcccaacttgagacagctcccatgcacagggattcccctcaaacccccccgccacttgtgtgccttaccttgcattagactgtaatgtcttcccagccactttcctccctcccacctgaaaagcctagctttcttgttacagctcatctctgctgcagccacatacactttccctctctcttccactcctgctctcttggagtttggctcatacggcacccttgcttcctagttcagtggcagagcagttaaaacggggagagactgtacaggctgaggcctttgacagtgttaccatctacttcagtgacattgttggcttcacagcattgtcagcagagagcacccccatgcaggtgagagccatgggtgagaggtggcgggtggggttgggtgggtagggacctggggaagcctcattgataataggaaagatgagtttgttctagagttcccacatcttttgatggcttgtgggttaagaattcttagaaaattgggcacaagtctcagggcctctgcttttctatcccttttaggtagtgacacttcttaatgacctgtatacctgctttgatgccataattgacaactttgatgtctacaaggtgagagctggggccgctgttcaatagaagaccctttaatagagacccgctttgaaactcagtctccctgaaccccacacaccttacccaccccatgatcagttttccctccagggtactcagcatcctggtgctggagtgtacttcgtagacagatgtagctccagcactataattgtacactccagtcgaatttcttgtgaatcctttgacttccctaatcagaaccatcatgagatttagctcctatcttcctggagtataaatacagcctatccaacatttctctccagtcctctccagacatggaagaatcatataggatgtgggtccagactgatttagtggggtgagggaaaatatattttaaaaagtaaaactttttgttgaagttattgagttggatttattgtccttgggagtaaaaatcatctggatttgaatattggcttgttgctaactgtgtggccttaggtaagtcacagaatctccctgagcctcagttgttttatctgtaagatgggaataatagattcgttgtatggaaagtacctaacattgtttggcatgtggcagactactatttagggataactactttatccctaaatacttagtgtgtatttcctaaaaacttcactgtgtatttccttaaaacaatggcatttattctcttacatagctttggcacaattaccaaaatcaaatgcctgctttcctcctctctgacagtttgggctgtcaggtccatttcactgggcctgctttacctcctcaccagcctctgtcctcttgagttaccgttttcttgcttcccatttcctgatggcagagcctatttgtccatgtcctgctgcagacagggtgttcattcattccgcaaatgtttactgagtattcaccaggtgctgggtggagaaagaagacttaaagattccctagacatctcctctcccctagactcaggaccatggcacttattttctagtcaatattctggtctccagcatgtcaggatgattaatgatggtgtcaagcttgtctccctctactttttcccatccccatggatataaatagaggtgaccttttaatccccctctcaatcaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaaggtaagacattagccctcaaccccactgttggcctcaatttatcttgcccttttcttcttttcataatccctccaatttcttaatctgagagaccacagttccttagtgtcgcatcctcgggcatattttggttctaatagatatgcattgggaggttgggcatattttggtcctaatagatatgcattgggagcttcccagggatggttggtcgggcacggtgctatacagtatcaccaattatttgattgccttttctttgattcctcattccaccatcctccccattccacccaccccagcgctgaagatccatgtctcctctaccaccaaggatgccctagatgagctaggatgcttccagctagagcttcggggggatgtggaaatgaaggtgatggcaggccatggggaggggggcatggaaagggagggtgaaagtgattatgggaatcatagggaaagagagggagacaaagggactaacatcgaagcatctgaatcatgtccactctcccacttccagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcatagtgtgggataggggcaatcccaaggaaaggttatggggtatgcacacagtgactcacagaatcactaaattagcagtcttgggatgagagagaaccctttatgtaaagcctcttcaagtacagtgagaattaacttcctcccgacctctctagtgcagacagaaatagattccatattccataccccacttccctcctcacccctcagaaaggagtcattctcccccctccaccacccagccttcctccgggacagggaagggaagatatttctcccaattggtaggggtaattctcaggttcatagggcaaaagtttccccagagacaagggtactggtgttgagaagctgcagttcttccggaatggtgtgtccaatgtcctgatgttactgacaccctggaggagtgccaggatgaggatggatcccactctccccaagccagaacaaaacaactctgccctacctttcctgccccgctctgcccccaacacctagtcaccctcacacaccggcagctgtggtgccctctgtatccagaaggtctcaggttgctcctggcggtagtcgtgaggctgtgagggagggtactgagtaactcctggccttcagccctctctctcaacctctgggcttggtacttggccacagcctgtcagagcccagctggtgcaagtggcgggggatggggggtgggttctcacctttgttggggcaggagtccctgcttgtgccagctccattcggtagtcatggtgtgtcacagactcaacctcgaagagcttccttgtgggttcctgttctgcctgcacctctttactatgtagcccgaggggtgtcaaggccattctcacccaatttttctcctccccatccctcttcccctttacccaatcccttaccagatctgatgctgcaggagcatctccagcatggcttcacgcttccctgtgagagagttggggggtgggcaaggtggggtctggttaagaaggaggcccagaagaaactaacttgagaaaaggaagaagaaccttggggttccgcccttatatccactggagaatccacagccccaccagaaattccttcctcttcttccctctgagtaatgggctcgttctggcctaccctctcacatttcacacctcgaagtggccaatagacgtttcctggtggctggtacgagtctttctgggtggtgctggagggcatgggtgactttagttgcatagtcagcagtccccggtgtccgtgtcggaagaaaaaactctcagagccatcctgcatgcttgggacttgatccaggtggttggtggctctctgtggatcccaagttgaatgactataatatcccttctggtacccaccctcatgtaaactactgcctcccctaagaaactgagggcagccttcaagaaaagggagcaggccaaaactttaatacctcttcctcccagttgtagaggaggcactggccccgcggcaaagtttcatagcaaaccataagcttccctttaatgtctgggggtttccatagtcctcgggcacccggttctaagacttgcaaaaattcccaaggtggttgtttctggggctcccaggggcagtgctgactccaggaggtatagttagggacccgatctgccaccaggtttctgaaccctggaggaatacaggggctgagctcagagtcagggccagtgtctggaccaggcccagaggcaggaccaggatgagagccagagccatgaccaggaccagagccaggaccagagccaggaccaggaccagagccagagccagggacagagccacagccaggaccagagccagagccagagccatggccagcacctgagctggaaccaagaacaggcccagagctagagcctggaacagggccaggattagaactatggtcagttgtagtgcaagtgtcctgagcaatacaggaaacatagacgggctcaaagccaagactcccatgggctatattgtgggtaaagccgggtcccgcacagggctccccaagaaggctggggtcagaggacggctccatgaactcagaacagggcgctggggtctttgtagataatgcagctgctttggcagtggtgaaggctgcagtagctgcagcagctgatgcagccgctgcagctgctgcggttgcagctgccagggccgacctgggactgtcatctgaagaaggaaacggttccgaagtgggccccagtccttcggagctgggctgtatgtctaaagatctgaaagaaagcaaacacgacatggctgtcaaaagcgcagcagaggaagtcagctgaccttcctcgtccccttatgcctgcagccagagctgcggctctcaccgcgaccgcgaccgcgatccctccgtagactcgttggtctccatcttcagactccagctactgggttgccatagagacagcaaacaactcctggagcctgcgcagaagtacagctgggcggacttgcaggtggcggtggaggcaagtcctctgcggggcggaagtcttcagcctagtgctgttagggaggtccgctttccggtcccggcggcattccgcctcagacggggttttagggttccgctggcttaagacctcgccctccacgtccaaacagtctttgcgtgcggttttctaagatgatgctttatggggatatgttggaaacaggcacagggttgtggcattagattacagcctacttggtgtttgctgagaggcaagtagcttccccttagtttgcttagttcattctcaaaagtgagtggggtctttaacaaatgttaaggatgaaaataaacaaactagcttgagcaaaatggtgagacgtagaatagtgaaaaggcagccgcttttgtttgggtgtgattactcctcctctaataaaagaccctcatattgaccaccctcctcctaagcgcccttagaacctggtttgacctctgaagaagggccaggattggctttcagtttcttcctactcatttaggctcattcctactgttacttttctagaagcttgacctagggtggaccacttgtcaagaagacttacatatctgcaggcaacatttaaccacaggttggacctcctcagtgtctttcactcagaccagtcaaggggcatcatagccctgaatcagttttctttcccctttgtggtataaaattttatattaaagacaggagagcataattaagggagaacagttttattagcatcacagggtccatttttccctttccatccaagcatccagagtctggtgtcctttaatcagttggcaggttcaacctggaggccactggagctgccggcccccaagtacatgaatgtgcagatgatacacagattgtgcacccagcttcccatcgttgatcactgaaattgagcttggggttagggagtcaggatcatggcagaggtcgaagaatgaagatcatattgagaagtaggaatgagaattcataggtgagggaccaagggccaaaagtcactcaccaagtcggtatccatctcccaggccctcagcctttgctgtctgcttggccacaaggagtaggtgtcctagaagctatagagagagcggagggacataggtggcttcattcatagggagcaagacctctagctgggtccaggggctcctcccagccaaaccctggccctgttcttcccacctgctggtcttcttcttcagcctggctaatccgaggaatgggcttcttaggaatgaccaggaagtgcacaggagcctgaggggccacatcacggaacacaagacactgggggaagtgacaggccagaggccacgttacttcaacaggttggatggtatctacaacattcctaaggggataggtcctaagagcaccccacctgctggtcctcatagagaatgtcagctgggaggctcttgtccaggatccgggagaagatggttggggctgctcccccaggagttgcctgctgggccttggccacttcattcccatcagtcacacctgcagctcctcggacctgaaggtggatcgaccatattcaaaggagggagctggcagaagctgggctctgatagttgttaatttcgtccttctaataacctattcatcgttcccacccaggaggaaagttcctgaatttcagagcaccagcagcaaagggtagggccagaaggtgctggacctggttagataacaggcggtattattatcaggattcagcagtgcaattgattcctgctcatgtgtccacgaaatatagcactgtttagggaaaggatctagaatgagagactggggattttggtctcagttcctaccttaccataccactgaattacctcagataaattccttctctcagcttctaatataaaataaagggatggtttccataatctcttgcgatggcttgaatctctttccactctcaccttgttagtacatttccacttatttccgttacttgttttctgatctttaagccttgtcgcctgttttatttaagttttaatgcaatcgccctgtttgacactagttgacccctcatctgggtgtcacatgtgactctgtgaattttaactcttgtcccttgaatgagtggaggtaagagttcagctaagtgacctctgctcccctagccccagggaacttcgggtaagggattcagagaaggctgatgtcattgcatcacgttgggggagaacgggacggaatgaattctctgacctccgagccgcttctggcaagtgcagaagagaggttaacactagtgctcattaggaggccagaagcctgaggagggcagagcactggctccaagaagagaaagctcatttcctgcagggggcatcgggccagctgggctgcaggcagtggaaagaaggcggcagccgctgcactgaccctgtcccgacctcggcgccccggcctgcgcagggcgggaatcagcaccagctcgttctccggagccaccagttcgacctcaccacacagccccggagcttgtgcctcggaggggcagaggccacaggcaggagctctgcgcggctctgcgcgccttcgggaccccctggccccggatggcttcggagcccgcaggaccccctactcgctcccgcgccacttctcacctgccccccgcgcacccccgtggccgccacggctctgcgcgccgcgcgcaacccagcagccagcaccacggctgccgccatcttccctgagccgcgggaacctctcacccgggtcagcactcggctccgcggccggccgtgggtggggactccgggcgcggggaagcggggtagtggcggccgggcgagccctgctaccccattggagcgcgcctctgagcacgattcaccccattgcctctgcagccactttggaggcgggctcttttcatctcattggctgcttctaccaacgcgaggacaattttccattccattggtttcgtcttctagtccgtgtgaacgttcttttcccattggatccccttactagtttctctgtgagagaaacttccactccattggaaggattaatggagcctggaggtgggattttctcctagttgaatctgatacacaactctggcttctaggttgcggctcccgagtgggtggttcttttcgttcttggttcgtcctcttcaggtctggttcctattggtgcgcggggagaagggggcggggctccgccacctgctgcagaaagggctgttttagaccctctcaccgctttggccaggaggagggcggggctctgagggcatccggcgcttattggctccaagaaccacccggggtggggctaaaggtgaacggggatgaggtgtgtttttttgtgtttgtttgtttgttttaactggcggggctgatgcgcagcattttctccacaagggcagtttcagtcccttgagcattttggagattttaatgtacttatctaagggaaattcttccttaattctatgttcttgttaacgcattcactccatagattaaaaagtctgtggtttttgcattttttttttttgagcaggaggagataagagtgtcctatatttgccgcacaagaattataataagcaaaggagtatgtattcattgttcttttctaatcggaaaaggtgtgtgatacagttagctcggtgcctggtgttttctttttttttctttttttcttttttctttttttttttttttgagacggagtctcgctctgtcgcccaggctggagtgcagtggcgcgatctcggctcactgcaagctccgcctcccgagttcacgccattctcctgcctcagcctcccgagtagctgggactacaggcacccgccaccacgcccggctaattttttgtatttttattagagacggggtttcaccgtgttagccaggatggtctcgatctcctgacctcgtgatcctcctgcctcggcctcccaaggtgctgggattacaggtatgaggcaccaataagtcaggtttgcactgctggaatatatatttttgacataagaaacgtggggtcacaaaatactaatattctcagacgctaggtaagttttagtctgatatcacataggacaagttaccactgtttctttggtttttctttttttcttttttttttttttaaacacatgacctgatacatataggtggtcagtaattgttgaatgaataacatttggtgtttcctgtctttttttcataatatgtaatatgtattgcatatgatactaacccatgtgtaatcaatttttcatatttttacagtctacgtaaatatagtttgtattggctgcttattatttccttcaatgagtttatcatagtaatcctaactctattgttgactattagttgaattagttttaggtgaatggttatcatggggcatataaccactgttggggaactttgcttctagagatataacaatctcttttgtatagctatattattgttagaaaatcctttctcctctaaagggcagacatttgattctgtgattttccccagggatcctagcagtccagattgcattccttcccttggaggaacagatggcccccctaattgtgaggaaatgtagaatggcctcttctctgggccccagaggctgcagttctctgtggtgcctctgggacactgggagaccctagagttgccctggagaagggcgagagataagtggatctgggatctaggaagaggaaggaagccagtctggaggataggtggatacaaagcactttgaaattagttatttctttggttctcatagaaagtaggcaacacagaggttattcctgttttacaggtccagaaactcagcctaaagagggacagtgacttgcctgggttcacagagcccattagtgctggaatctcctactcccataagaacctatggactcccttgtgacttcccacattcactgattttgatccttggcccacagttttctctacttcaagcacttatcaccttcacttgccctcatctgaaagatgttatgctctgcagcctctgaacactgtctcttgtactccaacccctgcccctacgtctgctactgtacctcattagagacttctcttcctttgactgctccctttttcaatctgtcatttgcctcctggcatcactttctttccctattggtgctgtatgctcccttcacatcctcatgccttcttttgcttagttttcctgatcttcctccctgacaccctcacatcatcaacccattaaatatttggattctctgcttctctaactaggttctcacttccaactgtgcccgaatcctgaactacccactgatgaggtttttctccagttccctacattagccttcccaaaccttcccctttctcttcttgtctcctgctccctactcttatccctcttcccctggaccccagccattggccttatctcctacttcacagggcatatagaagccatcagaggggaacttccacaggttcttgttccctgaaactctaggaaggctccatcctcttccttcgtcttggtcataggaagtggtgtttctcctgtccagagaaaatcccttcacctctgctttgacctcatccctttcctccatctctgggatcttgtctcaccaggcatctcttctctctcttctgggtccttcaaggtcctttagtctactggcctcttccccttttccttcctacaaaagtacttccttgactccacaactccctctggatattgtctgactttacttttgtacttttcatccaagcttctttaagagactccttgaaactcactgctgtttgactcctgcctccactgcaccagtgtgaaactgcactctccgatgttcccaaagatcttctaattgcaaaacccaatggacacttttcagtctttatcttattggtgccccaactgcatctaacatcacttcccactctatccttcttgaaacttcctcccttcttgacttccttgaagccactttccttcaacaggcagcttgaatgtgagtgtgatggaggcagatggccagatccaggctttctcctgtgtctaataggtgtcaactctaagttattaggcagtctctccctgggctgggatctacctgccccatatagagccaagtcaggttccaatgactcctcttttattgctgatctgggccagactcacaaaggcctgtgccagttgctgacagtgtctgtccctggaggaagaaagagcagaggtgaaagggtcaggtatgggggtcagaagggaggccaggctggagaccgtgtgaaccagggagccccgggggactagggtgggagctgggaaggccagagggcccctgtatctgcagggcctagaagtcagagttgctgaggatggcttctcggagcacagccatctctgcaaaaggtacatagtctgctcctgggggtgaaaaccagtgcagatgtgggatgcaggtaggtgggtggtggggaggtgggctgagggagcgcgctagtcctggaagggatggttgaggatgggagtgccttcctgcctggccttctgactacagaccctggaatggccccctgtcccaggtttctgcctcaccgcgaggccttcctcctcgttgccgggtcttctgggtgtcaaagaaagtctcgtgttcctcccagcgccggtcacaggccgcacagaggaaattagactcaaaacagccgcagcaacagcctggggcaaaagtgcagccaagaagagtttaggaaatggtggtatccccaggagctgaccacattctcatctcttcctcagtgaccgcatgcccaaggctctcatacctgctctccatcattatccccagattgcatcctatccccacctaccctgctcccaatacacctcttgccctagaagttaccatgatgcctgcagggatggggcccagtggctgcatgttcttcgtggctgtgtttgcagcgacattgggccctccaggccttggggtcaaaggtggcccgtctcttgagccagaactcacccacctcctctgggcgtgatgggataaagcagaacatgaagcagcggcactggcttaccttgcagggcaccgatatgtctgtgggattggggatggatggtagggttaatctgataggaccttgccttctcatgccaaccccatcctccatccccaccaccccctatgcacgcagacatgctttttttttttttgagatggagttttgctctgtcgcccaggctggagtgcagtggcatgatctcagttcactgcaacttccgcctcctggcttcaagtgactctcctgcctcagcctcctgagtagctgggactacaggtgcgtgccaccatgcctggctaaattttttgtatttatttatttattttttagtagagacggtgtttcactgtgttagccaggatggtctcgatc

SEQ ID NO: 331 - DNA, 28252 bp, Homo sapiens
acatgatgctacattggaatgcttattttgaatacatgttaagggaaattaactcaaggaaagacaagcacttgattttctttttcttgcttttcagttaagtacagacaaggaatgtaatgaatgaatcaacagtacatattttgatgaaagcaatgttgagcatacaaaacactgcacattcaagaaaagccttgcatttttcctaactcataacattgaaaatgagattcacaatcttgttagtgtcagactataatcattcacattgctctacaaatcaaaataatatttttaaaagagcagcactgcactttcaatgttaaagttttatgttgttttgtgttttatgaatgaaattttactcaagaagatcctcaaagggatgtgagagacattgaggctttgttagtcaagaacagaacatgagaaggtactcttagatagtgcatgcaagttggtctcttgataccatttgaattgtaagaagcaattaaatacttctgcttactgaaagtaaacttatgctatcctggtcaaaccccaggccacaactgctacatgtgtcatggaggtgatgtgttagtctccagggaaagggtacaaaggaaagtgcacataaaacttccgctccagaggaaaagagccctgacaccctggacaaagaaagttgcccctctgtcctcccacctgaaggtacagtgctgtcctggcatgtgacaacaagtggagattaaaaacaggagaaatatctgggacaaaaaaatgtcaaagcctcagagtcacttacagtcttaaagagaataacatttaaagggaagccacattattagtaacatgggctttaaagagggaaaaggtaattagcaacatcttaattctgaattatgaaactttcagccaaatctatcattagtcaagttaggatagaaattagaatagactgtatagcattcggttttatcacaaaggaaaaaacgtgatagtaaaagcttttcaatcaaaatttttgccttttctaatactcaaaaaaagtagtatcgtagtcataaatttgaaaaatgcttcaccaaggattagttttacactcacttattgaattctacctagagaattaatatagaagatgatacgaaaggagatgaccacagtatcaaacatatatcctattcagtgaacactattgacatctgattctacatatacttaggtatgtattttttacattatatttaccgtccacccagattttcagttcaattgacaattctttactagggacccttttgtcccttccaaatataaatggaggacaaatttaaatgctgctcagacagatttttaaaatctatattcactacccaagattcaggtgcacaaattccttggctccagagagcataatcattccatagaattgcttttccttatttactaactgaggaccactgcaagttggagatatgtggcacttatcgaatatattttatcatatattgcttcttttaaaatcaaaattatcttttttatgaattcctcttttatgcttatagtgtaaaaatcaatagtaacctaattcattaaaacattattcgcataagtaacaagcaaatcattcatccaataagcagacttggaaaccccaaatataaacaccaaaagctgaattttagtaagaaaatatgcactattggggaaaaaatgcaagacagacagagcagtgcaccatacataaaatgtcaaacatgtcaaaacactcatgaataccaacatctcccaccacaccacgaccaattttaaaggttatttagggctcacacatctacaagtgcagattttacagcagcggactttatttttctcagatatattaaaaataagtcactgatgtgtcaaatgttttctatgtcatttccacacatgtggcccatgtagagaattctgcccagcatttctgagagcaggacaattacacagaacacagactcctggcaccgaatagattcattatggatttgttagaagcttgtttttaactgtatcaattcagtatgcagggaggataattagtcaaaagaccaagaaagcaaatgtagctatcttcattcctcaaaaatagaaacccctgttagggtctccataattcaacttttcagaacttcatttcagaaagacactttgagaacatgtcacaaggcttccttgtccctaaatcactgattatgaattatttccggataactgcagacaagtaagtcttataaaacaagaagcataacacatgcagaacatacttatcctacttccagccctcagataagtgaagcttaaattaaatgtcaaaagacgaacaaaatctattgtataagcaaacagctgatctaaatccactatgttttgtctgtcaagtatgtatattctaataaattttataatataataagactatttttgccaccctttgaccacaccaagttagatgcagacagtcttctgaataaatattactctctgcttgactgtctaagcaaaatctatttataccatttgttagactgtgagagtagctcttaagaaaatgttaataacagctaaacactgtctaccacaaatatagaagaagtagaagaaagaataaaaggttcatgcatagccagcttttcatttttacaaagtggcctgctcaggactgtgaactaactaatatgcaatttggttttcctgataggaaacctagaagcttgctgaaaactcacatgattaatataagggaattcaaacagcttgaggatgaaaaacagttttcttttttactacttttaatatgactttctcaatggcataaacacacgcagcaatcattcccactcttttcttgggcagcaaagcaagcaactcagaactccttcacccataaactacgaaaagcaatgaaaataatcccttctttaaaatttcagcgagaagaagattatgctattatcacttaccccactgtggtttcaggtcaatgctcccctccagaagtctgaacatgcctgaagcaacatcctcaactctcagcaggtgagaaaatctttagttagtttctggagaagcagaaaggtacaatccttctgggacaggcagtgctaaagcaaggcacttgtaagttcatatcctggctctcagttcgaattccaactcttccatgtacttataggccaagataataaacgatacctctcaacctcatctcttcatttgtaaaatggaaataacagtgccaacgtcatatttggagttgagatgattatatgatatgatatctggaattgcaacatgtagtagacagagttattgtaatggaggaatgtcagaaaccatggaatgtgtcctccgtctgccacctgcttctgcccttcacaatgacccaaatctttgaaggagtccacatcacccctgcctaaagattgcagcacctcttaggaaacaagctctctgactagaatggaattataggaaatgcaagtttccatgccaatgattttgttccttttgactcctttatgacaccttgaaacatctgtgtggtcctcattagcccagagcttcccatacttagagccacactctcctaacatagtcttgctatggcctctatatccaactttcaccttatacctacctgcctgcccagcacccagcatcctccatgtgccctttttattcacttccatagatctcttcttactttaaactcattcacattattgttggcaccctggccattttagtcctctccttctcatctctgccttcaactctaggactctgattaaataaatcctctaaattgcctcctcctcttccaacttatcagtccctgctcacctgatcattcacagtatggttcattatctttatccatccctatctctacccatttcccccaaaagcttttgcttcctccttcttgtttggcaatagcatataaatgagaaggcctgtgacatggacaatgggacattcactaccatcccttttctctagctttcctctatgccttttttgctgttcactctcttcccaggtaccaggttgctgaggaagatgaaaagggggtggctacatgtgcttatgtgcttgtccccctggcccttccttatgacacccacctggcttcaagcagataacaggccagaggataaagagatacagaagtccattggagtggtgaccaaaaacgaacaaaccagagtgaagaaagaggactggccagaaaaccacagtagtaggccaggcatggtggctcacacctgtaatcccagcactttgggaggccaaggcaggtggatcacctgaggtcaggggtttgagaccagcctggccaacactgtgaaaccccatctctactagaaacacacaaaaaagaaaaaaaaaaaagctgggtggggtgcccgcacctgtcagggagacagaggctgcagtgagctgagaacacaccactgcactccagcctgggcgacagagcgaggactccatctcaatctcaaaaaaaaaaaaaaaagaaaagaaaagaaaagaaagaaagaaaaagaaaagaaaagaaaaccacagtgctgagattcccttatcagtatctctcaataaaggcagccctttctctcacttcatgtacaattggtcctcagtagtgacactatcaacctttttaactgagacccccccataaatatatttcatagtgtcacccaagaaaaattgcagcaaacaatgcttagacgtcttatatttttgctatcctgcaaagccctcataatttctattctattattctttcatttctttagaagaaaattctgatggcaacccaatataatatctttgaaaaccactaatgggtcaggaccctcagtttgaaaaacactggcctatttgcagcttattgatgaggagtcctctctctgtccttacccttctcgaaatcccaatttaatttgagtctgtcaaaacaatcctcttgtccaagcttccagagccaagaaattgtggtagactcaatccctctggaagtccctctagtacccgatgaaagacttctcacactcgcagcagccgccctctactgtaccagggacgtctctagcagaaacttgggcattgtatctgctagaacgggtgacacatgtcctggaaatcctagtttatctaaacacaggttgagatagaaataagaaaaaatgggagtgagaaagattaagtgtgggaagaagaaatgaggagaaaagcgttgaagttgagctctgctaggatccaggtgccggctcggcgctgtgtctagttaaactcggcgcgacagggttcagctaagccgagaagagggcagcgagcggcccgcagtcagcatcttgtagagaagaaggagcgctcccagccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctcctagacctccacgaggtgcggacgcgcctctgccccgcccttttgtgcgccctcaccactagaaaaagagttttccccagtgtcgcgtgggaggtcgccccagtccagctcagcgttccaagagaccagagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggcgaggcccaggcagggagccccccagcctttactctcggcacctcggcgctgccgcgcggcggatacaaaaggaaacggacgagcgtgcgacgcgaggcggggaactggtggctcgaagacgcgcaacacgcgcgatgcctagaagtgctctggtgtcactcccctgtataggacctggcgagatggaattgtatcctgtactggaaaactctgtgatcaaaatattgcaatgaaattaaacttttccctcacagatctgtttgtatcttggaaacatttctgcaatgccgacgcctaggtttaaaatacaattagataatttgatattctcggtgacgcactgacaccgagaaagccaagagattctccaaacaaagtgaaattgaaccttcaaatgacattcttaagtttgcaagaatatctatatctccttgttgtgctccttgcatgcggagaaccagtggcccgtaagacttatgaccggtgttttttaggggaggagccacctaaactatctaggaatggagtccagtgccagaaagaaatacacaaggtcgttgggtgccgctgtcactgcagggcgccatcggctccctgggccttacatatctctcttgtgagaatcagtaccccaaatactctctctctctctcacacacacacacacacacacatccacccatccacagcggaaggccagcagggcaccgaaagaaattgtggcggtcgcctggaccgcagaaggcagacctcaggaaggagcaggcgacagcgctgctcactgctcactcgagctttgaattaaggccatctttccataaactcaaaatggggctagatagcaaagacttaaaattagaccttccctcagagctgagaactgtatggtcatgtcttcggaacaatgatcatatattttccattgctggaacgatacacaataactgaaatgcttaagaggacgcgggaatacgagggcggtatgaagccctcattacaaagtttaatctctttctgaagaaggtaatgcaacgtctggcttttggcaatgcagcgtgtctgctgtttttcctcactttactcctagaaacattaggacaagaaaagtcctcagctgcatctggaaagatgcaggggcaatgcatgcgacgctcttcacccgagcaactcggtgcgcggccggccgggagtttgacagcgactctgtgaaacagaaaaggcactagccaatttgcaacttaggaatcacaactgaatgttccgcgagccggtgcagtcggcacgcggacatggtggagggtcatctctgcctcctttgaccccaaattcccgggaggcgaactacccgacacccccttggccttgggtgttgcgcagccgcttccttaagggagaaccagtcacagagttcgtttctgggttcaactctcggggattgtgtgacggaatgtcattgtctcagggctgcagacacctgggagggagatgagtgctgaaggctctgcagattcccagcatttctaaagagcttttctctttcgctttacttactgctttgtggctttacttgggcataagatgtgaaaacaaaatgatatggctagtctcatcctttcaagaaagtcaagaaattgaacatttcgttattatttaatctcttatgtggccaccctatttgtccctcagttacccggagaaaaacgcatctcgtaaaaataaccttatattaccaccgacacctgcattctctctttttgctgacccgcaaaacgtgtcttttaaaaagaggggaaacaaacaaaagaaaacctgagcgctctcgtggcaatttacagttctaactctgcattttaaaaacaataacactcttcataaatttcagtgacccaaaggccatctgtaattcactagggtcagcgaaggagaccgtccccatcttatgctctctatgaattcacagctgccctaaggtgaaactcgttggacttcatttgcccaaggacaagggttctgagtggaagcagcttctacagcatcagtttcctttcttttttgaaagttggtgctgggtggaatcctagaggcccggatacaacttgcttatactaggcccaagacccaacacatagatattttatcatgtacctgagaaacttacacgggagaaattctattctaaaactacaaattgcacctcatcaccatccactgaatgaggaaaataaagagttgtaagaactacctctactgagttctgctctgtgccaaagtgacccaaggcccaaagggcctgaactgctttgccctttctccatgacccaacagttgtaaattgagaaattggaaaatcggagattacatacaacactcctcaaatccatgttgacttcttgagtcttaaaaagatacttcctaatcactgtgcaagacaagtacttgactagactctgaccttgctcaagttcaaaagcttttgggtctccagaacttctctcctgaaagctacacttacttgcaaagttaacagaagaattgagatattctaaattgatcctaataaatattggtcaccagactggaaaattctggttaagaaaaaatattttactgaattatctgcataattattctggttcacctgatttcttttgccagaatagatttaggctgtttaaaattcagatattgaataagtgacctatcccaaattaatctccaactgtgtatgttatgttgctgtttagtcattattttttctgacccaaaaagaagacaaaattctgttcatttacatggtttattgttgtaaacattaaaattgtctttctcaaagaaagaatttatcagaaaaaaaatcagcatctctaactgtcatacaccatagaaaaaaaggcagtgactcatatcatgtgccatactagaaatatacaaagaaaaatactacagaatatggcaatattaaaattcttactcaaacaaaataataaattaactgacaattttagacataaaaaaaattcaaagtgctcagttatttccagggagttatgtatattataagcactctggaaacagtcaaaagctgctgcatgcaagttttgtttagctttagacaacaaaataatcaagatataaactttctttttatcaacatcaacggtacatacaacacttacaaacaaggaatgttggacggtgttacaaacactatgtgtcccttttgtcaggattttctgatgtgtaatacttgtgcccacctattttacaattgagaaaatgtttaagctcagataactaccaatctttataaaatctaacagactacatagtgtctgaaatactatttatataatatagacattactgaagtagcaagtgcctataacattttcaacctagaatcaacatgcttgtcccttttttatgtatttattttctttttttttgcaaacacacttatcttttagaatttgtaatatttattcataaataggcacaaaataatttaaaaagccaaactgcattgggtaaatttacaagcctttgccttcttcaactcatgccacccacgcaacatttagttttactatatattacagctttctttacagcagaaaactttgaagtcttgttaaagggcaatacttgtgggtccccttaagatgtgtctctgtgtgtgtgtgtgtgtgtgtatgtgtgtgtgtgttacatttgtctgaactgcaacaaccaagcatggccaaacatttcccattatacattatagcaatctttcttctgaacaacaaactgatttttaaactgagaataaaaagtttataccactgtattgtgtgtagtccatgttctaaatccaggatgccccggagccaaaatgccctttcaggttctgcctgcaggttaggaaatagcaacagtttttgtttgtttgtttgttttctttagggatcaagggggctaggagggttacagaaatggggggcagcttgagctgagactgctcacacggctatctctgcccatgtgacttgccccctcttgacagtttccattatcattccagttcctttgaagtgcttgggaggaggtcttagaaaggtaaagtgtccaggaaaagtttgtcaattattgctggcggtggcaccaagtcttccaatttcaggtagaaaatgcgctgtagcccctgtgtgcaaagggtacgaagttctgggagcttccccaacagtttggacaaataattggggcggttcaaccccccattgttgaaagtcacgtggtctttgagacaatttacaatcttgttttgcagttcttccactctcttgggttccttgagcccgtgtctctctgcagaaaacataatcagaaacaaaagaagaatgtacaagacagttagctagttggcaaaaccaaggagaatctgtgacaagggaaactcaggacaaatcctgctaggcagttctggaggggaagcgccctgcgcctgcagtactgacctgtgaccatagccagggcagcaatgcaggagaaggcagaaatgtcgatgttcatattctgcaagttggaggagaattcaacaatggaatcaatccattccccaaagccacgaacgcattgcaacctgtgcaagaccaccccattgcaaaagatgagtttaccctccactgggttggacctgcaattaataccaaagagagagaggggagaaaaagagagagagaaaagctaaacaactaattacttgaagagcaataaatgagggatttaagagtcacctaattactgaagagttaataaaatgtagaccagtggaccttgaaagggtttaatttcataacaatcaagaacgccccctatcccacctccattccattcatccaaggcttctgggctcgcttcttctcgtctttttttgttttctttctttttcttcctttctccgacttccatttcctattctgtctttttctctaccccaccctctggtttcccttcctccctttcttttcctttcttgatttctctcacagcctccctggattgtctccctccctcccttattacctgtatgctaatcgaaggacaaacagttctaagaaagctgattcaaaaagcaggtcttggtcggctttgggcaggtctgcgaagccagggatcttctctgcccagccccggatgatctccatggagccagtcaggagatcatagaattgctggatatgctgggtgtcatctccactcatttgatagtcagggttcgcctggaactggaatttcattttaaaaagcacttaatgaggttctctaaaatatataacccgtgaaattgctaaccccgtttctaataggggagccaggtttttataacaattaaacctctctctgaccagtaaggaaattagatgttccggggcaattaattcaattagggatggtgctacgaggtcgctgctttaaatatgtaaattgccatttccatacagactaaatacagtgccatccagccctgggaaacgttcactcttatctccacaaaacaattgacatgttagtattcatgctagtcccagagtgggcctcgagctgagacgcccttttgcaaatcttaataaaattgcagtccctaccaggtttgctcaacatacttcctccaattaaagcccgcatatttttcacagctggagtaaaaaggatctgaccacttgatcccccaccccactggcattctttacaccctctccttcccttccctgacccccagacaggcccccacatccttccccagcacagtgccaggaaggatgaggattaaagcatctatctctatggaggactgggaataaagtagattgggaagggggagagtttgcacagcccctggatttcatggtagaggcactggtgtatatggaagaggaggggcgatggggtagtggggtagtgggaattcacacagcttcaaaccctgtggcgtgtccctctcctccttcctccatcctgtcctcatgtctatgcccccagctacatggattgtctgaagatctgaatcttgaggccctggccagagctgcgaggcatatacagccttgcttgccttctttacccccgttgaatctgagagttaatgacggatgtggggaggggtcctgcccatctgtcggtttgtccacatgatatcccccccgccagcttcttaccctggaatagtccaggctggtcatagccgggttggagtcgacatgggccctgacgagggcactgatcagactcaccgggggcgaagggggagagggctcctgtgggctcttcggtttcgagggcaaacgacctctccggccttttaaactgtctgtgcgaaccactgcaaaggaagagccctgttagcgccgcttttccgagcccaggcccagctgctgcctcggtccctccccggggaaggccgcagccgcggggcaccaggctgagcggctgagggccccagtgcttgtaaagccttcactgactagaagcattaaaaaatgcggggttattttatgtcttcctccaaatgggtcgtatagttaaaggagagaagggcctggcggctttctctagggaaggccgggcaagcaggcagctgcagggtcctggaggccatactgagggggagtcggagatccccagcaccgggaagtggaacgtgatgctggagtatgagcagtggtttcctaaaggcgcaaactggagggtcggcagctcccctcagcctaccttctttgaccatcccaacagccaggcacttctgaaatcggcagtactgacagcgattccggcgacgcttgtccactgggcagtttttatttgctaaacacacgtattttgcatttttttgcactgtgcgctgcaaaaggagacaatatagaccaacattttttttcttcttttgaaaatcaggcaactcggagaaaatttctgttatgtgactggggtctacgattcctccccacaaacaaacacatacacacaattccattttatttttttctcttccttttctttctttcttttcttttttcctcccccagggcatttaacagaagaaaattgatagcgttaacatttgagctaaccttgccgctccttgctgtgttttatatgccaagagaaggagaaggagacgctcagtaaatacaaatccgtgggcattcatattatttacattccttggagaccttctctatttaaaatgataagattattcaatcaggatggcgaaataaagagatcacttaatttgaccatagggaattctgttccacttggttagctcagacacggttctctgtcctaaccaatttcattctgaacagggaagacagctcctagcacatgcaaatgaccctcttccaactccggctccagcaacttcgggcgggggccagccgggtcggctgaatgcgagggggatgcgaccctggcctcccagtctttctgcttccctttctcagacacccggaagtccccgccgcagcccatggtctcctgcagggcagcttcggcggaccccggagagctgggcagtcccgggagagctggggctgggctactggcaccaaggcagagggcacactccgaggtcccgggcactaggggctccctacctgcctactccgctcccgccattgctcaccttaaagaagcctttgcagccctcacaggtgcgcacgccgtagtgttggcaggccgcgttgtccccacacacagcgcacagcccctcgttggagggggagccccgcgacggcggtgagggcacctgcgtgtcgagcagctgagacgcgtggccgatctgcaggcccgggaagcccatggacgcgggcttgcgaatggggttgggcacagcgaaggtctgcccgtccaccacgtggtggctgccggcgggctccgggttcatggggacgtgcaggggcccgtcgaagcgcatctggcaactagacaccggggtgccagggggcgattgcttaaaggagaagagggagaggcgggagactggcgttttcctctgctcgatcatgtgcgtagtggccacgtagttctggtggaagttgtggagagatcccgggtcgtcccacatggggctgtgctgcacctggaagcccggggtggtgggcgtcgggggcgaggagggcttgtagtaaaccgacccggagtgcggcatcatctcctcagactgggggggcaggtggctgtgttgctggtagttgtgcatctgaatgtcttctaccttaatggaggactgctgtccggacaggggcatttggtacaagcaaggtggcttgacgtcgtagcctgtgctgtagttgtccataaaggtactgaagctggggagagaagtggtggcagtgatttcagtgttggtgaggtccatgctaaacttgacaaactctggagttaagaaatcggagctgtattctcccgaagagtggtaactgtagctctgagaagcggggctggctccttgaggcgaggacccatactgcgcctgaacacaaggcatggctggaaatgaaacagggtgataacacactcagcctggtcaactgaacactttctcccgggctcgggtacacctggagctacaccggcagcccgcggcagtcagagagcatgtaggggcgcgagaggaaaggcaggagagagagaatgctgcagaacaacagtttagggcgtggaaagactaaccaaataaagacccagagctaaaaagctactgagggtctacactcctgggtatttccaaacatctccctcatacccccccactcatcccactcagatgagcctcttctctgaagctcagattcagcagtctctttctagaaatgaccatctagaaatgaagttgaatttcacaatgagaaagttgttcccgaaggcgatgggtcgggcaaaccttaagttacagggtttgccttgtcctgtttcttgatgtttggggagctctggagagtaaaggaaagaaatgaagttgcactaaccttcagccgagttacaggcgttttcgaggaaattaaaggtggacagtgtcgtaattcaatgaaggacaaagtttccaagatttttagaaaagcaatggggagtccagcctgtccaatctcctccctgaaatacagacacaggaagcttcagggtttcttcccgacagagattcagctgggcatatgtagactcaccaggcaggcccttccatgccttccctgtttgtctcattggaaatgagtgggaagcctttaccaaacatagcacttaaaatgaatgtataaaagaaatgacttgaaacaacagaaaataccacccattgcactgtgtaaatccttgcagagagaagatcctgcaagaggaaagctagtccatgaactcatttaacatttatgatgtaatgaactggcccctttgctacagtgtaggtggagaggtcatttccatcttaggttaattcaggacctgagtatgaagactagagtatgaaaatacagcattggaaccttctcttgcatttttttttcttgtggtgaaattgccttttcttttggtagaggggaagaaagtagaagtcaagaatataaaatgagaaaacaatcttcccccttacaaaatgttagaaaggccttgactgagaaggcaagttgagtggaagcatccgcacttctaaagtgcttttgacagagcactgggattggagctacagataaattgatgttcacttttccagaaaacttgtctttcagcatctttaatggtcacaaggcttaatggtcacaaggtgggaagaggggatctacttttccaggagcttcttaggtcaattgcagaggggggacatactgcttatatggtattggcaccaatattagaagtgtttcccagcacagcaagatgaacaccttccccataatgccttccacaatctgcctttctggaacaaggcattcttgtgtcctagcaattttcagatgttcccacttggaagacattctagagcacagacaatcttattactaatgaaaaaagaaagccagtatcctctctttttattctttcccctcccccacaatcttgcttcatagtggtggtgggggtggggggaagattacccagaaaaagcagaaaggagactcgaaccccacagcccttagagatattcctgtgttggatattaaccccctggtagctccacagtttcataactgtactctttacatattcatattctcgctctgatacattcgcaaacccaaggacagcatatgtcaaaaccagaaatttcaggcaacttagtaacaggacacgctaccaacaccacccttactcaacaatacccgggaaacatcgcgcgctggccagccgcggagacacagttcccaagcaacgcataaactgaagaacttcctctccctgtcagtttgtgggcagcttccctcgtatacataggacttggagtctccgtgttcacaggccacaatcaattcctcactaacagcaaactttgcgcacatttccgcgggctagtcctcagctcccaaactgtggagtctcccttccacgtccaccaatgaggagcctggaaacctctgtcgagagccaactccccactagtgccaaagccggagttcgaacaaatgccccccggtaactgcgcgcacgcactccccatccttcggtcccactctcactagaagcctctggctcccacttccagagaacctgtcccacacaagtggaaagaagagacgtgcaaaagaaggaaaaagcataaaagaaggcgaactgcatgggctgcatctactcacttaggagttctccgcgtctgtcttcattcattcaactctgccgaagtgcagttccctctgggagcccgggcgccggggtcgggtaggggtgggagagctgggcgaagggaacccggacacctcacggagggagggagcagggacaggcggccggctggacaggcaaaagggaccgcggagccgtgcgcgagccgccgggcggactggccctggccgccaatgtgcctttgtttatgtggcttgcgctgccgctgccaacatgcacctaaagtctccgcgcgtcagcgcgcgtcagcggcccgccgcccaatcgccgcgctgccgcgctccctggactcctggcccgcgctcgctttggtatatttccgacctgacgtcacgagcagggccgattttaaggtgggaaccgctctgcgttcaccttggtagccagcttgggtggtttttggtgttttttttcttttctttttttttttccgaaagaggtgtgacctctcccaggtctgcgcagcccgcagcgtcgcgacacttcactttccccgaagcccctgcgcccgcgcagcggctcggccgctcacatgtggggagggtgcaacaaaagcaccggcggaaggcaaggccggcgtggccaggtagtacgcacctggagccgcacggaatgggatgtgccttgcagcgccctaacctctcccacccaccttcgtcacccccttagcggaagagcgtacagatgtcccatgacacgagacgctcagagggctcacgcagttcgggtgggatttccctacccggttcatccccttttactcccttttcctgtcccaggcctcctcctcttctggcatatattcattctaattatctctctctctcactctctctaccccacccccaccccccacactcccatctgaaagggaatgggagtgggggtagggcttatttttctatgtttccttatttccatgcagtgcccacgttcgatggaggacgtggtgcttgcgggggggggggagaggaaggggagagggtagacagtgaccgtgacccagctctttagaaaccccaaaagtcagagtgaagcgtcgccccttttcctttcgcagacaatgcagccgagcagcaggcaacaggtgcgccttctgcagaaaggtactctgattcccaccttctgcaaactctaatactttcgatactcctctgtgcccaccaactcgtaccccttccacgagttttaagggaataaatcgatcttcgtttgaaacacaaggtctatcacagcctcaatcttagagcccagaaagactggacaagaaaagcgaagcgggtggggattgggggcagcgtctccgcaaagcgtaaggtgtgagcctacagcccagccaggagaggggcccgagctggctctgggagcgtgtcccacccccgcggccgtccaagtcgccgccgcttctgctttgcaagtcatttcccctagccacgccgagagcgcagggagctttctagcaaaggaaacgccgcagctccggagggcaagccccctccccgtctcccggccggagctgggagggcttcctagggcttctcccgcggggcttccagcggctgggccttgggagggagagttcggagccgcccccgcttttctactcgcgcagagcgtcccagccgcccctcctttctcggtgtggctcgtttccaggcagccgggacccttttgcaacttgcccccctactcgtgttctcagtaccggccgatggctccgtggaactattcgggatcccgggctgctcaaccctaatctgcagccccgcctttgcctactccctgctgcccccagctcgccggcggctggggaggcgttgccatcagatgccctgcggctgccccaggaagccgcgggctcttttgcgccgcagcctcggggaaacctacgtgaccaccttaagtttcccccagatgttgcggctgccgctgctgctgccgccgccgccgctgctcggcgatgccctagcgggcgcgagaaaaaaaataaaaccaggaagtgggtggggggggcgggttgtggtggcgggtgagggtgtgtgagtagggggatgaggaggggagggcgaagaatagcatattagcatgagctcggtagcgtcagcgccccgtgggcagaagcgattccatgcgaacgaaagggaaaaagtgagagtttggagagctggggagaaggaagggggtgggggtggcggtgacgcaggggcgcaggcattgacgcaccggccaggctgggcccaaaatagcagcaactccagctcagaggcgccctcccgggttcccttccccttccgcgagggagcagggcgcggccacgggaagctttccttgatccccgcggtgggccaggctcccggccgctattttcaggcagtcggaaactcaagcacaggcacgccggggtggcagttattattttttaatatagtcctaggaaaacgggggccgggagaacttgaaggttgtaaccaccagcctccatacacatactcccgtctaagtagatacattcactctgcacgcttccccctccctcattgccattaaaaacacattcagtttaggttgggttgagcctgggacaatttgaaaatgcctccccagagagctgaaaagtgtcctggagttcttaaagtgagctccaaggaagccaaacattgtaatatgatgccttattctttaataacaacctgtcgagtgcggcttcctgataacagcctttgtccaagtcttaatgcaaccaagaatgaagggtcgttttcacagcagcttattataacaattattattaactgggaatataattaaatataaaattaaatataaattaaaatgagagaaaggggagacctttctcatctattccatcatctgtgtaagagttctctcctcttcaaagtcctattctggtttctgggaagcttttactgtttcttaggaagacacgccggatgtaagactgttaaactcgtttaaaccaattttgaataagctacttcttaggctagggtttctgtaaggcccggatgagatgggttggaaaggattcagcatatagatcagaagtgtttaaaaaaaaaaaaaaggccacgctcaaaaccccagactagttttcctcaccagattctgatgggacgatgtctcagtagcaccgccaatgtgtgtgtaattgactgatccagtcagtagggggcctgactccacaacgttcaagagaatcactcacacacacacacacacacacacacacacacacacacacacacacacacaagctatttactacctaagctaaaccaaagagaatgctgcaggcccaaatattcatattgtgctggaattcataaataactaaaaatctttgattctcttctattttctccaaaagggaaacagttttaacacatgggattaggttcacaaaagattttctttatttcctcctgctcatgcttaactcactgttaggtcacagaaggaaaaaatcaaactggtaataaaatctctcattttatcaccaagaagttcaaattggcatacagtttggaaaaatgaaagcatgttttaaaatcctatgattacatgttaaataaattatagtttagaaggagattcctgtgggtatatttgctagtacataagagaatgcttttgtgcatagagatttaattacacatatggaatcaaaatgtagaattgaacaacctttcagaaaatgttaaaacgatgctttaggctaaaagaaactgaaattctgcatttatatgactgtaacccttcaagattcttgaacataaatagttcaaataaagtattttataactcaattaaaatgacaataatggctttttcaggcccccgcagccgatataactttaaactattgccatgtataaatgtgtaaagttaccccacaatgaaggtctattttcttaacagtttttaaaatgagtgggagtaaaaattgcacctatcctcttttgaaaccaactaaaataaattaaaaagcattactattaagaaacactattggatgaccacagaaaaacatttaggaaagtaatgttactatattatcttttatgacattaaccaatattaggcagaacatattggtacatgtaaacatattttcattaaaaatcaacataaataatacatatactcacatctaaaccaaagtagtttattttatgcatggctaggcagattatacttaataaaattgagcttttggcataatttagaaagcaaacatgaatgtaatcccataggattttctattttaatgcataggaaagaggcctttagggatttatttcaccattcttcccaaatgaattcagaatagaccttacaatgcagatatagtgaaacagacatacctgttatgctttacgagttgaggcaactttaagatttttcataataaaattactttgtagaacctatttttagcattacaagatatatattttaaattacatttggacaaactcattcacagcatttgttgccattgggcagtaagtcacattactgatacaagaaataaattttcactttgaaaaaaatctgtttctgaaaatacaaaattagtttttacttctgaaagtgtttttattgttttgcttttgccatttcatttgcattgacaggatagtaattgaccaaattgtttgttcctttctcataggatggttaaagaacaagtcaattgctttgttaatattcacattttggatagttgtagcttttattcagtatttctcagccgatttttaccaaaaaccacttaacacaaatacttttaaaattatttctttctttgatacagaactcagtactagaaatgtgtaaagatgtgcagaaaaaaaacagcattcttttttctggaagcatcttcttgtaaattgaaattataaaactgaacatatggtaaaacctcatgccactcaaaaagtattttgcataataaaaatccttcattttttgttaatacttgacacccagtaaccatctcctaaatacttgcttttaaattaaccacttaatattttcttatttaagaactattttttattaggcaaagaagaataactttggttttagatttcattgctaattttagtaaacataggcatcactaaaatgtacaaagtcctaaaagacagtttaaagattatgaaaataagttgctacatgctaagaaaacatcaaatatctgcaaattctaaaagtagttaatagcattataacactaccagtattagatagcatttatttaaatttagataaaatacatacattttgcaagtttttatatgtaaatcacaagctggctagtttttgttctatctttaatgataaaataaccacttttgattttttcctcagactaattggtggatggaatgtctcaatttaattttaaaaatgaaggtattgataatattgcaacagagacatatatgccctttttctcatcagaattctgcaattatcaagcctacaattttaacactacaaaagtaacttaaagcaaggacccttatagtgataagtaataaatctaattaccatatcctttgaatagatgtaatataaatttcattgctcacttaaaagttctaaagttaacagcataaacttgaagttgagtaattaagtaatccttatatagacacttattaaagtatttatacatattatcttaaatctacatctatcattttgccaattaaaattaggactttaattgcaattaagtaatttaattgccaattgaacagcaaaattgctaagtgactaattttaatgcctattttaattaccaatcatgactggggagggagctaatcaagttacatcaagcagcaccagagtaatgatgtgaaaaaaaaaaaaagggtagaacaaacattcaaggctacatgcttcaaaaaaagaaacataaattaaataaatgcaaacacaatcctataaatgtataaaatactgtatttcaatatctcaatacagaacatgaaaggaaacaagattaattaaagaaacccctgtcaatcttcaaagtaaggacaaccaaagtcaaattttatatggtatttacatggcacccatgctaacccagataaaaacaaaagctgtatacagtcgagaataaaaggctgtttcctgcttggctggttaaatatttacagactggcagttaaaaaaaattcttaaatgaaataccataaaacagagaaacaagtttccaaatgcaacaacgtggattttgcatttgaaaagccaacagggcaagtgcaatggggcactatactctttcctggttgttcctctcagccacactcacttgaatgaagagttctatgagaggcctaatgcctatccatagctgtcccatgttaccctgagaaaaacagacacctggccaatcttaaatattttaaatttattcgggagtaaaaataagaaagcggctaggattacatcacagttaaaattatttggcatggggaatatacctaattcaatagtcattcttcattcagttagaataaacatgcccactcaagataaaggctgaaaaccagcaggcaaccagaaacactggtgaaatttttcttggacaacacaaacatattttcaaaagttttcatattcagactaattctcagattagcaatatggaggggcactattgaaaggaggaggtgaagttgagaactcaaaaaatagaaagtgattccctgtagatagtaacaattctagtactttctgactgtagggtttcccttggcagccagccacctcatttagagtaacaatggacatccatcaaatcttcatttaaaataaaagtcatgctgcaagatacatattttatttttgttgccatatatatataccaaaaatatacctacttatgtctacaaaagggcccaagattattaatgaaatatatgtaagcctataacttgaggaacagcaaatcgtgcggcttgggattttatttactaatggacttcaattgtgaaatgaagcacagcaggactttcggcctggcttttgaagaaggaacactttaataatcactgggcctgacaagactgcaatatctgttcatgacaataacagctttataaagcaagttctgtgtgactgattaaaggacacactcaccgcctattcacaagtcatggagatggagtcattattgacaagctcaccatcactactgatcacatttaagacacatcgagtgctggtgctacaaagagaaataaaacctcagccattaaaagatttaaaaaacagccccagaagacaagattgccataacttatgtatatcttaatgtgttctgtataagattttctcctatatacacacacaaaggatcttatttgataataattatcaaaattatcgaactaaagcactaggtaacaaatcagccactacaaaggaaaaaaaaaaggagaagcatcgtcttataatttcacaataattatgaaaggacatgatatatagacaaactttcaaaatgttaacactttccgaaacttgacatgactgaaagtaaatactttttcagactgttcatgtctatcttaggcattctgctagtcattagtttacatgaattaatgtttacatagtgccagaagcaaaaagttttaaaagtatgtctctacctttcagatatcccttagtaggtaaaagtaaacataaagtttagaaattctagtaagttattttactttttgcccttaaagtattgtcttcccgtgtgatctatctgtattagtgaatagaaaataaaggatacagtaagacaaccacgtttataatctgaaattaaaggcaatcaattaaaacattttattagtcaccaggatatttaaaaatgagacctgtgaaatattgcagaatcactccactaggagagaagcagcaacttaagtatgctgtcactgacatgttgggaggaaaaagcaaactaccagtaccaccatgtacatgattcaaattaagctacataaatagtgagtgcatggggttgtgggtacagaaactggttcgctgaggaggtgctacttacatttcctgtatttcatatttctgagaactgtcttctgtaatttccaaagtgtaggaatggttgaagtttgaaaataaatggagaatttcaaatagttaatgaatagatttaggagctatactgaaacaactagcagaaaatacattttctggagttctttaattttgtacgcttaaaagtatggtgttcctaaagatggctaattcttgttgaagtaagtagctctggaagtcatattttccatttctccatacttcatctattaatcagttgactggcaatttccgacaccagttttgctaaactttataaattttgcttcctccagaggtaggagggggaaggagatgggcaatacagaaacagattttacagccagaatatgacagggccccttaaactacaaatagatgtagaattttaaatgtagctctgtagttcaatttataccacagaaattgcgagatgctatcttcctgttgttataacgtatcaggtcaagggatataaattgtaccaggtaattcattttgctgttcagagagtcattaagttcctcccagaatatatgtgattgatatccctggaggtgaaaggctaaaggaaccatatggcaacatgttgcattccgtatgctatctgcccatccgtgcttaagctgtcattagcaacatctgtaccttacggaaatccagctgcgccgacgacggctgacggaattgtacttggggggaaaatctagcttagcgccattaacttgagacttagagtctatctaccaggacggatggaagctttcacaattagacgagacgacacgaatgctttattaaagtttaattttgaactcccaattagcgaaagtgcattacaaatcgattgcaatttcctagaaggtgcagcaagttctctgcctgcctgccacgtgcgagacgctccacagcgagcttccccagctccgggcagcagaaaggggatggttcagagccgatctccgcatcccaggaagtccctaaaatccgcgccagcccctcctcccgcagggcgggggcgtccacggcgcgaacccgccagaggtgtagggggaagtgtggggggctggtccgcagccttcgaggggtggggcgacaggagcgagcggccgggggaggagaaaaaggcgggcggcgggagagggggcctctattatctcggcttctcgggaggagcctcatctagtcagtcacgcagaagtttctctttcgctcttcgcgctacacacccagattggcttccagcgcgcaggcgagtggggcgaaggaggggggacaggagtcccggaagggccgtccggcgttcacacccacccctgttccgctcctcccgccccaaacaaagtcccccgactctaggtccaggatacgttacctgcccggcgctcccggcccctcggtcaccgcatcccccgctgggcgcgcctggtacgggtcccgctccccggggctcacaaagtggtcgcccctggctgggcggctgggtagatgcccctctctggacatgttggggcggtttttggggtggagggaacgcgggaagtgaaagcggaggctgggacaaggggaacttactgataaaatggaaaaaaaaaaagcccacagggcccaggtcctggccgggggcgaaagaggcctgttacctttcggggggtcgcggccgaccaagaagggagccggggagtcgcccgcccccctcccccggcccccggcccccggcccccggcggctgcggcagctgcacacagaagcccattgtcgccggcgtccggcgcgcagccccgcggactcggccccgcggccaagcgcgtcagcggccccgtcagccgggccgggctccgtgacgcgcgcgcagcccgcgctataaataacctgccgccgggcggctcgggcggctttccagtgacgctggggcggaggcgcggtaggaggagggcgaaaggaaacaataaaaccgcccggcagcctcccaagtctccctcctcccttcccaggccgcccgcggcccttcgcgtcgagctcct

SEQ ID NO: 332 - DNA, 38686 bp, Homo sapiens
gtgagactctgtctcaaaaaacaaaacaaaacaaaaaaatgtgggcttggagtcagacgcacttgggtttgaggcccaattctgttccctcctgggttctgaatcctggctttgtcacttaatagcggtgtcccctgggcaaatgactttgcctctctgagcctcagttacccatctgtacagtgggaatgataacagtccctacctctcagggtcatcagaaggattaaatgagaaaatggacatcaagcacttagcacagagcctggccacaaacagttgctcagtaaatggtagctgcgatgatgatgtgacttcaggcacacctgtctccttgctgacagcctgtttcctcacctggaggataaaggtaacaacaggacccacatgataatgttctttataaatgcagggagatgacatatgccaggtgcctgccaccgtgccagcctggacaccgtgagctcccagccaatgtgagccattgctgttcatattaacaagggcaagagaggagaaactccacctttgtttacctgtccagcagggctcccagcttcttggctacgtgggctcggaattcaggggtggtctgaagctcgttgccatcttgttcatgctcattcaccttatgcctacgacacacacaaagagacctcacttcctgcccgctcagaagctgtccccatgagcacagggaccatgtgtgtcttgttcacctggaaatgccaggcgtgaagcctagcatctggcacacgcaggggatcagtatttgttgaataagtgaaacttgaacccaaagtgcatagtacctgaggctcggttgggaggttgacaactggctatttgcagcacctgtggaaaaatgaaaattagggcatttatagaggaaacaatgacagcaacaacaaatgcgtgccaggcactattttcagcagcttaaaatacatataactcatatatatacatacacatgtaactcatatatattatatttatatataacttaaaatagttatatacccataacttcaaatagttacatataatttagttatatatgtatataatatagttacatattttatgtaagtacattatatatatatatatcttagttatataacttaaaatatatatataacttagttatatatataaaacttaaaatagttatatatataacttagttatatatacataaaacttaaaatagttatatatgtaacttaaaatatatataacacatataactcagtgaatcttcccaacaacccgattggagggattacaattatcccattttgcagaagaaacgtcaaagatatgtaaaataacttggccagagtcaaatacctaataagtgacagggttgggctgggggcccaggccatctgactcctgagccccctcttaaccaccacgctgtgctgaacaggcaggtctaagtgtgatttgactgcacagtttaatgcctgcctggctgtgtgctaagtgccgtggaagagagagaagatggctcttttgtggatcacatttttcaagccaaaacggtggggatgcccggccttttggtcattccctcaaaccagatactgaatgccttttattaaccaggtgttgtcattgctgagcaacttactcgactatcactgtctgcaggagcttacattctagttggtggagagagatgataaacacacatacgtaaacaaaatgtcaagttggataatgctaagtgtatggaaaaaaacggaaacaaagtaggcgagagaggtggggagtgttgggctggggattgttaacataaaggtgggcagagagggcttcactgataaggcaacatttgaacagagatttgagagaggagagggagtgaaccaagtggacatgtgggacacagccttccaggcagagggaaagcatctgcaaaggccctgagactggagcctgctttgtgtgtttagaaccagcaaggaggtcagtgtgaccagagcctgcccagtaaaccgggagcagcagagatggagaactcagaggggccagatcatgaagggccctgacgtgggccaatgggaggacctggactttgaggaggaggagctctggaaatgagcagagaagggacataaactgacctgggttttgacagaacatctttggctgctgtgcagcgtgagactgttggggcaaaggcaggaacacggagtctgctgcagtaattgatgtggtgagaagtgggtgaactccagatagatgcacttttaagatggagtcaaggccgggcgcggtggctcacgcctgtaatcccagcactttgggaggctgaggcaggcggatcacgaggtcaagagatcgagaccatcctggtcaacatggtgaaaccccatctctactaaaaaatacaaaaattagctgggtgtggtggtgcacacctgtagtcccagctacttgagaagctgaggcaggagaatcgctcgaacccaggaggcggaggttgcagtgagccaagatcacgccactgcactccagcctggtgacagagcaagactccgtctaaaaaaaaaaaaaaaaaaaaaaaaagatggagtcaataggattcactgatggactgactacagggcgtgagaaatgagtgaaagttagctctgaggtttctgacttaactaacaagacaaaacgtgcttgtatatttaaggggccaactgaacaaagtggacacttggtagctccgggcccagtggagggccatggtgtaagaaacagctccatgggggcactgctgtgtttatgtcatcacccatacacattgcatctgtgtcctagtaccttgtggtctgtgtcactgtactccagagcacaacacagaatgctaaacacgccccatgctcctggaggtgggtaatgtgggggcctggatggacagtctttaaagacctggtctttcgtcttcagcacataatcacttggaagaagagcatctcttccatcatgactacagtgtgatgaaggtgaggtaccgtcagggaacagaaacagtattacagagggagacagttcagttgagtcctggctctgccaccaagctgtgtgatgccgggcaagtcactttctctccctgagcctttgtttttctcatctataaaatgggaatacgattaccaaccttctggagtcagtgttgtggacgctgtttccatacccatccccttcctggatttgtaagctacttgaatacgtggtctgcctctttttacctctgtatccccagatcctgccatagtgtcttggtttgaattaattgtcagaaaaataagtcaaagtagatgctaccctaaaattaaagtggtttgagtgacgagttcatcactggatttaagagctgtctctagaggttacataaataaaatagtgacctatatttccacagtcatggaccaaagggtgggagttttgaccacaatagacacttgtccatggcagagtggcacagcagcaatgaagagcatggacttgggagtcaggtaggcctgggtttacgcctggttctgccactcacaaattggacaaccttggccaagttattttaccattatgagaatcagttttctgtaaaatggggctaatacaccctcttgtggcattgctgggaagatgaaaacagacaacaaatacaaagtgtttagaacaggggcaaaaagaaaattctcaactcctggtggctattactagacgcactcaagaatgtaatctaggctgggtgtggtggctcatgcctgtaatctcagcactttgggaggccaaggtgggcggatcacctgaggtcataagttcgagaccagcctggccaacacggtgaaaccctgtctctaataaaaatataaaaaaaaattagctgggcctggtggtgggcacctgtaatcccagctacttaggaggctgaggcaggagaattgcttgagcttgggaggcggaggttgcagggagccaagatcgcgccattgcactccagccttggtaacagagcgagactgcgtctcaaaaagaaaaaaagagaccaggcgcggtggctcacacctgtaatcccagcactttggaaggccgaggcaggtggattgcctgaggtctggagtttgagaccagcctggccaacacggtgaaaccctgtctgtactaaaaatacaaaaaattagctgggcgtggtggcaggcgcctgtaatcccagctactagggaggctgaggcaggagaatcacttgaacccaggaggcagaggttgcagtgagctgagatcgtgccattgcactgcagcctgggcaacaagagtgaaactccatctcaaaaaaaaaaaatgcaaaaaaaaaaaaaaaaccccaaaaaacaaacaaacaaacaaaaaaaactagaagccgagcacagtggctcacacctgtaatctcagcactttgaaggttgagaagggaggatcacttgagcccaggagttcgagaccagcctgggcaacatggcaaaaccccatctctacaaaaaatacaaaaagtagctgggactatacatctgtagtctcagctacttgggaggctgaggtgggaggatcatctgagtagggggaggtcgaggttgcagtgagccatgattgtgtcagcctcggtaacagactgagtcctagttttgaaaaaaaaaagagcgagaattaggcaggaggaggaaagcagtccatgtggaaagaccaaccacatatttgccaccatgtattgggcctttaagatgtgccaagcactgtagattgcattatctcagttacttctcaaccttatggggtgggtactatcactacccgcactgtacagatgaggaaatttaggtacagtgagatttaagtactttgctcaagttcccaccgctaatgagatggaaaggcagatctgtaaatagaacttgcagagaaaactgtggttatggtactagggggtgagaggggcagactatggtctggaagctacctacaggaagtgcagtatggcaggagggaaggaagggagaggaaggcaatggatcaccaaagggcttgtaagtccttttaaacaaatccagcggttcttaaccttgctttgccatagccttctctaacagcctggtgaagcccggttctcttctcagagcaatgttttaaatgcatgaaatgcaacatacaggattacaaagaaaaccaatgataccgaaatttaattatcatgatagtaaacaaccaaacttgtgatgtatgtgcttcttacatcttagatatagagatgggtctaaaaattagagtggcacattttaaatcagggatgagtgtaaatgacttttttccccaatatctttttatcaataaaatgatatattgatatctgtatctgcaaagattgtaatgagatatgaaaatctgtgacttctgttgggataaagtaacggcattgccagaactactgtggcttagtgcttgcaagacggaaagagatgctaaaattcagtcagagatgaatagaaagcaaagatgcaacatgttttcattccaaattcaagaacccttgggttctatccatgattaggccccttgatgttgcggggctctgtatttattcccagggcactagggagtcacggtcagagtgatgtgctgggcactgctcttggcaacaacctccagggtgggagaatgtgttggaggtggggaaaggctgggtgcgagaataccgggagggggctgttgcagttatctcgaagagacggcagccttcccagtgtggggcagtgaggatagacccaaggaggcagaatcaaaagacatttgggtacctcagcttccccgactggaataatgaaataccctccctactgcacctgcccatgctttcaatctgcactacacccagtccctggaggtctctcggggaaggaagccgagtcccagtgactctctcctcaccatccatcctctcaggctccaggggaagatcccacgcccctcagccagtctccccaaacatagtaccctaccggctcttggcttccctgccacgtgcgggcgttgctccaagccccaagccggcattgccgcctcgcggcaccgctccagctcctccgcatcgctactgctgttactactttccgaatcgctcactgtgccactgggcgccgccatcttgaaccaccgcaaaggattgtggagaacaccgccgttatcaagcctccttcatgacgtcacgtgagaggagaggcgcgaggcattgtggggattgtagttccaagacttggaccgccattggccatgaactgtactgggttggggataccaggtgggaatggggaggtgggcggttctcaaaggcaagagctagaagggcctaagagattaacttctccaatcatttcttgatgacagatctccagaggggatgggaatctcctaaggagttaatgacagacccaggattagttcccaggttttgattccatgtcatttattctagtaatttcccagtccagctgggcctaagaaacaccttagagagctggttaaactgcagacttttgggtctcacagaaaatactaacagaatcagaatctctgataggtggaatccaggaatctgtatttcctttaatagcctagggccttactacttaagagtgtagtccatgagccagcagcattggtaacacctgggagctcgttagaaatgcagaatccaggctgggcacggtggctcacgcctgtaatcccaacactttggggggctgaggcaggcagatcacaaggtcaggagttcgagaccagcctggccaacatagtgaaaccccatctctactaaaaatacaaaaattagctgggcatggtggcacgcacctgtagtcccagctactcaggaggctgaggcaggaaaatcacttgaacctgggaggtggaggttgaggtgagccaagatcgtgccactgcactccagcctgggcaacagactgagactctgtctcgaaaaaaaaaaaagagaaatgcagaatcctgtccgggcacggtggctcacatctgtaatcccaacactttgtgaggccgaggcgggcagatcatgaggtcaggagttcgagactagcctgaccaacatggtgaaaccccatctctactaaaaatacaaaaattagccaggcaatactgactcccaggacccatccaagaccaaaaaattagaatctctgtggttaaaatacctcacagtgaaggatgaacaaaatcactttacttttgtgtgtggaatgctgtttcatgttttatctttgaagacaggtatgtcaaaactttactaaaataaactctctggccttgagctttttctatttcaaagaagaggaaggtgactgatatggtctgaatgtgttcctccaaaattcatatgttaaaattgacaccataaaataaataacagagagactgactctccaaaataaagcgtttattccagaattgcaaggaattgcaatttgagatatgcatgctatagtggactataggcacattaaaagaggttgtggcaacgagaaaagacaaagtccacataagcttctttaaaacaagtaccgttgatcacaggagcctgttgcaggagttggctttagcttattgtggagacacccactgttaggcaaatattcttatgcaagtggtttatctataatactgcggattttaggaacttcttgagataatttttgtgacaggcatttgttagggtttgacataagtgactccattttgatactgataatttccaaaaagtccttactcccaaggtgatggtattaggaggtgggacctctgggaagtaattagtgaaagggtcttgtgttggttcgaaccccaagagcgtggccaacagacaacatgaggcagtgtgtgtgcaggtgggctgaggcttaaaatggcgtcagcaccaaatgaggacggggcaggggttttgtagtctcctgtaaacaggaagtttctcagtctgttgtaaccgctacattgtacccggatgacgtctctctcggtcttcagggggtaggtgtcttctggcccgctctcttcccgcttctgctatcttgctgacacatgctgctggcgcgagtggccttgcgccttgggaccgggcccaaggagggaggggagggaggggtcattcattctcttaagctttcaggccccacggagaatctttcaattacataatgggtcctgagccctcatgaactggatcaatgccttcataaaagagaccccagaggccaggcatggtggctcacaactgtaatcccagcactgtgggaggccaagacaggtggatcacaaggtcaggagttcgagactagcctggccaagatggtgaaaccccgtctctactaaaaataaaaaaaaaattagctgggcacagtggtaggtgcctgtagtcccagctactcgggaggctgaggcaggagaatcgcttgaacctcggaggcagaggttgcagggagctgagatcatgccaatgcactctagcctgggtgacagagcgagactccatctcaaaaaaaaaaaaaaaaaaaaaaagaagcgatcctagagacacctttgcctcttctaccatgtgaagacttagtgagaagctgccatctgtgaatcaggaagaggtcctcaccagacaccaaatctgccagtgtcttgacttggacttcccagcctccagagctgtaagaaataaatggttattgttcatgagccatccagtgtatggtattttgttttagcagcccagatggactaagacattgcatttttcattcttttttttattttaaacaagaattttcccaccacctacaatgtgggctgtgctgggcattatgaaggacacaaagatggggactggaacagcctgtctacctcctggaaaggaggcactttttctgtccctgaaggcaaacagaggtgggagatacacagattatgattgctaaattgaccagaggctgttgataaccaattgcagtgtgcattttctatgctatggtaggagagtagcccaccagaaaactaggcaaaacaggggggcaaaaggaaactttttattgcttggagtaaacctgatcacatgacgtcctttgataataaagatgctattactttcctacagtttcctgactattatgtactgtttgtgtatgggttttaggagttgaggtgatttttttttacactgcatcatcctcaatctcccattctttgtctctttttgcctcagtttccccagtcctcatttcttagagttgagaagctcaaatgatcaagcaataaccattaggacagcattaggccctgtggaaataaacagcccccaaatgagaactaacaaaggcgatttattcccaacttgctatagcaaaggaaccagccacccatctctcgcttttgacagagatttaaagacaggcaggaaaatgggaaggcttcagggatgccgtgattgaggctgttggtatggggaagctggaagtgcactcaccagaagtggggctaaccatgtgattggtctggggagcttatttgggtttcttgggttggtcataaataggaagcaggatgggagtagggtggggagttagagatgctgccagttatcgcccaagtcctgatggtttggggttgattgctgcagaaggctgtgggtccgaattctgttgctgtgcgtcatgtgaccacactatttatttgtatatttagtcctcacacccctcctcatcctccccctggcagggctgggataatcctttttttaaacggatttacttatttttatgttttagtttttagacacagggtcttgctctgtggcctgggcaggagtgtagcggtgtgatcacagctcactgcagcttcagcctcctgggctcaagtgattcttctgcctcagcttcttgagtgcctgagactacaaatgtgcacaaccacacccagtgaattatttttttattttgtagagacggggtctccctgtgatacccaggctggtcttgaactcctcggctcaagcgctcctcccacctcggcctcccaaagttctgggattacaggtgtgagctaccacgtctggcctgggataactcattgtaaaactggtgaagacctgggaccttcccagtagacaatgggacagagtgattgacaggatgagttctggagtacatggcagaaatgtacagagaagtctcccagagaaaactaactggctggaaacagagcctctcctttcttcttcgagaggatgagagtgtcactgtcttggatgccatagatccccagacccaaccagtcctgcaggacttggccttggaattccagctgctgctgctttttaggaagcccctgctggtcttcaatctgctgcttcagacccaggatgaagctgttggggttgatggcataggcgtagctcccaccatcaggattcttcacgaagacctggatctcggaggggatggtctccagcagatagatgtgagtgtgggagaagatcccatatttggctaaggagcacctgctgctgagaagctgcctctcactgccaggaacctggaaggacagacgctgcaggccagagtagcccctggtcctccggattttctctttaaccttccttatgggctcataagggttcacgatgaggttgaaatctgggtaacccctctgctccactgtcaagtggatgtctcgtgccctctggaagggagagggagaaggagaggtgttaagtccacacttctttgtctgatgtgcaaatgttcccttcatctgtccttatctttacaatagtagcagcagcagcggcagcagcaaatgtttagggagtggtaagcactttccaggctgtatgctgagcaccttccatacccttaatgcattttattctcagagcatctctattagttggttggttctactgttacccccatgttattgatgaggaaactgagcagggttaggtaatttactgaacaccaatcacataggtagtaaggagcagggcagatatgtgaagtgaggttggtcagactccagagtctgtgttctcaccacctccagaggctacactccagggcctgagagccccaggtggctggagagcacctggaaaatgctggcgagggtcaggcctctagctgattctttccagaagaaatataagccttggctgggtgcagtggctcacgcctgtattcccagcactttgggaggccaaggcgggcagatcacttgaggtcaggagtttgagaccagcctggccaacatggcaaaacctatctctaccaaaaaatgcaaaaattagccgggtgtggtggcgtatgcctgtagtcccagctactcggaaggctgaagtgggagaatctcttgaacacaggaggtggaggttgcagtgagctgagatcgcaccactgcactccagcctgggcaacaaagggagactctgtctcaaaaggaaaacaaaaaaagaaaaagaaaaagaaatataagcctggcattgccaagttttctgactagccaagataaaaaatatttgcacaatgttgtgtgtgtttgttttgttttttgagacagggccttgccctgtcacctcaggctgcagtgcagtggtgcaatcttaactcactgcgccttgacctcccaagctgaagcgatcctcccgcctcagtttcctgagtagctgggaccacaggtgcgtgccaccacatctggctaagttttgttcttttttttttttttttttttcagatggaatctcactctgttgccaggctagagtgcagtggcacgatcttggctcactgcaacctccgcctcccaggttcaagcgattctcctgcctcagcctccctagtagctgggactacaggcacatgccaccacacccagctaatttttgtatttttagtagagatgaggttttaccatgttggccaggatggtttcgatctcttgacctcgtgatctgcccacctcggcctcccaaagtgctgggattacagatgtgagccaccgcacctggccaagttttgtatttttagtagagacggggtttcaccatgttgcctaggctggtcttgaactgttgggctcaagggatccacccgcctcagcccctcaaagtgctgtgattacaggcgtgcgccactgcccccagcctacaatggcttttatattcaggaaaaatccagaggcgtatattttccagcccatgggtgggcctcctcatttggccagcgggtccccccgtttatactctatgtaccttactggagcctctgattctgcttctgccttctgctccaagcagttcagtctcctgtcctgtacacatcttgctcatcccagcctcccatcctttacccctcatcatcctttgtcctctgttctgagtgtctatatctccccccggcctttagggctcatttcaactcctaactttttaaaggaatcttctctggtgacttcagttaacatttattctgcttccagacccccagagcccctggttctgctgcctcttagcagagtgcccttagttaattaacctctctgagcctcagttttctcttctgtaaaatggcaataatagtaatgatgataataataataaagatagtgataacactcgaccttcttactttacagaattgcttatgaggatcaactgagacagaccttggacaagagctttgcacactagaaagtgtgatgttaataaaatagatttttgtgatctctgcctatactataggtttggcatcatataataatatgacttagtattttttgtttgtttgtttgttttcagagtatcttgtcttctctggtaattctagcagttttgtgtaagtttgtttcatggatttgcttcctgacaacatagggtgagttctctgagagtgagggtggtgtcttttttttttctttttttcttttttttttgaggcagagtttccctcttgctgtccaggctggagtgcaatggcacgatctcagctcactgcagcccccagctcccgggttcaagcgattcacctgcctctgcctccggagtagcagggattataggcacctgccaccacgcccgcctaattttgtatttttttagtagagatgggttttttccatgttggccgggctggtcttgaactcctgacctcaagtgatccacctgtcttggcctcccaaagtgctgggattacaggcgtgaaccaccgcacctggccgagcgtcgtggtcatgtcttatttctgtgcctgtgttgtcccccagcccacatcccctaccccatccctgagaacagcactggcacagaatggctgattgagctgacttggctggacccaactcacgcaaagaatgatcaggaacacagaactgattctccagtaaattatgggaaaaagaaaggaaaggagaacaagaatttgaaggtaagaaacccaaggctctgagagccaaagaatttgtccaagttcacggagcccatgggtggtgcagctggcccttaaacggtgactctaaagttctgttctccatcaacacagaactgaatgagtaaatactgagtagtttatctgtcgttctgaccttcaagcccttgacagcccagagaggagccattaccttcacgttccagctggagatggggttctccctgttgtcatagcaacagtcctgtttcaggcactgggaggccctctgagcaacgatgtcccatctgtacccttctgccacgttgagggtggggtcggccggatccaggatgatgggcctgtaacacaggaaaagggtgcccaggctcataatggtttgaaggccttcaagccagaaaaaaaccttctcggcaattatttcgtccagccactgagaattgtgatatccacatcccggggatgttcaagagggccccaaaacaccgcaggagagtaacaggatggagacaatgctatttccaagaattcctatctgggccaggcacagtggctcacgcctgtaatcccagcactttgggaggctgaggcgggaggatcacttgaggtcaggagttcaagaccagcctggccaacgtggtgaaaccctgtctctactaaaaatacaaaaaattagccaggtgtggtggtacgcacctgtcatcccagttactcagaaggctgaggcaggagcattgcttgaacccaggaggtggaggttgcagtgagccaagatcatgccaccaccctccagcctgggtgaccgagtgagactgtctcaaaaaaaaaaaaattcttcttctttgggatagtgccttaagtgtttgcaaggaatttagggggagaatgaggccccaagaggcatgctggagtaataacagatgccctttcaggcagggggggccctgtaccttcggagcaggttttgcaagtttaagtttaaggttagagctgctgaattactttggatagtagaaacaccactgccaccaactactgacatttattgaagcacaaggccaaatcctatgcagattaacctattttaatcttacagcaattctataaggtagggactgttatttttattgtttattgttgtggttgtcccctttttacagacctccctaagttcctttttttttttttttttttttttttgagacagagtctcgctctgtcgcccaggctgaagggcagtggtgcaatctcggctcactgcaacttccacctcccgggttcagccaattctctgcctcggcctcctgagtagctgggattacaggtacccgccaccacgcccagctaatttttgtatttttagtagagatggggtttcaccatcttggccaggctggtcttgaactcctgacctcgtgatccacctgccttggcctcccaaagtgctgggattacaggcatgagccaccggtgcccggcctagattgccctaagttcttacagccagtagatgggggctcttacccatctacctcctcaacagagcagaggttgggctgcccccaaaagtctctcctttctataaatattgaataaatattttaaagaatattggcttgaaggggatcttgggcttgcttattaacttggggtgactgcaagtccatgattaacaccagctctttgagtggggcgcagtggctcacgcctataatcccagcattttgtggggccgaggtgggcagatcacttgaggtcaggagttcaagaccaggctggccaacatggtgaaaccgtgtctctactaaaaatacaaaaattagggcatggcggcaggcgcctgtagtcccagttacttgggtggctgaggtgggaggatagcttgaacccaggaggtggtggttgcagtgagccaagatcgtgccactgaactccagcctaggtgacagagcaagactccattaaaaaaaaaaaaacaaaacccaaaaacaaacaaaaaaaacccagccctttgtactccagggcttgggagggagctgcgacttcatctgtgtaatcgaatgtgacacaggctactggaatgaactggactttgggctccaggctggctcctcccaaccctgactgctccctaaaacagtcctgcctgaaagtgccaggctgtcctatggggtggggtcactgatctaaagtggctcattctgttggctggcaggtgacccaacacatggggtctgtgtcccgtgaccaggaatcagactggttctctctggggtttggacatggggatgatggagatcccttatacctgggaggcagaggggagccggacaggtgtggagagagaagcagaggctgaggggaaaagtgctgtagttcatgagagagagtgacagagagagagagggagtctcaggtcctgatgctttctcgatttttctggccatggttataataaatcctcttttcatgagcagacctggcttttcttccttacaaaagagacccaatactacataacagaacactaaatactgtgatgttgcttacacaggcccagagcttctaacacagagagttgtctgggttgggcttcccctgaagcagatccccagataaggatttggcttatttggaaagtgatcccaggaagcacaaataagggagtgagacagtgagacagataagggaaggcagacaacaaagagtgggtattgaagtaattactactgtggtccactggaggcgatctttaggaaagagtatggaatggggcccagtgcggtggctcacgcctgtaagcccagtactttgggaggccaaggcaggcgcatcacctgaggtcaggagtttgagaccagcctggccaacatggcaaagcactgtctctacaaaaatacaaaaatcagctgggtgtgggttgtaggcgcctgtaatctcagctactcagaagcctgagggaggggaatcactcgaacccaggaggcagaggttgcaatgagtggagattgcgccactgcactccaccctgggtgacagagcaaaactctgtcttaaaaaaaaaaaaaaaaagttacgcaatgagacccagattccttccatcttttgggtgagggagctgtggtatttatccaccaactcccaccagatctggtggagggctcttctcagagtgggtctgctggcaaagggatgcaggtgctgacagctggaagtggaaccaaccttccctagaacggtaaaggccgagaggatatgaatgggacgctgacagcacatgctccaatataagcatttactcagcatctgccagatgctagatattgtggatccttaacacagattttctccaacccttacatcaatcctatgtcgtaggttccagtttactcctgtcttatggataagggattgaggctcatagcagtaggaaaatggctgagctgggatttaaacttgagtctccaagattctttccattttcccatgctagctcctacaaagcactgaaatggtcttcagagagcaagaaggccaagctaaggtggagggtggcttaggaaacaaggaacaggcttctacccgccccatggccccccagtgactttgataagccaccaacttgagatgccagctgtgttggtgtgggaggtcgatgctcaactatggtggcagccttactgcttaatacagccaatccataaaactctatgccacgttacactagcccgtctctctttttttctgtaagatttggtgggcaaacagtggtccagtacctctcttttttgagctgttttctgacacaatcctcaatgattgcattgtggagtgtgtagtacttggtccagtagatacagatgacttcatactccaggagcaggtccatcacagtggtgaagccttcgtccaacatgaaattctcgtcttcttcagtacccatttcccaggcatagatggttagaagttcaagagcatagagagggggcagattggctctgggggacctggctttcacatactgttgaaagagatgggaagacagagagagagagaccctaagattctgtgtaaggatggcgttggaccagaagctgagaaatccaagttctagtcctggctctgctgcctactggctgtgtgaccttggccatgtcacattccatctctagacataggtttcaccattttagaattaaagggctgagttagtccattgggcttcaatatatgctcaacagatgtaactcctggaatgaacttatgaacaggtatgagcagattgcgctcggtcacaaacattctagcctaagcagtcccatttaaatctattttaatgtattgagctgctgagaaatgtttcttaaaagaaaggaaaggtttccttagatagagggaaaaaatggtaataggtgagattctgtagtgaagattggggttgcctctctagcagacattctttccttccccattgcatagtagccatgatgtttggaaggggttgacccccacccgcagctccaggatgggccctgactggcacagtcctatcagcataaacctttcccccttgcaagtgattgcttcaagagaaggcatgcgatctaagttggctcaactagagtaaagcctagttcttttgttcagtggttgaaagaagagaagtcctcccatgtgtgaatatgagggcaggaatagttgtggccattttgccaccaagagggaaacaagccaaaggaccaagctgacatatagaggaatgagaagctgagagaattccagagaaacagagccagtgccctcaccagtgcctgaaacccgccccccccgcccgccccccctactgtttaggggttttcctacataagctgataattccctttattgtttaagccagtttgagttggtttttgtgtttttctcttacttgcaaaaggaagcatcttaactgacagtggtcacttcctgtgttaagaatctcactgaggccgggcgcagtgcctcccgcccgtaatcccagcaccttgggaggccgaggcgggtggatcacttgaggccaggagttcgagaccagcttggccaacatggtgaaaccccgtctctactaaaaatacaaaaattagccaggtgtggtggcaggtgcctgtaatcccagctacttgggaggctgaggcgggagaatcgcttgaacccaggaggaggaggttgcagtgaaccaagatcatgccactgcactccagcctgggcaagagtgagaacttgtctcagaaaaaaaaaaaaaaaaaaaaaaagaatttcactgatacattgatatttagccagaaagtgaaaaattttggtcaaatattcagtagtttgatttgtggaagtaaaactgacatattttcctatggccatcatatatgaatattagctcccatcccaaagtcagaggagaaaaaaaaaagctataacactttggccttgaaacaaacacagaatcatcttgtataattctcatctcccaaataaatgaaaccttgggcctttcctataggtcactgacttactaacaaaaaaactttatccttgaccttagaaattcaattttgaattaaaatgtatttataaggctgggctcagtggctcacgcctgtaatcccagcactttgggaggccaaggcaggtggatcacaaggtcaggagatcgagaccatcctggctaacacggtgaaaccccgtctctactaaaaatataaaaaattagctgtgcatggtggcgggcacctgtagtcccagctactcgggaggttgaggcaggagaatggcatgaacccgggaggcggagcttgcagtgagctgagattgcgccactgcattccagcctgggcgacagagcaagactctgtctcaaaaaaaaaaaaattataagttaattaatttgttttgtaactttttgcaaattcatccttaacactcaattttgtaaaccataactaataacattataattttgttagaaatttaaactcatggtaatataacttattttcttcaatattagtgaaatgttacattcttaaaacttagatgatatataaaatgtaggatgcctgtaatctgtaagatgtaagccttagtgaatagataaaaaaaatacccagctcaacttacttcacctccggggctcaagtgatccttcctcctcagcctcctgagcagctgagactacaggaacccatcaccacccccagctaatttttgtatttttgtattttttgtagagacggggtttcactatgttgctcaggctggtcttgaacccttgggctcaagtgatcctcctacctcagcctcctaaagtgctgaaattacaggcgtgagctaccacatttggccggtaattgttttttctttaaatccctgttatattttattttattttttgagacagagtcttgctctcttgcccaggctggagtacagtggcgcgatctcggctcactgcaagctccgcctcctgggttcacaccattctcctgcctcagcctcccgagtagctgggactacaggcgcccgccaccacgcctggctatttttttgtatttttagtagagatggggtttcactgtgttagccaggatggtctcgatctcctgatctcatgatctgcccacctcggcctcccaaaatgctgggattacaggcgtgagccatcatgcccagcctattttatttttattggatcaaatctttccttctgctgtctgattcccttgtaacttctctgcaagttctatataataaatgatttttgtctctgagttctgttttgcagttggagtttccgttatctcggaggaagattttgtttccaaaactgactgagctgctgcctgagaaatgtccctgagggctgtttacactcacacatgccctcttttcgactcctggggtggaattaaagaaatccttccccttgttagtccttaacctgctgtgacgaatggccacagtacccggcgaagctgacatctgccaggcctagactgtaattgaagggtaacaagaacatgtggggtgggtgtggtggctcgtgcctgtaatcccagcactttgggaggccaaggtgggaggatcgcttgagaccacttcgaaaccaggctggtcaacatagtgagaccctgtctctacaaaagaaaaataaaaaaaattagctgggcatggttgtgcatgcctgtagtcccagttacttaggaggctaaggtgggaggatcacttgagccagggaggtcttgatccagggaggtggaggctacagtgagtggtgattgcaccaccgcactacagcctgggcaacaaagcaagatcctgtctcaaaaaaaaataataaaataaaataaaaataactagtttactgaaatactgtagagcacctatttttctccttccttctctgtttctttctcctcttcctcctcctctcctccttttccaccttcttcactgacggtttcactttacatttcaaaagactagcattctctccctctctacctgcttccatttcccctggctgcagcttcctgagatgaaaatcaggccctgcctttcctcctcaccctcttccctctccttgcccctgccatcctggcagccccctcacctgctggtaccagtgtttcaccaggcgcaggaggctcttcagcttagttggccgatgtttcacgaaatttctctgcagctcgctgaaggatgggcagaaatttccaggaccaccgcaggccttgatcaggctcacatagacctcagggggtggctgggagttgggaagagaaggccctgaggagtgaaggagcaaaggaagagattggggattgaggaagccagagggtggtaagtagtattttggggagagcctgcctttacattggaagtatccctccagggacacttgagacctcatatcttcagaaaccaaaggtttgccttgtctaattgtcctttttgtgaaattcttactctggagaaccaacattgggctttccatgcatcagacccctccctggatgtcctcaatgtccctcattttctttaatatctgttttgtatctctttcaatactcatagggaggccgggtgtggtggcttaagcctgtaatcccagcactttgggaggccgaggtgggcggatcacctgaggttaggagtttgaaatcagcctggccaacatggtgaaatcctatctctactaaaaatagaaaaattagccaggcatggcatggtggcgggctgtaatcccagctactcgggaggctgaggctggagaatcacttgaaccctggaggtggaggttgcagtgagccgagatcacggcactgcactccagcctgggcgacagagcgagactccgtctcaaaaaatatatatatatataaactcatagggagaaccaggaaccagttccatggtacacatcactgagacatcccagcactctcttccttgctaaaatcagatcctgtctcttataccttctccaaagagcaactccacgcagccagccactacagctgataggagttagcacatgagatgaaacctctaggatctgggcttgcagcatgtaggttttacttcaaacacctaggactctgcccgaggacaaacaacaggggccagtgagttagtgctcccaaagcagcccccaaccagtgacggctgggaagctggtgagtaagcacgccagcgtcccacttgggatcccgaagaggttcgctccataatgggactgtgagttctcccaggacatgaagctcagggtggtgacttgcccatggacgcacgttgtattgaattcttgcctttcccatctcagttccatacttccctaccggtgtttcctgggaggaatacccaaataaactgcgtatcctcacatccatgtcttaggatctgcttctataaaatgcagtgacagacccccactcccacttttagctccttcccctcactgggtgtcagagcctcctgaatgttgtttccccagaaagtcacttcctgagcaccctttctgtggttacccaggccaccccattctttttctctgagcatttacaccatttgcaatcatgtttttttgtttgtttttttgttttttgtttttttgagacggagtcttgctctgttgcccaggctggagtgcaatggcgcgatcttgactcactgcaacctccgcctcctgggttcaagtgattctctgcctcaccctcctgagtagctgggattacaggcgcccaccaccacacccagctaattttttgtatttttagtagagatggtatttcaccatcttggccaggctggtcttcaactcctgacctcatgatccacctgccttggcctcccaaagtgctgggattacaggcgtgagccaccgcgcccaggctgcaatcatgtatttatctctgcaattctttggtcaatttctgtattccaagttgagcaatatgatagccagagttgagttaatcctgtgcactgcaataacccagccccaagcataggacacagatgaaatgaataaatgtgggtgtgtgcacgtggccatgagtaaaggtgagacactgggaagtctcctggggtgggcaagtgtgtgagtcgggtgagcttcccctccccttacccagggctctgtaggcaggcacaatggtgaccgtgatgggctccgcagtccccctggtctggatggtgaagacgagagcatcggggactctctgctccatcctcaggtcctcgagcccgaggtccagcaggtcctggctttgccacatggttttccatatcagcctcagaacatctttgtgatgcttggctgcctcctggaagctgtggaaacagctcagaaacgccaccagctccacctctctggtgctcctgagaaccgtgccattcccgaaggagcccacctgcagaacacagagccccgtcaccctgaggcccactgccatgagccaggcaacccctgcggcacttcacatgcactgtctcactgaatgctcaccacccgctgagggatgggttgtgggtagtactaatacccacactttacaggtgagaaaactgagatgtctggaggatctcgagacatgggatggagaaatggggcagcctgaaaaagatcttgacacttccctgtttcttagctaggtaaatgttctgactcctaagaccttcatctctaaaatgaaagcaatggcagaatatgagtcactgggctactgggaggatcagatgaaataatgtatgccaagggtttggtggggtgcctggcacacaggaagtcagcaacacatttgtctttctcctcattagtcatttgtctcaggtctcgcagtttgcagccctcagagcccagactctttttttttttttacacagggtttcactcccgttgcccaggctgggctgcagtggcatgatcttggctcaagcaatcctcccacctcagtctcccaagtagctaggactacaggcctgcgccaccatgcctggctaatttttgtattttttgtagtgactgggttttggcatgtcgcccaggctggtctcgaactcctggactcaagcgatttgcccccttggcctccccaaatgcccagcttcttatctactacactgcattgcttctgagacccagtcttcttacccacagagtaaggcctactccagaggaatggtagcatctactccatagggttgtttgaggattctgggggtggtggtggggctgaataatttcatgacattataaagcaaggagcaagtttgcctggtggatttaagagccataggctgtgaaatggagcagcctgaaaaagatcttgactcttccctgtttcttagctgggtaaacattctgactcctgagaccctcatctgtaaaatgaaagtaatgttggaacaagagtcactgggctactgggaggatcagatgaaataatgtatgccaagcgtttggtggggtgcctggcacacaggaagtcagcaatacatttctctttcttctcattatccagctgacttagacaatctcttctgctgccggggggtcagttttcctgttagtaatggaaggaggtcgagaagggatttttcgatgttttgagattctagatgagctctccaggccctggtgcctctggtatgcaaagcgccacaactctctggcctcctctccttctcattctgtgttgggaggtggaattgctagggaggcatcagacccccagaaggctacttttcttggtggttggagtcactgcacaagaatcagattccagctgttgccggatgatataacatgccctgtgtgacatgagcacggatgctggatgacatgagcacgccctgtgtctggcacccataagagccctgtatacatattattccttttaatctttacttcccagccaggcatgatggctcatgcctgtaatctcagcactttgggaggccaaggtgggcggatcatgaggtcaggagttcgagatcagcctggccaacatggtgaaagcacatctctactaaaaatacaaaaattagccaggtgtggttgtgtgcacctgtaatccgagctactggggaagctaaggcaggagaatcgcttgaacccaggaggcagaggttgtggtgagctgagatctcgccactacactccagcctgggcgacacagcgagactccatctaaacaaaacaaaacaacaaaaaaaaacgccttcacttcctgtattgaggtgggtactaggagaattatctccaatgtacagatgagaagactgaggcagtgaggagcttgccatggtctcccagccagaaggcagcagagtcagagaaagagccagaactcaagtaggggatggttcttccgcctctttcttcctcgtgacccaaggctgtgagccaggccctgcttccaagggaccatgggcattcagacccagcacctccaccccctgggagagggttggagatggcaccctgtgtgtgaatgaaggacacattccccccgaaggccagtctagacttccctttctttttgagacagggtcttgctctgttgcccaggctggagtgcaatggcacgatcttcactcactgaagcctcgacctcctgggcttaagcaatcctcccacctcagcctccggagtagctggaactacaggcatgcaccgccatgcccagctaattttttatatatatttttgtagagtcgggggtctcaccattttgcccaggctggtctcgaattcctgggctcaagcaatcctcccaccttggcctcccaaagtgctgggattacaggcgtgagccactgtgcctggcgtagacttccctttctgcctttcccactggtaagatccaggcagagagaaaagaacacatccagaacaggcttcctgatttgcttcagttttaaacctatttaagcacaattcatttgaagacgagcattcccttatgtggaccagctccgctcactagattttcagagggtggggaacgggagggtttagactctaaataagatatattattcctcattagtcatggctcactggggattgctaccatttagtggtttcaagaggaaaagtggctatgatgtgcaggaagtatttgaggcttaggtaaatagcatttcctgccgtaaaaactcattcttggccgggcgtggtggttcacacctgtaatcccagcatttggggaggccgaggtgggtggatcacttgaggtcaggagttcgagaccagcctggccaacatgatggaaccccgtctctactaaaaatgcaaagattagccaggcgtggtggaacacacacacacacaataaacttattcttgtagcatcctcctcttaccagacattccttattccctccactttattctcaagtttgttggggagggggtggtctaggagggtctgccagagtcagacttgagtcccaggcccagaagaaagcttggcaagaattataatgatgcttctgtttctgagcatttatcgtgcatgaatcattcagcctgcattgcaccactggcttggtgagggagagatgatgatgatgccccaatcacagatgaaaagaatgtgggtttgagaaagaagagtgggaaggtcaaaaccacacagctggtaaaggaagaagcgaagagtctgtctaatatcaaaatttgtggtttctcacttataaattgtatggcctcaggcttcatatgctggggataggtgcaaagaacggataggggcccagggcttctagatccctctgtgagttggttgcccctagagagagaacttgagcactgggctgggagtcaggggtcctaattctagtcttgcctttgccaccaactcgctgtgtgaccttggggtatctctcaccctctctgtgcctcggtttacttaattttttaagtgagtcattggtgagactgtctgattctccaaagtctttctagctccgaccctcttgaattttgatcttagctagcacaggcggtggcatgaaacagctggaggaagggcttgggggaaaatctcagtgaggggggcttgggtcccttgagtcaagttcaaatcccagcttcaacactgtgtgaccttgggcaagtcacctcacctctctgagcctccattaaaaaatcattttaggccgagtgcagtggctcactgtaatcccagcactttgggaggccgaggagggcagatcatgaggtcaggagatcgagaccatcctagccaacacggtgaaaccctgtctctactaaaatacaaaaaattagccgggcgtggtggtgggcgctgtcgtcccagctacttgggaggctgaggcaggggaattgcttgaacctgggaggcagaggttgcagtgagctgagatcgtgccactgcactccagcctggtgacagagcaagactctgtctcaaaaaaaaaaaaacaaaaacaaaaatcattttattggccggccagacatggtggctcacacctgtaatcccagcactttgggaggccaaggtgggcatattcttgatcccaggagttcgagaccagcatgggcaacattggtgaaaccctatctctacaaaaaatacaaaaattagctgagcatggtggtgcatgcctgtaatcccaagctatttaggaggctgaggatcacctgagctcagggagattgaggctacagtgagtggtgattgtgccactgcactccagcctgggtgacagagcgagaccctgtctctaaaaaaaaaaaaagtcattttattatcaaaaagttaaaacacatagaaaaatagatgatacaactaacactcatatacccaactagttgattcaacaagtctaaattcctggctacatgtgcttaatctaagccacgttaaagtaaattataggcaccaaggaactttgtccctaaaatacttcagtgttcgtgtccaaacaaaagacaaccttctgataaccacaaaactactgttacacctaacaaaatcaacaatgatttcccatatcagatatatgtactatctgatatctaggccagttgtccccaaactatattttacagatggttcattcacactaggatccaaccaaggacctcgcattgtattggttctgagcctccatttgctaatctgtaaactgggcaaagaatagtacctatctcacagagtgcaagaattagagatagtgtatgttaagaggttagtccagtgagcccccaaatgtgagctattattactagactcattctactcaaggcagtggtgcagtggggtgtagacagctaggtgggatggggtattctgagatgtcatcagcatgggctagggataaggaggacaggggtccccagcatccccagggacgtggactctgatactgggttttgtcttgcgtgggggctggaggagcccagtcttaccttgactaccttcagcacccgcacatcctggtccagcccacgcttcccctggaaatgctcctgcctcagaaactcctccacggtccgcacagcgtctagcacctcttccttccactcccggtggggctgcagccactgagccacgaaggagtccagcctggaggctggtgtgctatacagttcctgcatcagtgccatctctgtcccgagagtaccgctgctgggcagatatatagccaggctcctacccagctccctggcacacacctccttttttaaggtagctcctcctcagctgccctccagtgctctgtgggaggagggaccctagcagagaggaaaccaggtgtgacgggctgactccaggtcccccttcttggagacacccttgctgcagtaggggcacaggaggactctgggctgaggctggaatatctggggccaccttaacaggctggccgtctagtcaatctgtcatcagtttcgattctcaacttttagagttctcctttatgacgttgggaaactgaagttggatagtgtttgaccccaaaggaggcaacttgcccagtaggttggggttggatagttgttagtcaattcaactgcttacatctgtctaaggaaattgaggcttgggaacggaagggactcactagtgttcaggtggtggagtgagaatctggagcccaagagaacagactgggaattctagtctacctgtgccagactctaacctctttgaccctcactattcatagagtgggtttttttgtttttttgtttttttttttttttggccgggtcttgctctgttgcccaggctggagtgcagtggtgcaatctcagctcactacaacctctgcctcacgggttcaagcgattctcctgcctcagcctccctagtagctgggactacagacatgtgccaccacgcccggctaattttttttttgtatttttagtagagacgggggtctcaccattttggtcaggctggtctcaaactcctgacctcaaatgatccgcccacctcggcctcccacagtgctaggattacagcgtgagccaccgcgcccggcccatagagtgggtttaacaggtattatgattcacgcactgaaccaagaagttcatgcattgagccaagaagacaaaataagatgaggttcctgttccaaggggactcccagaacggtggaggagacacagaaaaaagagactgcaaaagtccagtgcgatgagttaagtaggaaaaaagcatgaaaacatgaagccggcagatgagtttcatttggtgttagcagacacctgcttgagaggaatcttaaagactggggatccgggctgggcatggtggctcatgcttgtagtcccagcactttgggaggccaaggtgagaggatcacttgaggccaggagttcaagaccagcctgggcaacatagctggacacctgcaacttcccaaactctgaataatattaagtgctccagggcttagtcctgggtccttttctcttcttgttctagacttactcccttggtgatttcagccagcgtttaaatgtttttactctggcaacttccacattttaattttatttttatttatttgtttatttttgagatggagtctcactgtctcgcccaggctggagttcagtgacacaatctcggctcactgcaacctctgcctcccaggttcaggcgattcttgtgcctcagcctcccaaggagctgggattacaggagcccgccaccgcgcctggctaactttttgtatttttagtagggacagtgtttcaccatgttgcccaggctggtcttgaactcctgatctgccctcctcggcctcccaaagtgctgggattacaggcgtgagccaccatacccagtgactcccacatttgtatcttaaatccatacctcttccctgaaatccagactcatgtatccaactccccactccacattggctttgaattccggtctgccctttgccacacttgtaacttctctgcttctgtggtgaggatgattgcaagggcaagaacagatgtagggagatggtcaggacactgcacagtggtgcaggtgagaggcagtggtggcctggagtttaaaactccagtttttgttttaaaaacaaaaagttttttaaaaaatagctaggtgtggtggtgtccacctgtagccccagctacttgggaggctgaggtgggaggaccacttgagtctaggagtttcaggctgcagtgaactatcatggtgccactgcactccagcctgggtgacagcatgagactctgtctccaaataaaaaataaaaaagactggcactccagccaggaggatgagggtacagcatagaggctgagaagtataaataatgctaggatatgccagggactcaagtgtgctgtgtgccttgggatgaaagggtgagcaggggagaggttagaaatgtacctggacaggtgggcaggattgaatcttggagtgctattcactcattcgttcactcattcaacagatacttactgggcacctactctgtgccaggcaggtgctgtggatacaacagtgaacaaacagtagtgaaaaatccctacctgcagatagttttctttctggtagtggagacaaacaacaaataggataaataggtaaaattatagtaaagaagacggtgataagtgctaagcagaaaaacaaagcaagagaagggattaagaggttgtgtgtgtgtgtgtgtgtgtgtgtgtgtgtgtgtgtgtgtgtgttgggggcatgtatttaggtttcagtcttacataaggtgattagggaaggcctccctgaaaaggagacatctgagcaaagacataagaaggtgaagagtttgggaggccaagacgggtggatcacaaggtcaggagatcgagaccatcctggttaatacggtgaaaccccatctctactaaaagtacaaaaaattagccgggcgtggtggcaggcacctgtagtcccagctattcgggacgctgaggcaggagaatggcgtgaacccaggaggcaaagcttgcagtgagccaagattgcaccactgaactccagcgagactccgtctcaaaaaaaaaaaaaaaaaagaaggtagagtgagccacgtgtgtaacagaaggaagaagattcttcatggcagaaggagtggaaagtacgaggaccctgtggtggtactgcccggtggcaagtataaggaacatcagtgtgcctggaacggagtgatcaagagcagagagtggaagggaatgcggtttaagtagtaaagggtggcaaggcaaatagatacaggatcctttttttttttttttttgagatggagtttcacaattgttgcccaggctagagtgcaatggcacaatctcggctcactgcaacctccacctcccaggttcaagcgattctcctgcctcagcctcctgagcagctgggattcaaggtgcccaccgccacacctagctgatttttgtacttttagtagagacggtgtttcaccatgttggccaggctggtctctaactcctgacctcaggcgatccacccgcctcggcctcccaaagtgctgggattacaggcgtgagccaccgcacccagccaggatataagatctttttaaaaagatttattccataaacaaggagcaggagtggataggatcttgaagacgactgttaggagttggctttactctgaatgaaatggggaaccactggggagcattttttgttgttctgtaggagtctgacaccatacattggagagttttgagtggaggagtgacacggtctttcattttaatggaattaatcacattggctgctgggaggaaattaaattagaagcagagggtggagtggaggtgaaagtggaggcagaagtatggttaggaggctactgcaacagtccaggcaagaggtcagttgacttggatcagagtggtagcagtgaaatagtatgttttaatttttctgattttggaacatttcaaacaaagtggaataatacaatgaacctccatgtaccatcaccagtttcaacaatgatcaacttatagacagtctggtttcaattctacccccatccctagattccctactgtgttatttggaagtgaatctggacatcatgtcattccgctggatatattttgactccaaggctgacaggtcttgctaatgggtagagtatgatgagagagaaagatcagagtcaaggtctaagtccggggcttttggccttagcaacagaaaggttgaactgcccttaactgaggtgggataggctgggcatggagatgaggaaggaactcagttttggaactgaagtttggggtgtctgtcagagacccaggtggagatatgtggtggggagttggatatgcgagtctgtattacagggaggaggtctggacttgagataaaatgtgggggtcaccggcatagggatgtttaaagccatgacactgaatgagatcaccaagggagtgatgacacagcaggaagagaaaaagacccaggactgagccccagagcacttaatattattcggagtttagggagttgcacgagtccagcaaagaagaaggaaaagaagtagctagtgaggtggaagagaaatcaggagtgatggtttgaaggccaagtgaagatattgttttaagaaagaggaaatgggatgggcatggtggctcacacctgaaatcccagcactttgaaagtcaagatgggaggatcgcttgagcccaggaattcaagatcagcctgggcaacatggcaaaaccccatctctacaaaaaaatacaaaaattagccaggtatgatggtgagtgcccatagtcccagctactcaggaggctgaggtaggaggatcacctcagtccagggaggtcgcggctgcagtgagccatgatcatgctactgcactccagcctgggtgacagagtgagaccctgtctcaaaaaaaaaaaaaaaaaaaaaaggagaagaagaagaagaagaaatggaaatgatccactgggttaaaagagtgccaggtgaatctgctttttgtcctgagggcagtggcaaatttaggggagtggcatgtagtggagttaagattggtctggctgcttccatggtgaggacgaaccgcagagggcaagggcagatgcagggaaatgcattaggacacttcgcaggggtgcaggtgataagcagtgaggcccaagacaaggctggaagcagtgcaggtggagaagaggggttggattctaggtctattttggaagaagggtgggcagggcttcttgttgactataggtgaggggcaaggagaagacagggatgactcccagctctctggcttgtgtccttgagtaactgttggagccaccattcccaaggagagaaggaggagtgggtatggctgtggggagttcgaggggtgcattttggataatgatttggtagtacccaaggatgagaagcgagtgacctgctccatgtaaagacatatttgatttccctcagtatacacgtggtcactggtaccttggggaagaatgaatcacaccaaaatgaactaatgtagagacagagtctcgttccatctcccaggctggagagcagtggtgcaatcatagctcactgcagcctcgaaccccggctcaagcaatcctcccacctcagcatcccaaagtgctgagattgcaggcatgaactgctatgcctggccaagccccaaatttaagtgatgagcagaggaagagaaatttaggcggtacctgctggggtggccaaagaggtgggcataaccagagttaaaaaaaagtcacccacattgctgaatgcttctgaaaagttaagaaatacagacctgaaaagtactcaagaaaacgactggtgatcaaggtgggcacagttttaggcgagaggagggagctgaagccagattaggctgggtggggtcgggggcatggagaccagaagtgcagatgattctttcaaggagtttgtccatcatgacacattccaatttaacttttcaaactggctaaccccaagtggaaagcatcacatattttaattacataaattataaaagttcttatatttccagtgtttggtagtacctgatccttcagcaataccatattatgaggatttaaagagcagtgacaatttcacaaagctaagtcaacaaccggttaagactccaaacatttgccatatggttacgatgactgacaatgaacttcaaggcaatatagaagttattcaaacaataaacattcagaccttaacctattggttttttattcgacttcgtgaaatctctgagggttacatagctttcaattatttgatcattaatatgttggatgacatttgaggatttcaaaagggaacatgaaatcagtaatgtgttggttttatggtttgttaaaataccacccagttgagcaggcatctgcagggagggagaagagccagtggataggaaggggctgagctaggttttgagcaggagaaagagacacaaagatgagtgttgtcttagcttggattcccctcaatgcagagcatgagacaaggggttgcatgaaggtggtttgttctgggaaatgatctcaaggggtaagtgtgggggattaggaagcagagaaagccaatctgaggaactctttctctttttctttctttctttctttcttctttctttctttctctttctttctttctttctttctttctttctttcttccttccttccttcctttctttctctttctttctgtcatctctctctctctcttttctcttccttttttttttgatgttgtcttgctcattcgcccaggctggagtgcagtggcatgatcacaactcactataacctcgacctcttgggcttaagtgatcctcccacctcagcctcctgagtagctgggactacaggcacaagccaccacacctggctaattttaaattgttttttgttgttgttgttgagacagggtctcactatgttgcccaagctggtgtcgaactcctaggctcaagtgatcctcccacctcagcctcctgagtaggtagagctacaggcaccatgcctggttaattttcagaaaattgtttgtagagatggggtcttgctacctcagacagggctgagataggaggatctcctgaatgtgggaagtcaaggctgcagtgagccctgatcactccactgtactccagcctgggcaagggagtgagaccctgtttaaaaaaagaaaaaattgtccatctgagaggtagaagaggggccactggttctggccttccccttggttatgggttgctccattgggtgttaactcccttgaacttgcaggtttgctcatgcatcctaatgggtgagtaggcacccacagatgtgtcttatgaggtggcggagaatgccttgatagaaagcagggccaagtttcctattcatggagagagattatagaagaaaatggctcacaggctgggtgtggtggctcatgcctgtaatcccagcactttgggaggctgagatgggcagatcacctgagaggtcaggagttcgagttcagcctggccaaatggtgaaaccctgtctctactaaaaatacaaaaaattaacagagcgcagtggcgggtgcctgtaatcccagcaactagggaggctgagatgggagaattgcttgaaccgggaggcggagtttgcagtgaaccgagatcgcaccactgcactccagcatgggcaacagagcgagactccgtctcaaagaaaaaaaaaaaaaaaaaaaaaggctaacaatgcatagaataatgctgccaatttcctctcctccctgtatacacactcctctacaaggctggctttgcagctcctcccagcaagaggtggagtttatttctctatttccttcaaatcaaggcttggccatgtgacttgttttggccagtgagacattagcaaacgcgatgcaagcagatgcttaaaaagtgccggcctagggggacttgctctttctcttgctcctgtcagagcccagtgaccacatgcacaagctcaggttggcctattgggtaaggagaaacctacggtgaaggcagccctattttctcagctgatatatatatacacacacacacacacacacatatatatatatatatacacatacacatatatatacatatacacatatacatatatatacatatacacacacactatatatatcactatatattatatatattatatatatcactatatataatatatatcactatatattatatatatcactatatatttatattatcactatatattatatatatcactatatattatatatatcactatatataatatatatatcactatatataatatatatatcactatatataatatatatatcactatatatataatatatatatatataaaatacatatatagtttgtttgttttttctttagacggagtttcactcttattgcccaggctggagtgtagtggcatgatctcagctcatagcaacctccagctccttggttcaagtgattctcctgcctcagcctcccgagtagctgggagtacaggcgcccgccaccacatccggctaattttttgtgtttttagtagagacggggttccaccatgttggccaggctggtctcaaactcctgacctcaggtgatccacccacctcggcctcccaaagtgctgagattacaagcatgagccaccacgcccagccttcccagctgatattgaaccaactgccagacacgtgggtggagctggtgtagatctcctgtggcaggtgagccagatcagaccaggaaaactgctcagccaagtcacagaatcattgaacagaaaaatggatgttgtggagtgattcactatgcccagaaccaagccgggtccggctgcattttctcgaggcccaataacgagaagcagagaaactagaaaagaagggaatttattgctgtaacaagatacagggagataattccaccagaccaaatcaaagtgttaccattttcttagtgcttatataggttgaggttatgtgcctatgtgccgtatggcattcgcctaagtctattggtaactaattttgtttcaactagaaggtcagaggccaaaaaaaaaaaaaaaaaagacttgctaagttccattaagctgtgagaaccccggtaccttttgttttttgagatggagtcttgctctcttgcccaggctggagtacagtggcatgatttcacttcactgcaacctctgcctcccaggttcaagaaattctcttgtctcagcctcttgagttgccgggaccacaggtgcacaccaccatgcctggctaatttttgtatttttagtagagatagggtctcaccatattggtcaggctggtcttgaactcctgacctcaggtgatccacccacctcaggctcccaaagtgctgggattacaggtgtgagccaccgggcccggcggagaaccccagtacctttaaggcctgtctgttgtgtgattatttctgtcttatctcctttacagcttggtccggattgctgccttagactctccaatgaatttattcaaacagctgcctttgtgctgctgtgttttgcttatctgggagcgagagtttctgtgtctgttcccaggcatcttcttgcagctgcaggcatccccgccacgtctgcttctagcttccctgtagtctttgtgctgctctgcggaaatgggtcggtgtaacggaagtgctatgcaggtctgtgtgtgtgattgtcagggagagttggcctggcacataaaccagctggcaccccctctggcatcatctggactcctggatccacatgacagttaattttaggtatcaggatgcccagagagtaaaacattatcgctgggtgtgcctgtaaggctatttccagaggagattagcatttgaatgagtacactgagggatgaagatctgccctcactaatgtaggtgggcaccgtccaatccactgagagcctggacagaacaaaatgtgaaggaagggtgatgaatttgccatcctccttgggagctgggacattcatcttctcctgccatcagacatcagagctccaggttctcagatcttcggact

SEQ ID NO: 333 - DNA, 499041 bp, Homo sapiens
ttctttatattctgtctcctttctcagattaaaagagggcacgggctggctgggcgtggtggctcatgcctgtaatcccagcagttggggagtccgaggcaggcagatcacgaggtcaggagatcgagaccatgatgaaaccctgtctctactaaaaatacaaaaaaattagccgggcgctttggcaagcgcctgtagtcccagctactcgggaggctgaggcaggagaatggcgtgaacctgggaggcggagcttgcagtgagccgagatcgcgccactacactccagcctgggcgacagagcgagactccgtctcaaaaaaaaaaaaagagggcaggggctacgtgttgtgtattcctgcattcccattgcttcttacaatgtcatgtcaccatgacagctggtagcatttatacatgtaggataagtgaataagtaaagaaatcaatggtcactgtgctttgtgcacaatttcatgtctatacatacagatcagctgcattcttttgaatcactgcacagcattcctctatctggtcttgtcttgctttttcatccagtgtgacaatctctgccttttaattggtgtgtgtaaattatttatgtttaatgtgattattgatagagttagaattctcttttttcattcatttacttttaacctatttgtgttgttatatttaagtgtgtttcttggaaatagcatctaattggatctttaaaaattatccaatctgaaaatctctgcattttgtggagtttttagaccatttacatttaatgtgatttttgacctagttgggtttaagtctatcatcttgctatttgcatttgatctgtaccatattttccgtgttcaactttccccttttactaccttcttttgattagttgtatatttttatgcttccatttttaaaatttctgtttcccctttcgtgactgttagttataactatttgctttgctgtttcagtgccctgtttagggtttaaactgtatatctttaatataacactgtctgccttgacgtgatattaggtcacttcacataccttgtaatagtgtacttctgcatgtcctctcccttcctttatgctattattgagatatattttacttacacatgttataaatgctacagtacacggctacgatgattgcttagttatctatatttaaggagatttaaatagtaagaacaatatcttatatatttaaccacataccattttcaagtgctgtttattcctttgtataggtacttatttctatgtgattttgtttttattttgcctgaagggcttcctttacatttttttgtaatgagagtctgctgatgatcagcttctgtatgtccaaaaaggtatttatttcaccttcatttttgagagttattttcatgggatataaaattctagggttttttttttctttcagtactttaaagattttgtcatttagcttacattatttcctgtgagaagctctgtatgtgatgatgcctttttcctgtgtctgcctttaagattttctctttatcactggttttgagcagttaaacataaccaaatgccctggtgtagttttgttcacatttcttgtgtttggggcttgttgagctactggcatctgtaagtttataatattcatcaattttgaaacatcttcagttattatttcttcacatttttttctgttcacttttgtctgtcttcttcttctggaattttgaccacatgtatattggtctcttaaagtagtcctgtgtctctctgatgatttatttatttatttatccacccattctttttctgtgctttattttgtgtagtttctattaccattttgagttctctgctcttttcttctgcagtgtctaatctgccattaatcctattcagtatattttttatctcagacattgaagtttttctcttgaagtttgactttagccttctttttatatatgccatgtctctaattttttgattgtatgggatgcagttattataaccattttcatgtccttctctatgaattcttacaccaatatcacttctgggtagtttcaattgattgatttttctctatattattttccttcttctttgcatacctggtaattttttattggatgtcaaccatggtggattttatcttgttgaatgatggatatttttatatttctgtaatattcttaagctttgctgttgtgcaaaaagaagttaagcgacttggaaacagttagatccttcctggtcttgcttttaagttttgctaggtagaaccagaactgtgtttagtttactgctaattattccccgcaactgaagcaagaactttctgagtacatcgcccagtgaagtatgaattttttttttttcccaatctggctgctggaaacagacactattcttggccttgtgtgagccctgtatacttactttacctgtgattcagtggtcctttagaggcaaaattttgccccagggacatttggtaatatctagaaatatttttgattgtcatgactggggctgctcctggcatctagtgggtagaggctaggaatactgcccaacatcctactacaaaatgcccccactcccacaaaaaaggaatttttctttcaaggaggtgagtagtgctgaggttgagataccctgatacagtcctttcagatcattctttctgtgccctccagtggtctcctcacacacttgtgtcgatcagtactctgtggaacaccccagagggacccttggcagatcctcagaattctttctccaagtggctctcttttctctagcaacttgtcctgcaaattcttaccacctgttctacggggctcagcttcacctctaattgtgagggtcttctggactcttcctgggtcccccttcctgtgctacagtctggaaattttcaaggcagtaagcaggtgtgatccatggcacagcttaattgtttctcatctctcaggattcactgtccttcactgactgatgtcaatggcttgaaaactgttgttccagatattttgtctttttgttgttatgttttagctatcagggtaatccagttcttgttactgcaatcttggctggaagcaaaaggtggcttcttatttattattgctgtcaaaagttctctttgtttactgtcatgtgtaaagaaaacaacctgcccaactttaacctcctcaatcactattcattatattgatttttctctgtctctgaatcttcccaacaagtctcacattttatattcatagtagattccccttttcctatatttcctttcacagtctttgtggggtgttttttcgagacagggtcttactctgtctccgaggctagagtgcagtggcactgtcatggctcactgcagcctccacatcctagcctcaattgatcctcccgtctcagccacccaagtagctgggactacaggcatgtgccactgtgcctgtttttttttgttttgttgttgtttggtttggtttttgtagagagagggtttcatcaagctggtcccaaactcctgggctcaagcaatgttcctgctttggcctcccaaagtgctggaattgcaggtgtgagccaccatgcctggccttgtgttttaactttttaccgctaacatgatagttagattctcttgtgttctactatttgaaactataagctcaaattctagttatgcttgaatttagcactaccaaaaatatatatatatatatgattttatttttgtacttaattatttcaatttttggatttatacatttgcctcaggaaacataattttctctaaaatgaacaaaagcaattgatttcctcaattattttagctattcaataaaggaaatgctttgaaattcttatggtatgcaaagttgtatttactgttcaattgatataactggcaataaatcataaatactaacattagtgaaaatacaaattgtgagtaacaaaaggcaaaaattttttggtactctgtacaaagaacttaatttagacctttaatctaaaatgtgttggtgtaaattagtgttgctttgaagtctggttattgtgggggtgagcttttccagactataataaagataggaggacactatatagagatatccaaggtaacattcaaggctttgtaatttgtacagaaaacagataaaaatggaagcatgagtgagtttcatctagaggttatttaatcttttgggtttggatatttgttatatttcagtctctacatagatatatataaccttatggaattttagaactacaattgatgttagggatgtttgataaattgtaatcattggcatcaagggttttaaagatacaaaatttacagttaaaatcaagttactttctaaagatacaattaaaagtatttcatcaggattaggaacatgttataaaacaatgtaatgatgtcattacatcattacattacgaaacttctctggccaagtttcaaaatatatttaaataatacatctgaaataaaggataggatcaacctaagtttagtgtccataaggcagggattgcctgcccattcattcattcagtcaaatactttgcagagtgttgggaagaagcaaataaccaagtaatccaacttgctttaagcccagctgtggtttccagaggagtgctatggttagtagctgagttgcgtttcaaggagctaatgaaaattaaccaactcagcttgatattgttgtgtgtttgctgtagccagttcaatcagaagttttttatctgttttgttttttgagacagagtcgcactctgttgcctgggctggagtgcagtggcatgatcatggctcgctctgtccttgaagtcctgggctcaagcgatccccctgtctcagcctcctgagtagctagaactacaggcatgtgccaccatgcccagctaatttttgatttttttatagaaatgtggtctcactgtgttgcccaggctggtcttgaactcctgggctcaagcagtcctctcacctcagcctcccaaagtgctgggattacaggcatgagccactgagcctggccaatcaaaaggtttcttttgtttgtttttttgttttttgttttttgtcacctttctaatggctttccttatttttcaaaggctttgcccactgatgcagctaatgtcatattcattaaatgctgtttgctaaatatgcacacagtgaccctcttccttgtgtaggactgtgcagtcactatcaaagtgctctaacaatttggcattacttaagctgcatttcttaaccttctcgtcttcagccttgagtggaagagataacacagaaaactgccttttgaagtcatattgaactcactgacttccatcaatgaagcatatcagtagttgcaaatattgcagtgtagattaaatcctcgaagagtttgaactatgtacgaaaatgaaaaggagatacagaggactttttattgtttacagtctaagatcaaattgcctcgatctttgatggcataatcaaatactacatcttgatgtattgtggcactggagaattgcttcacaaataaagaaaactcagatatttgatgctagagatgttttagaaagcttaagaatacctaaaatcatctttccattactaggtgttaacatttagttggtattgatttataaactttagaagtattaccacaaagttgcatctttaattgctattactgtgttaaagaacgtactgattatctaatttgcaagattataaaatggtatcatgaaaatgatacagtagagagaatactttttgcccttgaagatccaaatggggccgggcactgcagctcacgcctgtaaatcccaaccctttgggaggccaaggcgggcagatcacctgacgtcaggagtttgagacaagccttgccaacatggtgaaaccccatctctactaaaaatatacaaattagccgggtgtggtggcacgcgcctgtaatcccagctatttgggaggctgaggtgggagaatcgcttgaacaagggaggcagaggttgcagtgagctgagattgcaccagtgcaatccagcctgagtgaaagagtgaaactccgtctaaaaaaaaaaaaatccaaagagaatggaaagacggatggtttaactcagaggtttacacactgttttctctaaaggaccagatagcaaatagtttagactttgcaggccatcaggtctctgtgttagtttcctgtggctgcagtgagaaatgaccacaaccctggtggcttagaacaacaggaagttattctgtcagttctggaggtaaaaagtgtgaggtcaagggccacacctctgcggtccagagaagaatctgcttcgcgcctctcttctgacttctgttggttgctggtggccattcgtgctccttggctttcagggccattgctccaatctctgcctctgtcttctcctggccttctttcctatgtgtctgtgtgtgcctgtatccaaattttcctctcctgtctctcataaagacaccagtcattgcatttagggccctccctaatccagtatgacctcatcataatcttactacatctgcagaaataaaagtaaaaccccattttcaaataagatcacagtcgcagatactgggagttaagatttcagttaagatttatcttttggggagacacaattcaaaccactgcagttcctattgcagccactcagctctgtctttgtagcatgaaaatggccaaggacaataggtcaacaaatgcaagggctgtgttccagaaaaactttacttacaaaaacaggtggtggatccgatttggctggcagagtttgccagtcaatacctggtccaactaattgaagcaaaacagcagcagagcagaaaacgatttccccttgcttcaatcagttcagttttaaagtaccaaaatgcatacatatgtgtatatatagcaacacttattttaaaatagatgtcaatttagggcaagaaatgaaacttttataatgacttcaaatcccgaatctttattactaaaaatgctcgaattatatttttctgatcaatgaaaagctttttaatgatcatttagttttcggtctatagggccctccctccaaaaagatcaagatgatttggaaacaaaatttccctggaactgagacatatttattcactctgtcagaaagaatgtacctgtttccctgactaaatgtatgccccataaggacaggaacatttatccactctttgtcctcagcacctagaaggcagcctagcacatagtagtcacccagtaaatattcatctaaaataacttcttggggccgggcgcggtggctcactcctgtaatcccagcactttgagaggccaaggcaggtggatcacctgaggtcaggagttctagaccagcctcaccaacatggtgaaaccccgtctccactaaaaatacaaaaattagctgagcgtggtggtgggtacctgtaagtccagctactcgggaggttcaggcaggagaattgcttgaacctgggaggcaaaggttgcagcaagccaagattgtgccactgcactccagactgggcaacagagcaagactctgtctcaaaataataataataataataataaaataacttctcttggccgggagtggtggctcatgcctgtaatcccagcactttgggaggctgaagtgggcggatcacgaggtcaggagatggaggccatcctggctaacatggtgaaaccccatctgtattaaaaatacaaagaagtagccggatgtggtggtgagctcctatagtcccagttacttgggaggctgaggcaggagaatcacttgaacccaggaggcggaggttgcagtgagccaagagcgcgccactgcactccagcctgggcaacagagcgagattccgtctaaaaaataataataataaataaataaataatacttctctttgttggaataaaaagagtgaattggtgtgttgttgttttaatcctttggtataaaaatagtctgtcaccataccttgaaattgtttattatttcaatttaagtttgaaaggaaaggtacaatatgagaaattcagtttctcttaagagctattggaagaatttgtaaatgtaataatggagtaatgaatcagaggggtcagtgaaaaatcgttttttaaaataaaaaccaaattcatggaaaagaagacaaaggtagagaaatcaagatatattccaagactaaactaaaatattagcaactactttgaacagctcagtatttggtagccatatcggtatttggaagcagagaaatatggaaccccacaagggaacccttcattggcaacatggagagaggagggtataatttggttgaagacatagcagggaggaacactccaaaccttcccaggtctgggctgtggaactctgtgattattccagcgcagggagtcttgccactcttcttgtagctgatggaaggcaaaacttggaaagtgaggggtacatttgtaacgttacaacagaaaggatcaagaattcttgacaactccaggataagctgagttgacatgggagagagtcagccacaaggctccaagttggaagcacattaatgagctgtatgatgtgtatactgacagtgcatgctcgagagagtgggggagaaagagagagacagtcagagacagagacagacagagacagagacagaccaagactgagaccagagacactgattctttgagagagggactcactttttttggaggtgaagaaactactatctcaacagcggtcacggccaaaggatactacaggaaccaaggagaaggcctgaggccagttgggaaccattgatttcaagttgactatggaatcactcaaagaaaaagtgaatttaccaaaaagtgattttagtggggtgggaggaaaacacgaagggctgaagataaagccttcggggtccttcagattaaaaggagagacaacatgagaaggaataaagataaaggagaaccatttgaaatgcggattcgccccgggccactctccctcttgaaggccccagtcttttgccggcagaccctttcctcccaccctttccactgtcagttcagcaaattcaggaaatagagagtttttaagcagagcaacaccatttgcctcgcttattcgtgcagttgcaggaaactccccccatcaaattagccccttgaattaccttaaatatcacgatttgcgctgattaaattcatttgctagagaggaaaatccattttaagcagaatggtatggggaggaggaccagctttttccacagttcaagacatttgagttcttaaaacatgaaaattgtgccctctgaagaaagagtctttgtaagatatattaaaaaaaaaaaaaaaaaagttcaatgcatttgacaaagtttcagtggcaagaatttcccaatttgttcctgctctttagaatacattgaaaaagaaaaaaatagtgtacgtttataagaaaatgaaagggaatttattttgaatggagaaatgctataaagagaaaaagccattctaacttttccattgtggaaaatttaacaaactattgaagccaatttttagctggcttctgtagtgaaatttcagcgtgagcttacaattttttttttgtattaatggggaaaatcagatacagtagcttcaataaacactcatagcactcaccagcagaaagcgtgcttcacctcttggtgatacaatgtattttacactgatttcagaaatactaatttcttgttgaaagcaagtttcctagataagcaatactattgtttcctaccatcccagattgagaagggtagagagtagccagtttttaggtgaacgtcatgctgacctcatgcaaaccttgtatcttcacagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggtgggtaactgtcctagtaaaataaggcaatgctcacgttactaacttgtaggtgtcgtgattttcccctcaaggtgacatgtctgttttctgactttggcgttccatctgctgattctgattttgagatattagatcatcatgcagtattccagatgagagatagaaagccaccggtgggcacattggtgccccaggcacaggcactgacacgtggagaattccgaagcctcacctgctatacgtgaggtttatgattctgcacgtggcccaagcgtttgtacaaacttgtgtaaacttgaaactccagtctctggggctcccttttagttgaatgaaggtgctcacagacattgtgtctgtggctagaaccggtacaaggagaacaggagctgttggtgaagaaacccatctttccctcacaagaaagtgtggcttattaccccagatcatctcaggacccaagcagtcctgctgtttgcctctgtctgattcacacaaaagcctgccacggaaaggttccattgtctttctcccaggcaacctagtaaattaagtttataccttaacacttcctagtttcccacaatgtaatccactagggcttggtcattcgcgtctatctgttgaacatttttacactgtttttggcctgaggatgctcccagtggaatcatgactcctgtaactttacttcactctcctaaacctacccatttctactcttaagacagtaggttattttttattagacatacatagttatattttgtttcttctaatacagtcttgagatgtgggcaagattactaataaaaataaaatcctcttacatttgtaatgtgcagtataatttacatataacttagcattctttagctaatttaatctggaaatgagaaaaaataaattaaactttaataataaagaatatattcattcttttccaatcaccgtacagacagtgtgactaacagtctgatattgggcaggaacacatttaagaaaaagtaataatgcaataaatcgttcaaaagttggaaaattttccatggttcttttcttccctgcattgtgcaaagagccattgtaactagattgaaatagtgttcactcacccaagccggtttacatcaaagaaaactcatttgattcgctaaggagagatttttataccctaaagcatgccttactaattactggtatcaaattttatgaaaagggacaaaatagcttaacatttttaatccgtttttcaggggagatacaaaacatatttgaggtatgtactcttagttgactgtacaatgtattgtaattttaaacccatttttttcatattgtctgcacagctgaaatagattatcagtgtacattttttcaacaatttaaaaaatagtaagtagtgtagaaatgcatgcaatctgcaccaaatgtgaagtcttgctttttgtatcaaaaataactctttagtgccctgttggaaaacgaaaaaaaaataaaaaaattaaaaaaacccaaactccacattgtggaatattattcgaaggaaacagcagcacatgtggcgagatgcactgggggtcatctccaccccggttatctccacaccaggcaagcatttctttttggcagcacagacgatgcctacacaggttaaaaatagcgcactgaactgttctcctcctaggcagccttgatccagcgcagactgttgttgacaacccggcggtagcatttgtagaagccctgaaacggaggttcatagggggccaaagagtgttattcctcactccttccaagccaaggactgcagaatccaaaggggcggaggaaagagaaagggcgccaggcggccagggaggccttgttggagagcagaagtgaatggagaagcgctcgcgcagtgtgtgatggtgccgcaggtcacttgatgtgtatgaatccgaactttgtagaaacgtaaatgggatggactgctagttacagctaatgctgccaccctactgcgtgctggtcagtgcgctaggcaggtgtgtgaggcagctcccctggtgaggtgggtcccggtagcgtagtcttttcacagattgagacggatgaggtttggagaggctggagaccccatggctcctgagaactaagctggaacttgagcccaggcttgcctggttctggcctggcttctaatctctgtgcagttgccacagtggaaaacaggcaactcagtaaaatatcaccctttgatttattgcagtcaattttttaagtctattatcattattattaattaattaatttagtgacaagctcggtctgttgccaaagcctgactgcagcggggcagtcatagctcactgcagcctacagctcctgggctcaaaaaatcctcctgcctcagcctcctgagtagctgggatcacaagtgcacaccaccaccatgccagggtaattttaaagacattttttttaatagagacagggtctcgcttgttcctcagactggtctcaaactcctggcctcaagcaatcctcttacttgggcctccctaagtgctgaaataacaggcctgagccaccacgcccagcccattttagtcaattttgaattcgaatgttcatggtgtggatagtgaggtgtgagcaaactgtaggcatatttaggaaataaaattgatatgattctgtaattgggtgaatgaggacgagtgtgagggtggcgttgcggatgctttctccttcctgtggtttgatatgcggagtatttgtagcgggagtggtaggtgtaggagagaaacgagtaaggaaagtctgctatcagattatgtttttcttgagcaagcataatgagaaatccttccaggctttcattttctttgaacctgacaaatgtcaattttttctcacggactattatgctatgggattaattatttaattgagaaaatgtgcttcctgccacagctcctgacatcatataggtcataaaaatgaaagattaaaaatattcatagtagccaaatatcattgaaacaattccaaagagtcatgctaatttagctttttttgtccatggagttttaaaacagctgatcagtcctgtatccatttactccttgaatgacacagggaaatgcaacttcggctggagaaagggacaagcagggtttccgttggtgcgattatatggagaattcaaatcgagaaatatgatgtttttatatttttaattgaccaattttatgtctaattatcaaacttgaatttaatggttttgtatggctttactgactggcaggtgactactgttaattacatgttatatttaggtagcataatgctggggatcatttcttcttcacagtcattgtgtaatttgacgggatctcacattgatctctttctctttttaaatctcttcatgtagtttgttggtgatggaaatgttgctctttgaacagctgtggagcttttgctgtaggtgagggtgaggttagggtaacaatggcttgttttgcattcttagatgctattttcttttattaatctttgaagaaaatttatcccatcaggtctcagacaaatttcttatgaaacagctgcataggatcatcccacagcttttggagaagtggtaaaataaaagaacatttttcctctgctgcagctctgtgggctatgcacatgttctgtagtattcttgaccaaacacttatcaattccaacaaggaacgctgcccgtgagggtgaaccttgaaaagagacgatgtctggaagtaagaatacatttgttccactgaatcataagcctgaaaagaaccactttggggccctaacccaaagtatataagagttagtcaataatcagtgttggggttgtgaatttcagaattttaacatttgaagactaccacttattctttatttgtagagtggcaatggagaggaaggactctgttttttgtttttgtttttgtttttgagatggagtctcactctgtcgcccaggctggagtgaaatggcatgatctcggctcactgcaacctctgcctcctgggttcaagcaattttcctgcctcagcttcccgagtagctggaattataggcgcctgccactacgcccagctaatttttgtaattttagtagagatggggcttcaccatgttggccaggctggtctcgaactcctgacctcaggtgatccgcccacctcggcctcccaaagtgctaggattacaggcgtgagccactgcacccggccaggactctgtttttaaatttgaaaaacaccgtgatatctatgtttgtacgttactgaaattaaaacagaaagtaaatttgcaaagaagggaaggaagaaggaaggcagtttgagaacgacaggcactgattgatttctaagtgtgcctcatctctggtctttgctgacagcgtggctccactcccagaaactcccctctttgggccgtgccgtctcttcattcttaccatcatcagtaatgctgagcactcccagcccccagaagcatggcttctgcttctcacctcctgcccttgctggttcaaggccagttcaagtgtagtttgggggatcccactggggagaggaaagaaagagaagagggaaagtagatcccacaaggcctgattccccactgccggacctcccttatgggctgcatcctgagcgctagcccatcttgtatgcaaacattccagatgctagacctgccccttaccaaggataacccttgtgaggaaacaaaaggacattagaggagtagtctgaatgttcctgtaaatatgtatcttggaccctggcatgatggtggcttgaatgagggctcatccactcatctcccagcagactcgctacctcctgtgagctgagcagtgatcgagggtacacatgacatctgcaactctgttaggatcgtgaaggaccaagctggcgcaagtgttttccgctttgtgccagaagagagtgtggaatggggtgaagccctaacgtgaaggtcaagaagaatgctgtggcctggtggttccagagagaggctgacctgcccctcccatggcccccacttgggcaaatgttgccttgtgggagcagctggtttccttggcccctcaggagctggggaagcctgaacagatgcatttctccctctgatagggtgagaatgccatctaagaaaaccaaatagtagagatgttggtcccaggaatctaacacgatttcccgctctttcttaaagcacctcaggaaaacaacaaatttaatggcacccagaattcaggaagtgggataagatgtaaaagaaatagactaagaagcttgtaatgaaaatgaacaatggagataagagaagacaacctgaaccaaaataaaacattgtaactaaagcatgtgcagaaatcccagaatgataacaacaaaaaagcaacaacaacaaaacaaacaatggccaccaaatgctggagaaaaaattaaaatcataatttacaaactaaaaatggcagcagattagttgaagaagagaggttaatggttttgaagaccaggtagaagaaacaactcaaaacagaaaagagaatttcagataaaattaagaagacaacaccatgcacacacacaaactgaggcacattctagaaaaattctttaacttcaaggataaagagcgtttacaaggtgccacagagaaaaggcaggttacttttttttacttactaaaaataaataacaccaataatgaatttctcatctgcaacaataaaagcttgaaaacagtggaataacacctactgagagaaaaaaaaaatgcaacccagggatcttatttgcagagaagatactgtaggagaggaaagatttcttttcccatgcgtcactagttcatgactaaggcccctataacaaaagacagattaacaagagaaatgcacacaaattcatgtaatgtaagttttcggtgacacaagaacctttataaggaaatgaatgcccaaagaaacaggtaaacttgtgtttttttgtgtgaggttggatgaagaggggacagtcatggggaagtgtgattgaacacagggattgaatggtgataaactgggaggaactgggcaaggtctgctcgttcagattcttctctgtgtccttgtgtcttcagagatacggctgttgcttcctcctcgtatagggagggcacctcttggatgagggtcttatgtcctgcttcaggggagaaggtcaaggggaaagtgagagtggccttcctgcttctgctgttttctcaaatgccaagtgccatgttttgggtagcatgtcctgaaccccatcaatagcatttatctctcagagtaaatgaaagatacttaggtaatgctgggattcagagaccacgtcaacagtgtacacacaccgtctaaggaagtactcaagaagaaataccaactgaattagaatcatggcctccgaagaggagacaatgatgagaaagcaactctacagtgtatatagttaaatctcaaacgatgattacagagcaactggaaatgtgtcagaagcactacaagagaaaccttaacagaaggctggaactaaaagcatttacctatctcagcaaaatccagcagttggaggaaagtagaaaagtaaaagtgttccaaattctcatctcatctgaagagggagagtggggaaacagttatgaaatagagctttagtggagggaaataattgctatcttgcatacatatgacaatgacaaacatatatttgaatatgaatgtcaggagtgggaaggtaatcattaatacaatgaaaagaggacaatagacccacctaattagcagtgaggaaagggattgactagcagtctgaccaatttagcaaaaacagctccaaggaaaaaaaggcaacaggaaaaatcatgaataatcaaaaaacaagatgaaaggagtcaaatctactctattacctatcacctaaaatttaaatgtactgcattttggccgggtgcggtggcttacacctgtaatcccagcactttgggaggccgaggtggatggatcacttgaggccaggagtgcaagaccagcctggccaacatgcagaaacccggtctctactaaaaatacaaaagttagccaggtgtggtggcaggagcctgtggtcccagctactcaggaggctaaggcacaagaagcgcttgaacccttgagatggaggttgtggtgagccaagatcaatgccactgcactccagcctgggtgacagagtgagctctgtctccaaaaaataaaataaatacatgtactgcattttgacataaactactcaattgtttcataaaagttattggtatttttaagacatacacttaaaatggtaaagaaaatggttgagaataaagatatattaggtgaatacaaacaaaaagaaaggaggaatggcagtattaatatcaggaaagatggaatttatgatgaaaaactctcagtaggataaaaaggaccactgggtaagtgatgaaaggcatactgtgcagaagaagaacattcttaaaatgcgtaccttaaacaataatatagtagctaaatttataagcaaaaactattaaaaaaagaaagattgttaaaacacgttagtagtgagatattttgattcacttcttttagaatcaggcagatctgaaagacaaaaataagacagcaattacataatattaatcgaaaatttcagctaaggtatatatacagaaatttataactgtcagaaatgatacaattttttatatttctataggatagttgcagaaactgattatgtatttggccatctaaagaaacattaaaaattcagaaaatagattttataagccaaaacattttatcataaaatgtagtaaaattagaaataaataacaaaaagataattagaaataaataacaaaaagataaatgaagaaaagcacttttgccccttggattatgatgtcccttgactgtgatgaaaagcaatcaagagcaatgaaaattctacttccaaaatgtatgggagacagtgaaagtcataatcatagggaaaacattgtgaagaaatcaggaacaaagactaacaaaataggaatatactatatatttaagaaatgagttcaagccaggcacagtggctcacgcctgtaatcccagcactttgggaggccgaggcgggcagatcagctgaagtcaggagttcgagaccagcctggccaacatggagaaacccccatctctactaaaaattcaaaaactagctgggcgtggtggtgggcgcctgtaatcccagctacttgggaggctggggcaggagaatggcgtgaacccgggaggtggaggttgcagtgagccaagatcacgccactgcactcaagcctgggcgacagagcaagactccatctcaaaaaaagaaaaaagaaaaaaaaaaaaagacaagaaatgagtagagtacaatgtctggaaaataaatcagaggaagtaggaagaggtacataagatataactgaaatttaaaacagacaaaacagctaagtctttaaaaaggctagtaaaatagaaagcacctatgatcctgattaagaaataatgagaacaaaaataagacatcctaaaaagactgtaacaactaagaggtgctattattccaagcaataaatttgaaaaatctagaggaatttattttttctcagaaaatatgagtaaccccaaaagatttcagaagatggagcaaacttgtcaacaccaattatttcagacaagatgagaaaggtgattaaaagagagaccatttccaagggccagatatgttcctaggtacattttgcataaccttcaaagtacaactaagtttaatgtttaaaaatctattcaacaccacccttcataacagatggaaggcatcaaagttcatgttatgaagttggcatgaccttaataactaaacttgattagagtagtacaaaaaaagaaatcatacataaattgcttcacctaccaaaactgcttttcagtaggtgtgtaaaaattcaaaacaagtatttgcatttaagaatccagcaatatataaaaagaataatatgctagaccaaattaatagccaagtggttactaatccttgctgaatatacaaggatttttcagtgttcagaaatctactaacataattagattaataaatcaaaggggaaaaccatgatcttatcaatagatgatttacacgttttggaaaaaatttagaaaggattctttattcaaataaactcacaagaagaaaaaacacttcaatatggtagtaatatttgacatgatcactctagacactaaacagcattctaaaaactgagattctaggacatttcagttgaaataggaacataagaaaggtttacctattctcacaattattattcaaaattgttttagatgttttagcaattgtaataagaaaattaaatgatatatattttggaaaaagttaaaatcagtacttttgttaaagatatggttgtatgcatacaaaaaccatgtgtctctagaaattaaaaaaaaggaatttgaagtgaatttggtatttggatgaatacaaaataaatatatggacagtgtagatcatatagtataacggttgagagtataggttctgaatccacatgacctgtgtgtgaatcccaggtctgccttgccgtagctgactggcagtttacctaatcttggccaaggaacttttttggacaagttacataatttctctatgcctccattttcattattcatagattgtgctgtagtttgttgaggataaaatgagttaatatatgtaaactgtttagaataatgcctgatacctgttattaatatctactgcttggaagtcagaaaaaaaaatcctatcacaaaggcaacagacactataaaattctttggaataaattttgcaagcatgctatgtgacctaatgtgagggtacctataaaatattatttaaaaaacgtaaaacaggacctaaataaataatcaatgtttttggatgggaagatgataccataagaatattaattctccccaaattaatgcatagaagttaaggatatcaaatagaattccggtgggttagagttaattttaattggcgtgagtgatcttcaaatttatcttaaaattcaagtgatcataaaattcgtattttcaaatttctggaaatagccgaaaccatatttaaaagtcaaatagtgaggacaaaatggagttaatatgtattttcaaaagtatgatgaagctgctgtaatcatgtctatatgatattggcataaataaagacaagtagattcatggaatagacaaaaacttcagaaatatatcctagtatataggtaaatttaacataaaacaaaaaaaaggtttttctattcagtgggatttgataaatggtgctggcacaactggttatccatctggaagaatataaaattggacccatatctctcagcatattcaaaaataaattaagatggattaaagacaaatgtaaaaaataaagcaagaattctagaagttaatttgggagactaagataggaatgacttgagccatgagtagcagaaagcttcagcttaaaaactgaagagaatcattttcttataaaacacgaagtccagagatagactatctagccagggcgtaaagatatcattaaggcatctctctatctttttcatctttgtcattcttagccggtagcttttgtccccttggtgcccaggtggcagctgtgctttcatattcctgttggagtaagaatgaacgcacaggtaggaaggccttctctactttggactagttcattttactcccctgaaacttctcgctacccctctcttttcagagctgttatacttgaccatacttagctgcacaagaagacaaagcggccgggcgcggtggctcacgcctgtaatcccagcactttgggaggctgaggcgggcggatcacgaggtcaggagatcgagaccatcctgtgaatggtgaaaccccgtctctactaaaaatacaaaaaattagccgggcgcggtggcaggcgcctgtagtcccagctgctcgggaggctgaggcaggagaatggcgtgaacccgggaggcggagcttgcagtgagccgagatcgcgccaccgcactccagcctgggcgacagagcgagactccgcctcaaaaaaaaaaaaaaaaaaaaaaaaagacgaagcatttgccatttttgctttccagtccttataataaaggtggcaagaagaaagtggtttgaatccacacagccgatcccagggactcaatagtaggggagaaattttgcaatagaaaattagaatgtttctaacagaaaacccagaagaaaagatagacttaaatgattagttttaaaatttaaaaccttttacatgtaaattaaaatacccagaaacaaaatcactacattgggaaatatgtttataattcttatgacatatataatgtctatatctataatatactgaatgactgttacagtttgaaaacagaaagataaacagcccaatgggaaatggcatgcatagacaattcacaaaagagaaattcacacggtcagtaaacgtgaaaaggagaatcgatgttcctattagtgtgggaaaggcggtagctaatcccaaattctacatccctactatacagcccctatcctggcatccttcattgagcattcatatatccagggaatatgcctaggaagtttctccccacttggtaagcaggaaatcaatggaagcggctactgtaggcgggatcttcctcattggtacatttgttcaaagagacagtctcacacatggaagccatgccctagagtacaattcatccagttcttcattcagacacagataactcagaagacctgtgtgttccatcttggcatcctccatgttgttttcatgggaaaatgcatactgattcttatcaacttctaaacccaacaaattcctaaagtgagaactttctatatagtttttgaagttctggcttaggaagaagccaaaaaaaaaaagcaattcatgaatagctgtgctcaaaactttacacagaagctctcattatagtgtgtgaaataaacaataacacaaaaaactgaaagaaaaaaactgcaaaatattcacagagggtgcatttgagagtggggctgtgaaggaacaccttctgattttcagtcaaaaggtcaaaggccaaaaataattcctgcttcggaactgcagcaggttggttctaccctttgggggttggagaagaaaagcacctttccagatggccagatctagcttgttaatgtccctgctgccctgatggcttggttttcaattcagggtgaacttcagatatggtgtttaagggaggagccagataagaacatagcattgtgcttttgatttattttagggatgaaatgtaaaccaaaagtccccaatgctgaaggaaattttaactttttcttttccatttttctccttggactgttgatgctattattcttagcttttttttttttttttttcttgtgttccattgtgctgccttttttctgcctctgcataaactgatatggttgggagatctttgagagcctctgagtccactgtatacatgaggaatatgagactcaaacttgttaaagtgttcactcagacaacagctggtgagttctaggtccagaagaaaactacaatcaaatttcaatcatttttctacactactcttttatctttctagtttctattagaaaaccgcagtaaaaagctacgtatgttcttaaatatcttcacaaatgtgagatagacaaagatatcttagaaaggtcctaagtggaataaatataaaagaaaaaaattgataaattggacttcatcaaaattacaaagttttgcttatcagacattacctttaagaaaatgaaaagcaaatccacaatctgggagaaaattatctatctatcacagagacttgtctctagaatatataaagagcttctacaaatcaacaacaaaagataaataaccaaattttaaaatgggcaaaaaacttttaatagaaacatcacagaaaagagacacaagtgactaataagcctgtggaaaatgctcagcaccgttagccatcagagaaatgaaaattaaaaccacaatgaaatactaccactcatcttccagaatggctaaaattaaaaaagacccatagcaccaaatattgaggatgtggaacaactgaaactttcatatgtaaaatgacacaactgctttggaaactgttgggcaatttcttatataaagttaaaaataacatctcccactggacccagcaattcatctccttagtatttacccaaagtaaataaaaacttaagttcatagcagctttattcataataggcccatattggaatcaccaagagaatggatataacaattgtatgttaatacaatagaatatgagttggcaacacaaaagagtgatctacagatacttgcaacaatgtggaagaatcttaaatatccactgagcaaaaggatcctgagtacatcctgtatgactccatttatataaggttcaagaacatacaaaactaaccttctgtagaagaaatcaggacagtggttgcctgttgggtggggattgactgggtacgggagagctttgtgggagtgatcttatcttgcttggggtcatggtgggtacatttgttaaaactcatggaagtatccactttagatctatgtatgtcactgcctatgaaatttacctaaatattaataaatacaacagaagcaaaaatcagcatgttcaaacaactgtagttgaacatggaaagttttgggtttgtattttcccggcttccacaggggtaagatttgatttggtgccaagagcagagttgcactgtctctactgaaccataaccacaatctttcaaaaacaacctccgctgtcatcgcactataatgttttgctggataaaggcattttgcccattaagataataacatatacaacatatccaggactgcactgagagaataaagagtttgtgtcatagatgggaccagatcttcaaatattttcatctgtttccaaataaaaaagagcctgttttaagctcttagatatagactacttattttgggggagggggaggcagttttattagaatattactaaaatgataagtggtttttaaatgtttctttatattgtatgttctggctaggtcaaaagaattgaaatcatatttcttaaatatataacatgaaagttgtacatataattttagaatgtcactggtagcattggacagatataaaaatagtgtcagtaactcctttgattaaaataataatgtctctgcaccattttatcctgctttggatgtgaaatggaataaattatttttgttactcttcttatttttattttatttatttgtattttttttgcattatgaaaatctattaaccattcagacatgttggaaattgtgaaagaggaagatttgagagccaagaggaaaatgcttttaattttaaagactgagatttagtttagtcttggatgccattatagtgaataatgggaactgatccgagacttcaaaagaaatatgaccatatggtcctaccattcagtacttaatgctgccatgaatttccagttagaccccaaacttttcatttccccagtgttccccctcacctctgtcatcagacaaaaacgaaaggaatctgaaaccccttttcatgttttctgaaatactggtgctgagaaagcttatttttgtgagaattgagttttatgaaaaaagacaaaaacctgaaacattaatcagatccactgggctaattactgcaactccaaagtttattacttttaaatattaactgcttaaaatgattcatttagagatcaaaatgattaatccttctcagtcactataaatgtcagcggcaggattaaaggatttagatggtcatgtttactcaaccttacatttctgtacttaaagacacaagttaaatagctctagtttatcattgtttcatgttaatggttttcctcttagctccctcttttagctcccctgcctaactgattgttaactaattttggctgttaagtaggcaagggcttctttcaggctcggcagccaacctgctttgtggattacccaccagaaggtgtgagtagatagatgtagcttacagccctcctcaggacgcagtgggggtaatcctttccccctgcctcggccttcattggtctgatgtgttgagccccagcttactgctcaacttgtatctggttccttgccacgttgcccattttggatccacagtgtgactcaccgcggtgctgcttcagtcgcaattattaaacacctgccgctttatgccaaaccataggcgtatttataccaatacctactgcagttcgactatcagatatcagcagatacattgcaggcgtattatcattgccgggccttggattgttctaaagaagtcatttctaagtaaacataagaagcaaatttattttcagaatgtttttgatttaaaaaaaaaagctattttaaagttatttcttaattacaaatgtttgctaaagctttttttatggttgccccattaaatccttcatttccagacctaagacatgctctttctttatacgtcagccaactcacaacctaatttttcttatttgggccaccaaaccttccattcaatatgcatatgttcgtcctcccctggaggcctcacaaattttatcttgaagaaaatgcatcttttctggggccattcattctagtcctggcttttcagcttgcagatatacctagggtttccctttcttacccacctcctcaagttcaccttagtgcccagcctggaatttccattgaaagctacatttgtgatgattgccgaggggatgtcctgcaatggcttccattagacttgtgttgtgagtcatcaattagattatgagtatggtgtccagtggtcattttcagcgtcctctggaaattcatgggtttcaatatgtggttatgggtattaacaacatattaatagataaatcaagtaagtagttgaaatggggtggggaccttaaggtatttagtgggattttaagttagtttcttaaacctgttttttgtagggccttatgaataaagatttgtagcctcactgaaatttctattgcatgttcaagaatgggtattttgttcaaatggtgacacatttaacataaaaggttaaagagtttggaatgtcccataaaatatgtatttggaaataaaattacatatacttcttttgctgtggaatcttcttacgattttgcaaatacagcaaaagagagaactctggaagacatggtggtgccactgattcaacaagcacctaataagaaatgctttcccagtttgtagttttgtgttctgcctgactgatggaggagagtcactccatgcctgagaagaaataattccattcaagctcacaacaaccaaggaaaataattaaagacagctatagattgttttatttatgtgcatttaatttatatttattcatccattttttcccatattcaattttggggttactgtaggagaaatgaatggttattctcctttaaaacaatccatatatgatgaagaaaaagggaaggattgaaatggaggggaaaatgctcccatgtatcttacaaagtttcatttctttacaataaacgaggaaggatttttaaaactgagcttcccctagaagaggcaataaattaaatttctaattattgagtagaagctattaaacagcaaatcaagaaaatatatttgttttttagaaagaagataggctttaattttttctttattatgtttttaaattattgaaataattatcatgagaagtaaaaattcaaaactataaaatagaaaattactaatttccttcatttacaaccttttctaaatgacccattataacagttatatatctccttcctcacctttattcagattcaacttatataacctgtgggtccttttccttaatttccaaaagtgggattatactatatacataattctacaacttgcattctttttctacttaaaatatatacaaacgagcttccctgcagatccgaagacatgggtccaactcattctttatgctaaccacagtgttccacagcatgggcatgcaacttttccagccattctctttctggccaacatttgggttatttaaaattttgcaacaatgctgtagtaaacaacttgtttaaataaacattctgtatatttaagatcaggtgattttatttctataggatatagttccaaaggtagatttcctatgctaaataatatttctgattttaatagaaaaatattttacatggagtgaaagcagcataatagaaggcaaagaaaaaaatgatagaataaaataataaatttgcatagcagactcacagaatcagctgcttttcaggggaacaatgattcttgtttgccctctaaatttcaataccaatgacctatattttaagccctcattgcgaactccaagtcccacataaagtgtggtataaaagagaaccaatagatgataacaagtgttcatgagcctgtgcagaattaaaaccctcatacactgctagtgggaatataaaacactgcagtcattgtggaaaacagtccggcagtgcctcaaaaggttcaatacagagttaccatataccccagcagttcctcttctaggatatgctcaagagaaatgaagacatatgtacgcatgaaaacttgtacaggaatgttcctggaagcattctcataatagtaaaaaagatagagataactcaaatgtccattaactgatgaatggataaatgatagtgtgtccatacaatggaatattattcagccataaacaggaatggagtactgatgcatgctatgacatggaagaactttgaaaacattattctaagtgaaagaagccagtcacacaagaccacatattgtggatcttctttatttgaaatgtccaggaagggaagtagatgagtggttgcctagggctgggggtgggaggggtgaggggaaaatagaaggtagctgataattggtataaggtgtctttttagggtgataaaaatgttctaaaattaattgtgcccatagttgcagaactctgaatatactgaaaaccattaaagtgtacacttcaagtgggtgcattttgtggtatgtgagttatgtttcaataaaactgtttgtttttttaaaggaacaaacaagcaagagaccaagagagaaggagagaaagccaaatctagatattagagaaatccagacattagtgaggagagaatgccttccccgtggggtgctttcgtcatcctatgtacctctgagactagtccctcgggtagaatctgtttctcatacaagagatagtagatgtgttacccattggtgaacatcaccctgattgtggctttgaaaaatccctcactgctccaactaggttatagacaaatagaacaaatttctatgagaaaaagaacaaatagctaacccattttcccaatctccttcttttattaaagagggagctgtgctatgtgccaatctcatttgaaatatttgtccttacaccatcctttctactttgtcaaataccctcactcgttttttaaaacgtgaacctaaaaaaaatgatgcagcccacctaggttgtgtttattcagttttccttttctagattttcacatttatgagtgtcataaaacaaaaatgcctaatataatccgagctaaccttgccttttaatcacagtgaattccatcctcaggtgtactttgttcttgctacaatttattgttttggtcctgtttcaaattgtaatgggaaactcttgttggctctgctgatcaaggttaccaaaattcaatgtacaggagataaatacttattttgccagttatggccaagcagaattaatataaagaccgtaaaaggcaaagaaagaaattaaagcaatgttagaactactgcaaagaacatggcttttccaatgtaaagaaaacatggaaaatgagaataaagtattgttccttgaagccaaagctgactttacataggattgtccagggttcagcctggtcccaggggcatctcagctgccttgtcctgcctcttcccacttctctgcactgccataaagccctccccactactacaagcccagcccagcccagcccagccctcccgccctcctccacaccgcttgtcgcagtcagggagctctattctctccatcttccctgcactggtcaaaactgcagatgttttccatcagcatagtgtatcttgctaaacactgctagattgcaagaaataatcgaatagactaatttattctagtttaaggttagatctttccaggggtgtttgcattaaaataagggatcctaaaaataaaaatttcttaaccactgaggagaagtgacaacaatagaatgtgaagcactgagggaggtctggagcagggatgtttttgaataaaggcaattacttaagtaaaactcaactttggtggtggtgttgctatttgaaaatgagttgaaaatgatcctctccctactctcaaactatacacttctctgtgattattaattacgtttgtcaaggtatttattttttaagtgatttttttcatttagcccttttttgtgtgagtcacatttacataaaccatctcctaaaccaagtcaggacagccctgaaagatgaaaaaatagagtgtaaagtgacttaaacagagctagtgagtggctttaacctgagtccaactgaggccaagtttagttttctctcctaggggaaactaaaacaaactttttaattcagtaaggaaatctaacagggactcctgctatggtgcttgcatcatagcttcatttcagaagcagccctggagaattttgaatcattgtaagacattgacttcagagggaagtcgatggagggaagtatttatggagtttgggatacgtatatcaattcatagggatgatgtgttgtgtttttagttgcaaagtgaactgtgtttacatacctgggtaacaaagattacagttttctgcttccttcacctcatagattttttgcatcaagatggcaatagtgtgaaaagccaatcacttggaaattgtttcaagccacattgtagagattagaaagagagttgttactggccttttatttctcttttcatttctgaatgtgggcacctctcaaaatagaggcaaaaaacaaaggatcttatttatttttccctctttaaaaattattttgcatccttattttgaaaaatcagcatgtttgatggcaatatctacacgttttagagtcctcccgtatgttacaagtgacatataaatagcagtgggtaagctcttccacagcaattccattaactgttcatgtggacactgaccttgttcagatttacttttataagtacaatctgcagtaatgattttaacatgctaacaatactgagtctcatctcagtgagcttgcctgccttctcactgttcaacgcacaggcgctttttcctttttttctcttcttttactcttcttttgacatactttttggttcagatacgtgttcacatctctctgataagcacactttgatttgcagctaattgtagcaactgattttcattatttatgagtgtcattgtcggaatccatttggaagtctgaccgagataaagctgattccaacttctgatatgaccacagcaataaagcaattaaccacactagttaaaatgtgtggcagcctggagggtgctaatatctttacaacccaatatttactacattgtccattaggtttgatttatttccgagaagattcaacatggtatcattttatcacaaataatttataataccctctttcaaaaaatataatgtatgtttctcatatcaacctattagcattaaaatgttcacagatttaagaggtagaagtagggaaatcaaaactatgagtaatataaatgcttaatatacttaaaaggtttggttatgagatagcagcatttaaatcagtctttgtaggttactattctttacctatattttgattctgattggcacctaaatctcacactctaccatgtcaaccagagacaagaaatagaaaagctttatgtatgcatgacaagcaaacatttttctcactcttctcatccatagtagtataaaacgtgaaatttccagaataaatacaggattggaaaagtcattaataacagcagtcattttaaagtgtcacctaatttaaacacttttgctttaagttattgcagtgtcatgagttttattatgctcaatttattagtaaaggcctgcagagttcacagccatttatttttcagggaacttgattttatcattaatttttaaatacgtaatactcccactttatttttagagtgcactttatttgcaaagattggtttactctgatcaatacagatgttttcaggtgtgtagtaaagcaaaaagcctagaaagtcaaaaatgtacaaaatatgcagcaaattttttagacgttatactccaacatttaatgtgtatatacacccaccccacacacacacatatatacatacatacatacatacatacatacatacatacatacaaaatactacgtgttatgttgattgctaagtcaaggcggaaaaatataagaagaatgaccaagctcctgtttctactgtttgagtaacttattcttgaagggaaacttttctcttccaaaggagtgacatctgggtgggaaaattttattgttggggactcgagccaggacacagaaaataattctgacaatttccattgcctcacaagtctgctaaacaaaattctatcattgcactaatcctttctctgggttgagttctcatggttggggccactttacttgcccatctctctggaggtacttatgggcttaaagagttgacaaaggagctctaagttggggccccgccctcctcccataattgcgcccacttgatcctatgccgtgtgacgctactgtaaacgcctggtgctgatcgctgaaaagcctaaatgtttgagtgtttatttctgaaagacattcttaaaaaaaaaaaaaagaaaagaaactaacactgaacatatactcactagttgttatctttttttccccctaattaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatggtaagtttcctttttggctttataatgttggcattcagtgcttctgtctgttttggttgactccgcggggggggatgtttttctttctctccttcctctcatccttctttctctctctttcttgtccatttctttttgttttaatgtagtagaactcaagaaatgtccttgaataatgcattttttcctggaaaaaaaaatcaatatttgacatcagattgttaaattaggcaagcagtctacaatgttttggctatagttttgaaaaacaggttaatcatctacagaaaaaaaaaatagctttgacttctcttggaccatgtcacctgttgtcttctgtggggtggcaaagcacgtgttgataaagtttaccccagagccgtcttgcaatcaaagatgtctttgtagattcctcttgaagatatctcaaagaagttgcaaaatcttagaatggatgagtgagcacgcagaatagtttattaacagggctctagtgattgaagaacaaatatgatcatgctttaaacttaagagttgatgagagcaattgaaatcttggtaaagagggggagtgtggcctttaatgttctttggggactggattactaagcaattaaatccacacacaaaaattggattttaggatatccaaatagcagctttttgtatattgtaagaaaaaaagtctttataaattattgggactttttttttcctattgccaatgcgggatgattttttaaaagttaatttatatgcaataatacattttaaagaaaacttaatttttagtcagtgctgcttctaggaagaattggggcatcagcagcaatgcagcaaacaaaaaattctccttccgcttttaatattaacagtgcacttgctatttcagtctagttattaatgctatgcatatcctatgcatcaaaaagcaaagagaaaattaaaatgaaagaattgcatgacatttgaaaagaaaaatggttgttttatcaatgatatttcaattttattatttattgggtgactttgtcagctttgctttgtaataggaaagcggatctattgttagctttcagtttcagctaagtcacagtgtgaagcagcacctaaggcttattagttattttctttctattcatgaaaaaaggtctaatttaaaccaatgcaatcaatttcttatcctaagtagaatatcttagtgcattaaaccaaagtcaagatcaaataatagctatatactcaatatcttcatttggaagtttcagttcttggtggaggctggctttattccaattcaaaagaagaaacaaggacagttattttgataaaatgagcctcagaatcaggatgccaacatttctctcagttaatccattcacctcagtaaatcctgtgtttctatccattttcatagtggattcagaagtcactaaccttaaatacgtatgatttggaataaatattgcttcctgtccagctgtacttcacatagcactccttgagcaatggcaggtaccatggtcatattcaaaggtagcacccagcatttaattttcttaaaatacacaataaaatctttgacgttatagaagactagaatgcagcaggataatgcgatcagttctgattatctgcatcatagatcatccacatccatagctatcaaatatgttttaacattgggtcagtgtgcactttccaaacaaaccttctatggcatctcatcctttctctctaataacaaaggtgtcttgttatggtatctgtattggtaaaatataaattaattttatgatttttaaaattatacatctgctaaaaggatctcatggtggatccccaaacatatgtatttttttttctttttggaaaatataaactttgtaacctttagttaacgacacataatatccaaatgttagggagaagggaaggaagacttgtgagtttctcataccactgccctcaccattcgcatggattaatattaactagaggaggaaattgtttccccaggaatcttgtagaccttgttcttagagtgatgtaaaggcaagaaaagttgcactctttaatttctccaagtagtggctaggaagcagaatgaagagagacagggagagtgtcaagggccttgccttgaaattcagaacatttggcagcatttgttgagagtaaataggtcagccaagttaagagtataaagtgtcaaaagcaatgtttgttgagctgggcaacatgatgacttaaacttgtgtttactctttttccgaaggtttggttgtggttgtacttttaaacaacgttttgatggtctaagaattccaaatgagagcagtttaaagaaagaaacaaaagaggaaataaaatagatacgttgtcttaatgaatactggctattgcatatatttcaaacatatgtccataggaacttttcagattaatttatttgttctgaaatttcagcgattacttagaaggaacaagatttcatttaatgtaattaattacattaagatatagggaagcataattttctgaagtatttagcagaccttataattttgaattgtggaattaaacaatagcactgaggatttttttcctgatattaaaaaattatgtgtctttcccttaagctgggttatagtaagaagtgaaatttgcagtcatacataggttcttctaacaactttataaataatcgtctcaaaactaattcacatttttacctatattactacttttagtcaagtaattctaatataaagttaacaaaaataattcaattctactatcttcaggtgtttttaattgctctaacttaaaaagctatagattttctggttatattttcttttgactcttcaattcttttcattttctcttttattcatttttatactagcttgagatgtgttcttggaagttctattgtatcactaaaggttgaaaagagaaggagatggatgaaataactcaccaaaaggaaacgaatttaagagccagatgctgatgtgttttcatctggtttaacatgagagcttgccttgactgttttcttcatttgaaataactgtgaatgaggctgtttttcccagaaaaaaaaaaatgttattcaacattgtaaaattatgcaagcagagtgcctgatgttctagctacaatttcaaagaagaatttagtcactaaaagggattagattccatttatttattgataaagaggccaacagttcaagttaagaaggtgctagaactgctgtgaggctaatgaaattttgatggcccgagcctcccacaagagtaagagaacattcggaccgtgtcacacagctctctgttagctgagagtcaaaacaagtgataagatttattcttttgcaaaactaacttttcaccagccatggggagttgacattaaaaagcattttgaggaaaaaaatattttacagtatatattgagtttcctgtgtaatcccaaatattaatcttgttccaaatgaaggatatgggagaagccctttcttggcacccattgattgttgtggtggtgtttttgtagtggactgccacacaccagggcaagttctggagagacggtgatttgggatcacctactaacagcagtttgagtaaaaatgggtgaaaggttataaaatcagtgtgatgggataccccagtaaaaggtagaattctcagtgtgctctggtttattgtaggcatctctcctgtctccaatgtggtttttgttttgttttgttttgttttttgagacagtcttgctctgtcgcccaggctggagtgcagtggcgtaatctcagctcactgcaacctctgcctcctgggttcaagccattctcctgcctcagcctcctgagtagctgggattacaggtgcacaacaccacgcccagctaatttttgtatttttagtagagacggggtttcaccatgttggccaggatggtctcaatctcttgacctcgtgatctgcccgcctctgcctcccaaagtgctgggattacaggcatgagccaccgcgcccggccactgacgtgttgttaaaagagccgtgactgaagtcccaccacccagctttgcaagtgctataatctgacctcagttccaaatacctatttaaacgtcaggaacaaagggcttttttttattttttcaaaacatcagtctttaagctttaaaaatgtttccatggagagtaactcagtgtcaagagatgtgcagaaaatccaaagaagggtaaggttgcccctggtatcaaggaaataagaaccagaagtcatcaggacagtgaagatatttagcaaagaaatgtaagtgggaaaacatgtaataaagttagttttgtgatttaataaataaataaaatgtttgcgtatgcatcgcttcccagaagcagccaggcatctattgttttttgtcatccagccggtgcgacgttgtcacaggtgcctggatttggaatcacactggtcagggctcacattctttcattcatcccctgtgacagttaccccctgaatcacctagagtggcagttgtcaactcttgcatgccttgtctgctccttcagctgcctgccgagttctggaggggcggagctctcctgttggagtctagttccttcttccagcctcctcagcctgttagccctcttggagaaagatgacctttgatgtaaggcaggccagcaggcgttggcgctgctcttccacctcctcgtgactcaggaccccgagagcctccattgaggacagtctttgcgaatgtgatgcccggaggcgggactcctggttttgtatgggcactaccacctcccgactttgagaccttgggcaagttgctcaccattccgtgccatggtttccacgttgtaaaacagggacagcagtaaacagggctctagtcctatgaggtcagggctgttgtgagcattaagtgagttcaggtatgcctggtgcttacaaaactccctgacatctagtgagttccgaataagtgtgtgcccttattattatttgtaaaaggtggaaaattatatctgtttatgtggctatgaagattaagttaaataaacaatatcaagtgcctacctagtttggactaggtagatatctatagatatcaatagatatctcctcctcccctcccccactcctccttccttaccccaccccaccccagggctgcattcatcaagtgttctggcaagatggaggagaactcacggtgtcttccagaaagggcgctgatcatttgtgcagtctggaatttctgtcaccatttattgactctcttatttttctccaaaaccccacatcccttttaatttactgtaattaaatgaatgtacattgaatggtgctgataattagtctgatggttgtagacttcaaagattttagcatgctccttcccctcctggccaaagaaaatttcaaaattagtgtttccctcaaaggcatgttacttagacagctggtcaattaacaggcaatttaactgatgctcatcagttcacacaataaaataaatcattccaagaagacttcatttctcacctaagtttgagcaatgtacctgttgtcggaccccactaatgccacattaattgtgcatgatactgaagtattatgggctaatttggctaatgaaaaagggtataacattaaagtgcagtctttttaaatgtaatagacactttgcacagctgaaacacttttcaaggaaccaatttcacttgtcctttgaaatggtattttaagtctactttctgtatggagagataaagtctaaaagttgcattattgtattttaagaggaaaaaggcgtacccctcaaaccaatttgataaatgactgtagtgatagcatttccatcaatctctaaagagagaacttcagctattttgcaatccagattttcttgtcaagcagaatatgttatctggaaaggagggcagtgccatttcttctcttcctgaacaactgcagataggtgagagagtgaggaaatagacggacttgtagctcttccagtgctgatcaaattctaggagagtttgagagaaactgctagccagctatgtcatgtacttgcgatcattctaggacaacacaaatgccacatctctcctagatctttggaggaaggggtactgtcttagaattctgaagatgatttgaagagaggtgtactttttcacctcactagcattattccattccttcagctttatccaggaaccttttctgagcctactttggttgttgattgaaagacataaaatggaattctgttgctgtaagaaacacatggcatttcagtgttattctaattttatgagtttctattatacatactaaactatagcttgaatataaatttcactgtgggccctcttccggcatgtaatggtcatttctggcatggtctcctgtgataaattatattttatgttttatgtgcactagaatgtcaaaaatagcaaacgtaatatgtcggtgggcttcctaaatcaggctcagaattaaagtgctgctttacaaaatgccgtcaaatagttcctgatatataaaaataactacattgccttgatagatatacatttacaatttcaatagtgacttgtcattctttgagcaaaagcttccctgtttcatttaaggatgaaatagattcacttcatgggtatgtacaagtcactttttagtataataagttatgatttaactggctgggcgtggtggctcacgcctgtaatcccagcactttgggaggccaaggcgggtggatcacaatgtcaggagtttgagaccagcctggccaacatggtgaaaccccatctctactaaaaatacaaaaattagctgggcatggtggcagatgcctgtaatcccagctactcgggaggctgatgcagagaatggcttgaacccaggaggtggaggttgcagtgagccgagatcgtgccactgcactccagcctgggcaacaacagggatactccagctggaaaaaaaaaaaaaaagttacgatttaaataaaatcctaaaaaatttagtattatgaaactagaactgaaacaactgtaaagttcactactgttgttgttactacaggcttaagtatttatatacattcatatttttctgttctaagaggattttcagaaagcttggcagtttgctatgcttcacatggaaattgccatttctattaagctcgatttgtgttctaagtgtttttgttaaagtatacagaatatatgccatctctgtttcaattctaaatgttcttttagttgtagagttgaaattaaagtgaagcatgctatgaatgtaccaaaactgatgatgtatgctattttgatttttgaatgtgtttttgatatccttgaaaaatcacagtggtagcagtaaaattgttttaattaatgaattgaatagcagtgagtgctgaatcaggtttattgatgtaattatcactgaaatagaaaaaataagtgttagagccatagaaccttcgtttatttgccattccgtgagcactcaagtgtcggaaaagcagctaactgagggtttttttggtgttgtttaaagaatattcttctcaaatcataataattctgtttattaacattacatacacatataattttatacatgattatcttgtacattatttactgaatggtttgaatactaacttcagtatattgaaattttcttatatttatcagttgacgagatcgttttccataataaataggctgtacgcaaactaaacgtgaaacctatttgaatgcatgttaaaatggatagaaatgcgtatacacttaagaaaagagcaactaaaaatgtctgatgactattgccttgactttagtcacgcagaacctgaaaactaaataaagggtaacttattgaatagatttcttatttagtatatcaactaagtcttcattcaacgaatcataaatgctggatatggtaccaggtgctggaaaaacaaaaatgagtaagatgtattccctgacgtctagaagctcacagggtggttgggcaaaccggcaagtaggcgtgtaattaggttttaatgtggttagtgttattacaacagaatatgcagagtcagtgtcagcccagagccgattgttgccaacagagactgggggcaggagaggagagaatgtttcacaaagaaggaaggaagcagcgttggaccagaggcttaaaggatgtggagaaattcgagatttagacagaacagcaaaggagaatgtgtaacttccctggggatgctccaaaagccacaaggagtttgatgcctgggacacatgaggctacaaaagtagcccccgagcaaagtcttcatggtgatgctaagggatttgcacgttttcctgcaggtaatggggaggctctgagggattttaatgcagaggaatagtatggtcatgtttccgttttacagagtaccctgaaagcagtgtggaatattaactgtctttcctcaaggagagcaacctccctggggacatggccctgttcactgttgtacctctgtgctcacctcacctaatacctgaacctggaaataaaggttttgttgaatggaaaataattgacttagaggtcaaacttggaagcaaattggccagttagatagtattataattatcaacataggaaaatagaaaagtttggatcaaaaaccagaaaggaaagggagacccatttaagtagaatcaagatttgatgattaattgggggaagagaaacatttaaagagactgtcttccccaacatgagagactcagtgagtgatggtataatccaagttgaaagttaaagtattttgtctatggtaaagttagtaattcacatgagaagacatagtgtttgatgtgtctgtgggccatcaagtttcagtaatttattagccaattatatatatattatatatatatatatgaaattcaattagattttgtgtaaaaatatttactctgtgatctatattattgcagttaaagccacagggcagaattaaacctctttctgaaagcaaatagaatgagaaaagaagaggagtgaagctagaatcctaagctcaccaatatttaacataaggttatagatgaagcaccaataaaagaaacgaaggaccttttatagaggcaaaaaaaacccaaaagattaattgacaaaagacaacaaaagagacatactgtgatcagcagagtcaaaaacttccaaaagttgctgggtacagcaatacccgtgtctgtagtcccggcactcagaaaggaggctgaggtgagaggatggcttgagcccagaagttagagaccagcctgggaaacatagtgagaccccatctcagagaaaaagcttccagtgaggataatgtaggtatagtgggtgtggaagtcaaatcgtggtagttcagagtggaaccaaaaccttaaatgtggcaccagcaactggagattattctctccaaagctcaactaaggaaggagagagcgtggctgagggatccagggatggaggtacttgcataattggaggacatttcagcatcttcttaaggaaagggacggagcggcagaacaacaagaaggtggagtagaggcgattgagggaaaatgaaaagcgtctgacctctgagaatcaggagtgaaggggtccttggagtatgaatgtgggtaactgcgagtccctgaaaactttttttttaaatatatttttaaaattattatttttttattattattatactttaagttttagggtacatgtgcacaatgtgcaggttagctacatatgtatacatgtgccatgctggtgtgctgcacccactaactcgtcatctagcattaggtatatctcccaatgctctccctcctccctccccccaccccacaacagtccccagagtgtgatgttccccttcctgtgtccatgtgttctcattgttcaattctcacctatgagtgagaatatgcggtgtttggttttttgttcttgcaatagtttactgagaataatgatttccaatttcatccatgtccctacaaagcacatgaactcatcattttttatgactgcatagtattccatggtgtatatgtgccatattttcttaatccagtctatcgttgttggacatttgggttggttccaagtctttgctattgtgaacagtgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatgacatctcactgtggttttgatttgcatttctctgatggccagtgatggtggcattttttcatgtgttttttggctgcataaatgtcttcttttgagaagtgtctgttcatgtccttcgcccactttttgatggggttgtttgtttttttcttgtgaatttgtttgagttcattgtagattctggatattagccctttgtcagatgagtaggttgcgaaacttttctcccattttgtgggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaagtctaacatttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtagatatgcggcgttatttctgagggctctgttctgttccattgatctatatctctgttttggtaccagtaccatgctgttttggttactgtaggcttgtagtagagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatcgataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaaggtggattcctaggtattttattctctttgaaacaattgtgaatgggagttccctcatgatttggctctctgtttgtctgttatcggtgtataagaatgcttgtgatttttgtagattgattttgtatcctgagactttgctgaggttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattaagagtttttagcgtgaagggttgttgaattttgtcaaaggcctttcctgcatctattgagataatcatgtggtttttgtctttggttctgtttatatgctggattacatttattgatttgcatatattgaaccagccttgcaccccagggatgaagcccacttgatcatggtggataagctttttgatgtgctgctggattcggtttgccggtattttattgaggatttttgcatcaatgttcatcaaggatattggtctaaacttctcttttttggttgtgtctctgcccggctttggtatcgggatgatgctggcctcataaaatgagttagggaggattctctctttttctattgattcgaatagtttcagaaggaatggtaccagttcctccttgcacctctgggagaattcggctgtgaatccatctggtcctggactctttttggttggtaagctattgattattgccacaatttcagctcctgttattggtctattcagagattcaacttcttcctggtttagtctagggagagtgtatgtgtcgaggaatttatccattttttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagcagtctatcaattttgttgattgtttcaaaaaaccagctcctggattcattaattttttgaagggttttttgtgtctctgtttccttcagttctgctctgattttagttatttcttgccttctgctagcttttgaatgtgtttggctcttacttttctagttcttttaattgtgatgttagggtgtcgattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccaatagtcattcaggagcaagttgttcagtttccatggagttgagcggttttgagtgagtttcttaatcctgagttctagtttgattgcactgtggtctgagagatagtttgttataatttgtgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtgttgggtgcatatatatttaggagagttagctcttcttgttgaattgatccctttaccattatgtaatggccttctttgtctcttttgatctttgttggtttaaagtctgttttatcagagactaggattgcaacccctgcctttttttcttttccatttgcttggtaggtcttcctccatccttttattttgaggctatgtgtgtctctgcatgtgagatgggtttcctgaatacaacacactgatgggtcttgactctttatccaatttgccagtctgtgtcttttaattggagcatttagtccatttacatttaaagttaatattgttatgtgtgaatttgaacctgtcattatgatgttagctggttattttgctcgttagttgatgcagtttcatcctagtctcgatggcctttacattttggcatgattttgcagtggctggtactagttgttcctttccatgtgtagtgcttccttcaggagctcttttagggcaggcctggtggtgacaaaatctcttagcatttgcttgtctgtaaagtattctatttctccttcacttatgaagcttagtttggctggatatgaaattctgggttgaaaattcttttctttaagaatgtttaatattggctcccattctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttcctgccttgctagattggggaagttctcctggataatgtcctgcagagtgttttccaacttggttccattctccccgtcactttcaggtacaccaatcagatgtagatttggtcttttcacatagtcccatatttcttggaggctttgttcgtttctctttattcttttttctctaaacttcccttcttgcttcatttcattcatttcatcttctatccctgataccctttcttccagttgatcgcatcggctcctgaggcttctgcattcttcacgtagttctcgagccttggctttcagctccatcagctcctttaagcacttctctgtattggttattctagttatacattcgtctaaatttttttcaaagtttttaacttctttacctttggtttgaatttcctcctgtagctcgtagtttgatcgtctgaagccttcttctctcaactcgtcaaagtcattctccgtccagctttgttccattgctggtgaggaactgcgttcctttggaggaggagaggtgctctgctttttagagtttccagtttttctgctctgttttttccccgtctttgtggttttatctacttttggtctttgatgatggtgatgtacagatgggtttttggtgtggatgtcctttctgtttgatagctttccttctgacagacaggaccctcagctgcaggtctgttggagtttgctagaggtccactccagaccctgtttgcctgggtatcagcagcggtgtctgcagaacagtggtttttcgtgaaccgcgaaagctgctgtctgatagttcctctggaagttttgtctcagaggagtacccggccgtttgaggtgttagtctgcccctactggggggtgcctcccagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcacccagaggtggagcctacagaggcaggcaggcctccttgagctgtggtgggctctacccagttggagagcttcccggctgctttgtttacctaagcaagcctgggcaatggtggtcgcccctcccccagcctcactgccaccttgcagtttgatctcagactgctgtgctagcaatcagcgagactccatgggtgtaggaccctccgagccatgtgcgggatataatctcctggtgcgccgtttttttaagcccgtcggaaaagctcagtactcgggtgggagtgacccgattttccaggtgccgtctgtcacccctttctttgcctaggaaagggaactccatgaccccttgcacttcccgagtgaggcaatgcctcgccctgcttcggctcgcacacggtgcacgcacccactgacctgcgcccactgtctggcactccctagtgagatgaacctggtacctcagatggaaatgcagaaatcacccgtcttctgcatcgcttacgctgggagctgtagaccggagctgttcctattcggccatcttggctcctccctgaaaaacttttattttttaaggtacttttcatctcacaactttatatacataattaatttggtgtttgctatagaaaagtttttctgaaaaagatacctttctgtctaagattgattgaaatcataaccaattttaagtcagtgtagtataaattgataatatttgatggaactgagcgaccatgtcatcagaagctttggaggagcagtacattcttatccaaaattgacattttacttaaaatccttctataaaactgtgaaactggaattacacatccagattctaatggaaaacagttattagctttggagccagaactataggattgctgtcaggactagtccagggacataggtaacttctgatttcctctccttgatccttgatgtgagtatgtgatatttatatatattcatatagatgtgtgtgtatatatatatgagtgtgtgtacatattcatatatgtgtgtatgtatgtgtatatattgatatatgtgtgtatatatatgaatatgtatatgtatatattcatatatgtacatatatacatatatatgcatgtttatagtctttgcctgaggactaagttaatagctaggaaataagtttcctccttagtaactgccacatagttttgcactagcaatgttcttttgcttaaaaaaaaatgcatgtttataaacataaaattatataatcagatttaagtttttaatgaacactcgagacaaacattattttaaagaatatgtatacaaaaggtaaccataaaacctacttacaagtgatatatccaagagaaatagaaataggcctttaaaagccagagtgatagttattatttgcatattgcaaacttggaaagttatgactttgtgaaaaaatttttaagactaaactggctaatataaagtaatcagtgtgaagtatggttccccttccaactggttaatataggagtgttaatgttcacaaagaaagaacttaaaattttagcatacagcagatgaagattcctaggggatttgaaagtagttgaatgaaatatcagttgctacagaaaacaagtacaaaatattttcttgtaatggactgtgtctcatttattgtgactggagtaccattgtatagatggcagagtacaaaatatgcctataggtgaaccaaattatttaaatgaacccatttaaagagtttgtgctttcacataatcactggaatttttaaagcatctaatcattatttgtaatgtactgtcttaataccccaagtaaaatgatgggatacgacagatgtgataaaagtggaacctgagatcaaatgaacttaagaataaatcatttgagtgtttaaatcaatgcccttaagttatctatgatgtgatttaggatttcatgtttattgggcaacacagataagcagatggataataaacactagtttctcttttaggatttacacttttattcttaatctttgtgtgtgtatatttttaaaaaaataaacattgcaacttcagttgttttttgttttttgttttttgtttttgtttttttgagacggagtctcactctgtcacccaggctggaatgcagtggcgcgatctcggctcactgcaagctccgtcttccgggttcacgccattctcctgcctcagcctcccgagtagctgggactacgggcgcccaccaccacgcccggctaattttttgtattttgtttagtagagacggggtttcaccgtgtcagccaggatggtctcaacctcctgacctcgtgatccgctcgtctcggcctcccatagtgctggggttacaggcgtgagccaccgcgcccagccccaacttcagttttcacctaagtttccacatgctattggatttttttctataacatagtacttttttcatgccatgatttatcataatttaacatatctactactgttggacatccaggtttgaactttcgctactataagtgattctgcaataatgatctcagtggctaaatctttgcctctaattctgttattaccttaggataaattcttggaagtggaatttcagagccaaagggctatacaacctaaggcttttgatacactctgtcaaaagtgtgaaaaagcttgtatcaatttatactcccaacagtatacaaaagtgccttttcccccagggcactgacagggagtgtttccatgctttaaatttttgacaattggaccgatgaaacgtgtcttacctttgttgtaatttgtattcgtttgattagtgagttgaatacattttcacatgtatgtaccatttgtatttcttcttttgtgaattgccagttcttgcctctgtcccttattctgtgtggatgtatgaagaaatgggtcactcagggtataaggaaaactgaaggcagagatggacttcgaggacaccagcacagtgactctgctttttctcccttgtgtatatgtggcctcgatgagacaggtttggttgcaggaccttttgtatataaacatctccttacaagtgggccttctgctcatagacataggtgtaagtttcacaatggtgaagaacaggtgtacgtgagctggggcacaggcccaatgtgtggtcctaaagtctagctggatgccgcctgtacactttttactacagattctaggtgccaagaagttctgcatttactgcagttcagagtagcaagttcatttccacaaagtttctgtatccttattgagtaaatgaaaaacataaagcaggcgataaatagcactgggaggtaaatctcttttcatcaatccatagagtgttgcaaaagatgcaggagatacatagggatatagatacagtcctgtgccacttaactcatacgttcagagaaatgcatcgttggacaattttgtcattgtgtgaacatcatggtgtacctacacaaacatagagggtatagcccactatatctaggctacatggtatagcctgttgctcctaggctacaaatctgtacagcctgttactgtacagaataccgcaggcattcataacacaatggtatttgtgtatctacacctagaaaagatacaataaaagcatggtagtataatcttatggggctactgtcatatatgtggttcatcattgatcaaaacattattgtgtggtgtgtgactgtagagatatagatacagatatagataattatggacatggatttttttcttattaagttgcaaatagtttttatatattatgaatcttattaacccttaatctatttgtaaatatttagatcttaatattctgcaaatattttcctgtttgactttgtttaaggtatttttgatataaaggattttttttacaaactttaaaatataatcaaatcaatagcattatttacttgtggcctctcatgcttaaaaatactgatttcactctagagcaaatactaattatattttttctttatttatatgtacaaatataattatattttttcctcatttatatgtctacatccttacttaagtacatttactatatattatatagattacatttaattcatctgaattttgtaatgtaatagttgaagtaggaatttaatattttttcacattatccacttttgtaaatgtcatttaaattaactaggggatacttcatatcgtctaataaatatacgctaatctacttatatttcagcaatgagacatcaataaaaatttgtgcagtcaaatctttgcaaagaagtgggataggatttgtgaaatataataggtttaaatactaaattcagatttgatgatttctgatagacttagaatgctaactaaaaataaatattttcagaaatacacagccactaggagtgtaatgtgtaacctttagacactgtaaaaaaaatgtaatagtggaaaagcagacttaaagaagcttatggaagttacatttgatgtcagaagcagttatcaagatctatttttcagtaaaaataaagtgttaatcctgcagaaagtcaggttacataagcacataagcataacatttaatccctatattacgtattttgagagttcgttttaaggaataaaagacatcctttgctgtcaagcttataggcttgtaatattgggctttacaacagggaaacaatcggaagacaaaacaactagatgaaatacattgctaaactgcactttgaaaagagaaaagcaatgaggattcagaaaagaaaagactttacagaatttacaggttgagcaggacttcgaaagatggtaaaatctgttttaagtgtagcaggacagcagtacgtacttatagttggaaccgctccaggaagtagtggaagcaacaagggaaaacagtggtagcattgtaaggaggccacccgatctggagagatcctcttgggaaaccatggaagttaacattgacggtaaagtggaatccacttaggcggaactgtgaacgttgtgccaagaggtctaagactgtctctgtgggtagtgtctggccagtctaggtcctagagcagaactgagacgcgatgaacaatgaatggactatattacgatgagcttggaattgatgagtcaagatccactacgaaataagaaggcgtcacatcgtgaatagagtagaaggaacaagtggtagcagtgttgacagggctctgtaatgtgagagaagaagagtgaaaagccaaaatgactccaggcttttgggtgcagaacctggagaaatgttcctgtaatagagagaggaaaaaaggaaaagccatagaaagatagttaaaatagactgtcatctgcacaattacataaagtcatattgcaggagagttgagactgaagtttgtgaaatagtagatagtatataaaagtgttatcaaaactcaaaaatacatgtggatttaaaggaaaacataatggttttagagaataaggtggacagtgaacaatagcagatcaagttcaggatcaaaagatggaaggatggaaaagttatttttccatctttcataagtcatttcttagaacaggtcattcagtgaccactcggtatctaataaaaatactacatcatactagcctagttaactttcatatacctgtactccaataccagctaaggtgcactaatttgctgctagagtaagaccctagcgattgaatagcagagtctgagaatattttatcccatgcattttagttacttcctgcaaatctcaaaacaatcacaacataaaatagatttcctgtactcttgactttgtatttatcttcaccacagccgtaatgagggttttgcagctgatatactttccatgggaacctcctgagaacacgagcatcagaggcaggatggtgcaaggaagtaggctgtaggattatgatagtaaaccgtattcccctccacctttgagtctcaatcctgagtaagattttaaatcaagttggttgagttttgtagacagcttgttaaagacacagcagatgtcctgaccagtgggcccttttatcctgtaaagacaggctaagaatccagtagtttttattgtcgacctttgcatcttcagggttcccatgttagttccttactaacttagtttctaactaacttccttagttgctaataccattagcagattgagggctgttaccattttgtctccaaacagcaaaaggtgagtgtggaggatcagaagggagcataggctatatagtgtagccttaaaatgttgtcatagtttcacctgtctgctcccaaattgatctctaaaagggataaaaaccgatgtaaagggatctatttggaggtgaaggtttgttctttaaaggataagaatattgcccacgtatatacccacgagtcctggtttcttcccccagattgcaagtagcttgtacggcatgtgcagcccatctgtagttgacagctgtcaggcaagattctcttcagaagcatcagagaggagagagtgtctgttgaccctttccatgagatgcatttcttctcctatttcgatcatatgttttccctcacaaaaatcctcttactccaaccaatgctggttctgcgattcaaacatcgttccctcatgaaacactttgtgttcgctccaaaatcctttgccctcccccacattaaatgtcattactatccagaagcattttgaaaacagccatttgtaacagtgacctttccaatgataattgctaaggattttggatgtgaatgttgttgttactgttcttcagaaaaaccagtatatgaaaatctaaatggcagagaagttgatggaggcagagatagatatttggactttactcaacacttattatgtttaatcttttcaactaccctctgagattagtagtattatctgtgttttacagaggaaagaaaactaaggcttagaaagaatctaaataccctgctaaggtcacacagatactgagtgacaaagccagcagttaaagccacagcctaattctaaaacccgctgagtaaacttcctgttcttgggtggaatctattggcatccagacagtagtagactgtaggtcctcagattacgtgctttgcaatgagaaggaaagagctttttcaacttaaatgtcctcactgtctccaagagcttctgcgcagttgaattcatttcctactttttagtttaagatgtaatcctgctatattaaaagtttctggccaggtgtagtggctcatgcctgtaatcccagcactttgggaggctgaggcaggccgatcacctgaggtcaggagctcgagaccagcttggtcaacatggtgaaattccatctctattaaaaaacaaaaaattagctgggcgtggtggcaggtgcctgtagtttcagctactcgggaggctgaggcaggggaattgctcgaacccgggaggcggttgcagggagccaagatcacgccactgcactccagcccacgtgacagagtgaaactctgtctcaaaaaaagaaagaaggaaagaaagaaaagtttcataggcacagtggtaagggcatttgatgagaagataagagatctggtttcttattctggttctatcattaatttgttgttttaccttaggcagttcacctggtgtcactgggtttgagtttcttcaaattctgccttcttattaaataattttaatgtgcattgttttatctttgattaagactacaaagctaattttgcaaagttttttcttgaggatttctctcaagggaggaaagtcatgttgggtcaggataggtctaacaaagtgaagatgcaaagcataaaaatccaggaaaccacctgaagtggtaagaaaagttagatttaagatttattttttgcatccatcaaacataacccaagtttccgttgggtcttgtgtgtctgttgtaagtatcatgtctatgacaaatagaacttaaactaatacagcataccctatcgcctacagagctattcttttattttgttttgactggtagtggtattcaggaagaaattttttgatgaataccttaccatacctagcaagcaggtcctatatttaatagattaatacaaaaataactgacattacctgaatattttaatcaacctttttaaaagataagtcggttttaacaaaaaagagacaataacatttcccctttctctttcacatacttttcaaagagaacaacgtggtgtggtacttactgttttgcttaaccatggtcctgatttctaaacatgagtcattcctaccccaggttttcccaagtattgttatctgtgtctttcttgagatactacaggctcttaaaacgcaatctggagcagttcattatttcactgtgagaatattcatgcgattatctgcatgtttctagaagtgatctctgcaaaacaattctgctttctgttgctaaaggacctgccaaatagttgaatatcttaatcataagtctgctctggaccttgagagacattagttttattttctgtaaggaagcctcgagagacaaactcaactaggtatcatggtttttctgaatttgcctgtgtttgtgtttaattaaatttttttttcctgcttttgtcctaagttcttaatatgaagttgagacgttttggtcttcagtttcatggcatacttcttttcacatttgagaagcaagactgttatcctttctttctcaaaactaattagaccaatattcattccttgagaaattgttcctaccttttagccctagtcattttcattattcactgagctttttcccagtttatcatgactccttcgtttctgagggcctcaaaaattctcctccccatcacacacacacacacacacacacacacacacagactttcttatgttttaatgcactgttgatgttggtacccagcatctttttgcctttttaatgataataacaccctatttctgttcaaagttatttttgttgtctaaaatgtgtatcaacgctatgttaaaaaccgtggtgtctgccctcaaatatgtcttcaatgggtaaatctgttctgtgacccttttcttcaatctgacctaagcctcaccatgatgtttctgaaaccactgaaaatatccacaacgtgttacctttctcttctcctacttcttggtaaatttctgtgtaatttccagctttggatttctctagagttttccataaaattcttatttcctggatcaccatggatgactagattaggattttctgatcattctcttcccacatcctctagtcttaccaatcgaatgcaatcgcacggtcttgtctcgtttcctatcctgcttctaattatcagaccctctccctcccgtcccctctcatttcatcattttaaatttcctcataactgaggcattcaaatacatgtttctttcaacttgcagttcttaatagaccaggatgagcaataaatatctatttgaagtcctgacttagtagcttttcaaatgttatttcccacaccctaaaagtcgatgcaactttaaagagatctaggtttgaaagagaatacaatatgtgagttaatgaaaggctgttccacgaacctgatatttcagtttatatctgttttaaaaatataccttagaatatcttattgtagtttgcagcttaaggtgttatatagataaattatgcaaactctcattaacaaaaataacttgctatacattgcaaatatacttccagttagaagacagctgttggggaatagaatggtagctctcttttagtagcctactttttttcctagcaggcacaaatcattaggaataaattgtcttctgtcattgtagccagtaattggtgacattttcttgtcactatgggattataaataacagcaatatatgtactgtcaacagattcattatgttatgaaaaacataaaccagtagtctgtgtcttttagctatagtttgcatgttttccgtattaagtatgacactgacatctttacaaattaaaaaaatactcgacagtgcagttttgttactaataacttcaaattttttaagctttaaatatatcataattccttctatttcttccatagttcttctggaaaatatattcttccaagatttctttgtttgcaaacaagattgtaagcatttgtgatgcatcttagcggagctcaagttataagagtaatgataaataccttgtcctcaaaattttagtttacatagtaaatagtggtcacctgtcccatgctgaacaaaaaaaaaataatccatccagaaggaaaattaacatggactaaatgttataattacttgcttcattgataattttgacagattaataattttcttttttgagtctcgctctgtcactcaagctggagtccagtgggatgatcttggctcactgcagcctctgcctcccaggctcaactgatcctcccacctcagcctcctgagtagctgggactataggcacgtgccaccacacctggttattttatttatttatttatttttttgggtagagatgaggtttcaccaggttgctcaggctggtctcaaactcccgaactcaagcaaattgcctgcctcggcctcccaaagtgctgagattacaggcgtgagccaccacaccaggcctattgataattattaagttagatattattttctaatttgagtgtcctggcaatggtatatacctgtcacctctttgacctcccgataaagaagggcaacatctcactttcagtagctgccattgctttgcagagaagaagttttatttttctttgcctttgcaaaattaagacagaaaagactctgctggttatggagagtgcatggaaagcaagctggctgcagcgttcatgtgacccctatcttcctagacaagtttgtcagcctctgagtgagtctgttttgccttgctatcaaggaagtacctgaggctgggtaatttataacgaaagaggtttatttggctcacagttctgcagactacacaagaagcatggcgccaacatctacttctggtgagggcttcaggaagcttttactcgtggaggacggaaggggagttgaagtgtcacatggcaagagcaggagcaagagaaaggaggaggtactgggctctttttgacaaccagctcctgcatgaactaatagggtgagaactcactcatcaccaaggtgatgtcaccaagccattcatgagggacccccctcataatccagacacctcccacacggctccacctccaacattgggtgtcatatttcaacatgagatttaaaggggacaaatatccgaactatatcagcctctgaaccaagacttgaagggcataatttcttgcctgttccctagagtcatttttgggagccccctactaaggggaattgtgactttcctatcgaggagatgccttctaaacttctctgtttctctcttaacagctatacaacatttaaagacttcaaaattttggattcccctactttgtgaaaatactgttatccaagttttctttacctcgtttcttatttattcactcaacaaacacagccaaggcattgtttctgactcttcagggactacaaagctgaaaaacaagacctaccagtgtgtatagtatatatatatatatgtatatttagaagtaactctaacgggagctacagtcacgtgtgagtttcacacgtctttactcacatgctttgtgtcttactatttctgtattaatttttcattattctgggcagtccatcattcagatatccctttcttcatctaaaagttagtcctctaataaagcattttgctactgaaagaggcaccacagtctttttggttttatagactaaatctgagctgtatttgaatttcaatcctgctgtttttttcttggccacttcgttgatatcccttctatttaaaataatgctatctaaagcagcaatataaattgtacactaaacatattctctctctttcataatggaaaattgtaaaataagtttttaaaatataaaccactataacatttttgagacattatgaaatcacatgatgagttgtgttatatatttttcatcatggcactcaaaacagtttgccaaagtggagctcaagtttctattttttcttcccacttaccatttccaaatcacttccaaaatttcaagttcattagccttgtctttcttccctacatgatatctttccattgccatgtacttccatccaattcaaacgatttatttcaaaactttttttagtcctgagtatataggaggtgtatatattacttcttcaaatttcttcctgtcttttgtccttttcttacatctagaaaatttttcccccaattctcttgatcttggcttcataaaacgtctttgcaccagtgaagacaggacagaagttgcatcaaccttctcaggaaaacttaaattctctaagcttatcttccccgttatctaaacaccaaataatcttatttttccattctttccttgcaattcctgtgaagacattgtaatggagtcttctttattatttgccatattgtgaataaaccatgagttttcttgcctctctgcctttgatcataccaccaacaatctgcaataccctcttagccactctttgcagatcaaaatccttccaatctttcaaggctcaacttaagtatctcttccttttagtcatcctaataacaaagggcagtgagctgtccagcctctaaatttcccagatgtttactctctctaatgcttcatgacatttagcatttactaccttattttgaagttatctgtttacctgtcttattttcctatactagatcataagtatcaagaaaaggggaattaggcttctaagtccattccttggattgtgtagcaataaagccacaccccaaatagatgcctggttaaatgttttcaacagcggaatgaacgaaatgtccatggaactaggcacaatgtcacaaaatgctgggaggaattcagagagaaacttagtcttaggcagagaaaggtttttattttcctagtggaaaaacaggtatttgtattctctgaccttttgtaaaaatattttttaaggagttgcgtgttgtggatggtttttatttttatttttttatttttgagacagagtcttactctgttgctcaggctggagtgcagtggcgcagtctcggctcactgcagcctacacctcccaggttctagcagttctcctgcctccgcctcctgggcagctgggattacaggcacaggccaccacacctggctaatttttttgtatttttggtagagatgagatttcaccatgttggccaggctggtctcaaactcctgacctcaggtgatccacctgcctcagcctcccaaagtgctggggttacaagtgtgagccaccgcgcccggctgggaaccgcatgttgtgggtgctttttaaaacaacatttgtaaaagggataatgaatgcactgacttccatgacatagtgttttaattagaattcagaccatttgtgcaccccttatgatagtttcttcttatttgcattcactagatttcctttcctaaatgatttatacacttgcataactggaaattttaaacattaaatttattgcatcttgtcattatgtattaaaattattttcctaatcttgagtactcgaattcgtcatatgttcttatacacataatttatgttaagaattgcttcagcaacatttgcgctgtcatttggcacgcttttggaatcaatattgtagaatactgtaaggggaaaaaataattctaacagttctcccctgtgttcccattaatttgtttattatccaggtcttcattagtaatatagttgctaatgtaagcccataataaacagagtataattgaattttcaatattttgtcacctgggagtaattttcttccaagacctctgctccatcttgtgactaattgtcgacagttactcagtgccaccacattaatgtcatctagcattgcaaaaatatctacctgactgcattatatttaaagatattcattccaagcccttgatattttctttttaaattatttacctcaagtttaaatatcatttaaaatgcaataaatgtaatgagccaacatgttgtgaaaatacagatttagacatcagctaagatttgtttgggtagaagataaagacagtcatgttgggtgtcaccaagcattggagcagcaacgtggcagaggagggaggtggctgaaccggagtcagtgtacagaaaccagagcgatggccattggacccattttttttttttccctgaattggggttgtttctggtcaaattactttttttttcctgtgagttttacctgggttgaatcagatgttatcttgatattacattatgctgaataatgttctaaaagtgtattatcaaaaataagtgaagacaataacaattgaaaatgctagacacaggcagattgattgaaaaatacaaaaatctttgtttttgttggcactgtgtagtcagaatcaagcttttcacaaattcagaacacaaaatagcaaccccggaatactccaggtttatgtctgttgtcccagtgtaatccgtccgcactgtctccttccactcttaaacatgtcttggtttggtcattaagttaaatggtcagctaaccgacaacacatttttagtttagtacctcctctatttcccagacagcttgctaatgacccatatagtaaaattaaaacaactgtgttctgattcaggaatcctacacttgacctaatttgcaaaacttttcaaactctctttgttcaacaatcaaattttgattctgcgtataggcacataaagccacattttgtatttatttattcatttatttatttattttgagacagagtcttgctctgtcacccaggctggaatgcagtagctcaatctcggctcactgcaacctccacctcctgggttcaagcgattctcgtgcctcagccttgcgaatagctggtattataggcatccaccactaggccaggctaatttttgtatttttagtagagatgaggtttcaccatgttgcccagactggtcttgaactcctgacctcaggtgatccacccgccttggcctcccaaagtgctgggattataggcatgagccaccacgcccggctccacaattattccttaatccagatattgtcattgcttgtttctgatacactatatataaagtcatatatgtaaaacaaatcatgtatatagatcatgatattgtttatatgatttttaaattttcattaggaatacagtttcccaaagagaattattcacattatgggaaagcaagagagcctggtgatgctagcacgttatcctagactctgtgggtactctcttagtatatcacaacagcaaagtttgagtgaatgtcttattgtgtgatcatagagaagcaaatctctgtaggtgagtgaaatagagcaaatgtggtagaatgaaaaactgcgatttcggatggcatgctcacttcagttcaagcagacattgatggatgtccacgatgctcactgtgctaggtcatgtggaggatacggagggaaggcagttcgcttgcaaggactgcagtttggaagtggaagtgggattgggagtagctgctccctttcactgagcactcccagtctgtgcagattttgttctcggcttcttaaaggcagtgagctcgggtaagtgtgattcctattttataaataaggaaaccaacatacagagagatttatccctttgtctttcttgagcatctgcatgtgctgttgtgcagacgactggggatatggtgatgaaccaaacagacaggttccctgtccttatgggagcttacaagtctagagggaaagacagacctcgcacaagtgaaccacaaaaatatgtacgcacactgcatacaaagaatggagctggcttctgtgagagggggtattcagaatgtaggagagggagacttctttggaccaggtggccagggaagtcatctctgaaaaagtgacaggtttaaagctgagacttgaggggacagaacgaacaagttagataacatagcaggagagattccagatggaaggaaagcatcgcaaagaccccaggagtgcaagagctaatgggagcgctggagaaactgaaaacaggcctcggaagggtcacccagcggtcacggaggacagtggcataactcatgaaataaggttgcagaggaaagtcgggttttgcagagtttggatttgaaaagattttgaatttttaaaagattattttggattgcagaagtgttttttctcccaaaattgcaataggaagccatgaaagggttttgaacagggagagacatgatccaacttgcctaagaacctggagctaaaaattcagagagctagaactgaactcaggccagtctaacttcagagctcagctccacattctaaaaccgtttcccttgagactctacaaataactgggtacgtggcagaaggtgcgtaccgtggccagtatgcacaggcattgggtagttctaagcgggaagatcgagcatcggatttggactttcataaaaactcgaggagatggcaccagtctggagactagaagcgtgttgcaagggccaggcttggtggctcacgcctgtaatcccagcactttgggaggccggggcgggcggatcagcctgtccaacatggtgaaaccccgtctgtcctaaaagaaatacaaaaattagccgggcgtggtagtgggctcctgtaatcccagctactcgggaggctgaggcaggagaatcacttgaacccggggagtggaggttgcagtgagccgagattctgccactgcactccagcctgggcaatagagcgagactccgtctaagaaagaaaaaagggtattgcaagaaacaggaagagcataaaaatggggcagggaaaagggactgttttgaggggaaagtgagcagtccaagtccccacagtgtatcccacccatagtgtgttactagaaaattgtaaaggtaggttaaagactgaacggggcttttcatgctcgtctgagacattgtatataatgcagtaactagtgaagagtcactgaagatgtctgaggaggagaatgacttgaacagagatacacttttaaaactctttttaatctgagggtgtggatgtaccattaaggaagggaggctgcatgaaggagagatctgtaagacatttgtacagcctgcgagtatgatggcagagtccagccctgagccaggccgtctggccccatgttccaggtccaccgctcactagctctggggccttagacagttttctgcatctcttggtatttccatttcctcgtcaatcaagggggttaaatgagagaatctacttcacagggttattgagcagagataactttattgatcaagtatttaccagacctcttggtgtacattagtacacaaggcaggctagctatttcaacaacaacaacaacaacaaaagactagtgcaggatgggcgcagtggctcacccctgtaatcccagcactttgggaggccaaggcgggcggatcacctgaggtcaggagttcgagaccagcctggacaacatgacgaaaccctgtctctactaaaaatacaaaaaaattaggcgggcctggtggcaggtgcctgtaatcccggctactctcgaggctgaggcatgagaatcacttgaacccgggaggcagaggttgcagtgagccgagattgtgccactgcactccagcctgggcaacgagagtgaaactccatctcaaaaaacaaaaagcaaaaacaaaaacaaaaaagaactagtgcagccattcccctaagagctagttaagcttcagctagagtaaagtgagataaatggaggagttgtgtgaaagactgacatgagaccagaaactccatgtggacaggcaccatgtccacttcgcctcctgtttaacttccagcagctagtgcagtgcctggcattgcgtaagcatgcaataaatatttgtgcatttggattgaattaatatatgaagtataatgcacttatatgtgccctgctatatataaattatgctggcttatagcatacacatgtgctactgatgatattgatcagttttggtaataccctgccaagcaccttgaactacacataaaaaccaacaatagaggggaaaggattcaaaattgttatttaaaatgcctcccaactgtgagaatgtatgctgctcacaaaacttaccagtttcccggaatttaacgaaggccacatcttgctttcccatttcagcaagggtgtgattagtttaccagtgacgcaaccaaggttaacccaggctttggctaaggtcccagaagaatttagtaaaatcttcttgaaagtctctaccacataccctctttgccttcctgacctcatatgaaacctcctcttgtttggcaccagcgcatggagaaagctgatgcaagggtggtctggcttatgggatggtcacccgctcttatttcctctgtgctagcacagggctgacgctgacgggcagtcttctagtgcttgagtctctccgtacccctgagggaggggtgtgctctgaccaggaacgagatcagacagctgtgagagtcccgaccagggctgagctgaggagtgagagcaggtgcttttgatagccaggaaagaattggtctggggatcccccgacagggggaagtcacagaaattagagacggaaaacacctattagtcaattcccatgccaaagataaattgatccctagtgtgtctccctagctccctgaccactccagttagttatatctctgtcaacatgtaaggaggagggaccatgggatgcagggaaaaaaagactcaggatgttaagatggtttcgatactgggatgaagagaagatcagtaatcattaaagaaaaaataatgattttggagaaaaataagagcagtagacattttccccctagggcctgagatttgaatagaggtaggcaactccacaatgggttctatagctgttcttttcttttcctcccctcccctcccctcttctcccctcccctcccctccggagttttgctcttgttgcccaggctggagtgcaatggtgtgatctcgatctcggctcactgcaacatccgcctccagcgttcaagtgattctcctgcctcagcctcccaagtagctgggattacgggcctgcaccaccacgcccggctaattgtgtatttttagtagaaacagtgtttctacatgttggtcaggctggtctcgaactcccgacctcaggtgatctgcccgcatcggcctcccaaagtgctgggattacaggcgtgagccaccacaccgggcctatagctgttgttttcttaatgaagagctgatgttatttatccaaagggaagaaatcgtcttgttcatgtggtcctcattttgtgctagggagtagaggtcttgagtgagtattgctgacattgctagaattagaatatgcattttgcttttggagtagtgacagtagagaaacctaggacgatgctctgatagaatgtattaaagagggaattatatggtagtttgtaaatatgtggatttggttgactatctatggctatgaagagagccaaaggatgttatcgctaaagataagatcatattgagatgcaagtagatatataatgaaatctgaattggctctgttttgcttggactattttcttcattatttataagaagaaaaaaggggctaattctcaaactatgtgtcagtaatttctcttgattttaatcacattaaactagatggctgattcattgcatcaactttgattgatatttttgcaccatttcttgttttttttttttatattttcaagttatacccaggcattttgttgcatatctcacatccaaaatagctcaaatgagcaatatcattcccagccaacctctccccgcctctctcattcacactgcagttgaaggacttttccaggaaatgtttagagaaccatgggctaaatagcctttgccccaggacttttttcttccttcattgtatttgttttttaaacttatcatggtagagctaactcctgctgctgtcttctctctaggcatcaggtccggggtgcccaggctgcctcccagattccacaccacagtgtccatgatagcagcttgatccttcagccagatccactctgcacattgaaaggcaggcagaggtcgaagccataggccccaaattcctgtgatctttaaaaacctcttttcaggaactcattatgtttatcacacatataaaatggtggcaggtgagctcatccttttcagggtacctgatgccagactctggtggttcctcgacccatgatgttcaggctgatcacccttgctacggttcttacagttttagttccatatgaggaatccatgagctgggaccacctactcgttggtgttgctaaggaaaaattcattctggcgcttgctaaaacgttaaggaagactattcagaattgttgcaactggtgtcaattctgttgcaataggggagagacatcaggctcaacctcaattatggaacgagtggggatttacagccaaagaacaggtgtggagtcggggtggtggatggaaaattactaagaaaagacatcagggtagggagattcttgctaaactcacttaacaggattcttgctgatggtaggccaaggacttatacatcaagttgggagatgaggaatttgaccagatatggaagatgtgggggttctctctaaactgatttagcgagagtcttgctaaatctgggctatgtgggcccagcaaggggaagggtgaagaaggtggaggcctagtcaaacagagcacttggaggggcctgactcaagtggagtcaaggagagagtctttgtcagtgtgacaagcagcagttgttttaaaaaacatatttttatttatttttttaaattggagactcaggggtacaggtgcaggtttgttacatgggtacattgcatggtattaaggtttgggcttctattgatcctgtcacccaaatagtgaatataatacccaatagatagtttttccatgcctgtcttccatccctccctccccccattttggaatcctcggtgtcttattgtttccatctttatgtctgtgtgtacccaatgcttagctccctaagcagaaagaacaaagccagatgcatcacattacccaatttcagactatgcttcaaggctacagtaaccaaagcagcatggtactgttacaaaaacagacacatagaccaatggaacagaggaggaaacccagaaataaggctgcacacttacaaccaactcaccttcaacaagcagcggttctaccctaagaatggatacatcaaattcagctaagtatggctctgccagaggcaggaccgtatttctgtgcatgcacagtgtatattcttgagctcatgccaggctctccccgcttcggtcagttttgttttgggcacttccctctcccatgctcattgggcctaggaagtcaggccttcaggtttcaagaatacggatagtgtgtagggaagggacgtgagaaaagcccttggacgtgactcaataatgatgctcagatctttcacactcaccctgtgaagccgactttttcaaatgaaaaaacatatactactcacatgtgacattttattcagagccaaaattataaagcaaaggagttcatgtgtttatacccagaaaaattggcaaagctttctttgaaaatgtctgctgtggttcagtttttttttttttcttgaaaatataaatggttcttcatttagtaccattactttgaaagaaaattacagagtagacgcaggtaggtgtcactgaggagttttattatgtatgtttacaaacaaagagtataaacaaagaaatgcatttgttatacttagtgcccccaaaatcatttgtactaaagtagcccttgaacaagctggaaaataagtggaataaatgtggtactttggttcctttccattgactttcaaaaacaccaccgatattgaaatatttgtgtttcctttgctgtagtgccagcaacataatagatgagaagagagtagctattcactgttctccagaaatacaacttagcctcttcctgcaacttgagcctccacactgcagccttcccttgtctctgcgatttcctgcttgctccctcctctaattactcttctttttttcagactcctttcatgagtctcctctttttttgtccccctttattccctcttgcccacattccacatttcttttcaacctccctccgtatttggctacagtgtttaaaacgagtattaagtctggaagctgaataagccccatctcctaaaaaacagttttacagattttctactgacagagttagcagtctggcctcagtgctggggaactgaaaagacccatcagcagcctgaaaaagaagagcttcttcatcagtgcagtaaactgctctgcggcttcagcctcatttttacgtagatgacggtgtcccccagcattgttgtaagtacaaacacatcatcaggcatcctggaaagaaaaatccttctgcttgtccagattaaactccgaattcatccaaacattaaatgacaagaatgttgagttgagaatgtagaattgtaccagcagggaatcttaagaggtaaatctgggaaaaggaagttttattgtgcgtcttttttttttttttttttttgagacggcgtctcgctctgtcactcacactggagtgcagaggcacgatctccactcactgcaacctctgcctcccagattcaagcgattctcctgtctcagcctcctgtgtagctgggattataggcacccacaaccaagcccggataatttttgtatttttagtagagacaggatttcgccaagctggccaggctggtctcgaacctctaacctcaggtgatccacctgcctcggcctcccaaagtgctgggattataggcgtgagccaccgcgcccagccagtgcatcttctaaagataagaaattactattactctattcagcaataatccattgcaatatttgatagaggctttgttaaaagttattttttaaatgaatgaaagtaaactaaatgggaaatgaaacaaaaaaatttcatattttaatgaatttgtccttttctttgcctctaagataaattatttcaacaagaagctgatataaattgagaatttcttaaaactactggtagatgacagatgtgttttaaattatcatatgagatacagctatttttcttggaagaatacattgctatttttcatattattattatttttaatggcattcttataaggtaactaaactgatatccaaactacattttaaaaattgtgtcatttctgattttatacctaggaaaagtaatatctaccttttaaaaatgaaaaccctcccaagaatattataaattagcattgcttttttatgtgataagcagcaaaatctcactgtttgacttagaacgtaagaaagaggaagtgaagactgatcacaagtttctatttggagaaaatcaatcatgcactcaattagaattcgcaaaagtatctttgtgccttttgtttaaaaatttcagtaaacatagcccagtctgatttggaaccctcataattgtgaatagcaaacaacttatcacaagaatagattcccacaaaagggattctcacaaaatgtctgggtattgttaacacagaagggacaagaagttttaccttatagcactgctgaagtgtttgtgttttgaaaagaaagaatgatatataaaatagtgagaggtgacagcgtgctggcagtcctcagaaccctcgcttgctctcggcgcctcctctgcctgggttcccactttggcggcacttgaggagcccttcggcctgccactgcactgtgggagcccctttctgggttgaccaaggctggagcccgctccctcagcttgcagggaggtgtggagggagaggcgcgagcaggaactggggctgcgcgcagcgcttgcgggccagctgtagttccgggtgggcgtgggcttggcgggccccgcactcggagctgccggccggccggggcagtgaggggcttagcacccaggccagcggctgcagagggtgtactgggtcccccagcagtgccagcccaccggcgctgctctcgatttctcgccgggccttagctgccttcccgcggggcaggcctccggactgaagcccgccatgcctgagccttcccccgcctccgtgggttcctgtgcagcccgagcctccccgacgaatgccgccccctgttccacggcgcccagtcccatcgaccgcccaagggctgaggagtgcgagcacatggcgcggggctggcaggcagctccacctgcagcccctgtgcgggatccactgggtgaagccagctggcctcctgagtctggtagggacgtggagagtctttatatctagctcagggattgtaaacacaccaatcagcaccctgtgtttagctcaaggtttgtgaatgcaccaaccgacaccctgtatctagctgctctggtggggacgtggagaacctttatgtctacctcagggattgtaaatacaccaatcggcaatctgtatctagctcaaggtttgtaaacacaccagtcagcaccctgtgtttagctcaagctttgtgagtgcaccaatcgacactctgtatctagctgctctggtggggccttggagaacctgtgtgtccttggagaacctgtgtgtccaaactctgtatctaactaatcggatggggaggtggagaacttttgtatctagctcagggattgtaaacgcaccaatcagcgccctgacaaaataggccactcggctctaccaatcagcaggatgtgggtggggccacataagagaataaaagaaggctgccggagccagcagtggcaacacgcttgggtccccttccacactaaattttgctactgctcattgtttgggtccacgctgcttttatgagctgtaacactcgccacgaagatctgcagtttcactcctgagcccagggagtccacgagcccaccgggaggaaagaacaactccagacgcgctgccttaagagctgtaacactcaccgcgaaggtctgcagcttcactcctgagccagcgagaccacgaacccaccagaaggaaaaaactccgaacacatccgaacatcagaagggacagactccagacgcgccaccttaagagctgtaacactcactgtgagggtccgcagcttcattcttgaagtcagtgagaccaagaacccaccaattccggacacaataggactctggtttctaaggggtgataattgcaaaaaaaaaaaaaaaaaccaacaaacgaaaccagccattcagtcttgctttggaatttttttttctctccatggttaagcaaacgtgtaagcatgtatctgcatgccccaatggagactcgcactttcgcaaattatgaggaattaaaccttgcgaattagggtattttcaaccatctgggcatctggggttgctctttcttttctctgtagctgcctcttccccttcattcccagctgcttccactctagttcaaagttccatcgccacttctctggaaaccaggaactacttcccacctggtctccttgacgtagcagtccctctcagtcctctgcctggcctcatcaagacttcttcagcctgcttctattatgttgtttttctaaaaaacagtccgatgatgatgataacaaaaataataatataataaacatttaatgtacacccacttcttcaacagtttctacgcactaagctgtgttacatcttttgaatccttattttgtttaattctccaaaacagtcttgtgaattgtgcttgagtactaaccacatttaataggtatggatttgaggtttaaacgggttaaaagtactttgcaggaggctatgcagcaacttttccttgttctctcaccaagtcaaaaatgctctgctggcttttcaaacatctacatccatcctactaccttagaaacactgttttcaatgtaattctttttctagaacatttggtagaagattaactggaaatttgctattgcttttgtgtattatcatgcttttgaatctcaaatttagatcataaaggaaattgaatgtgaaactctctggccaccccaatttttcagaagcctttatctgtgtcacaaacaccagaatcattttgaaaatgttcgcaatctatgaccaaaagttgttggctctgcaacaagagcagactgatagccagcaccaagacagatggaggtgatgttctaggcagaggtggcttctagaccttcctttgcactgccagcttctagtcagtgttattaaatctagtccctttcataactgaaatttcaaacataaattatattgcaacatccctatagaaatgtctgaagttatatatgaagaaggaaggaagatgctgttctcaatacatcccacatcattaatatgtcaaatctcttttcttgtttaaaatgaaactgggatgttttccaacttttcatcctgatggtaaggatagttgcccgtgttgggtagggaagggagggaggtgtagctgaaagtacagttttgtgtttccactaatctgatccctcccaccagctgccctttccacctgccctacaaactctctgctcagaaagtacacattgatacaacttatcaaagccagccctctgttgtagccatttcagcaaaataagccaatttgggtttggtagatggaaaaaaaaaaaaaaaagaactatgcccaggccatagagattagactttaaaacagagctaaagtaattccgaaaccattttacctgccagaaaaaaaaattacatataattactttaaaaattagccattttaggtcagcgtatgtggcacaaagaaatctgaaatttaactatctaacagggaatatgacaaagtggaaatttgtttaactatgcaccatatcgtagagaaggcaccaatacgaattaggttatttctgtgtaggcacaagactgtagttgcaaagctgcactgcagtagatgactcttttttttttttgagacggagtctcgctctgtcgcccaggctggagtgcagtggcgcgatctcggctcactgcaagctccgcctcccgggttcgcgccattctcctgcctcagcctcccgagtagctgggactacaggcgcccgccaccactcccggctaattttttgtatttttagtagagacagggtttcaccatgttggccaggatggtctccgtctcctgacctcgtgatccgcccgcctcagcctctcaaagtgctgggattacaggcgtgagccaccgcgcccggcccagtagatgactctttaaaggtcattttagcaagtgtaagatagatcttttgagggtgcacatagcccacctccctcagtttggttttctgtttcattgactgtattagcgttaaactttttaagagtgacaggctgcaggaaggggatcccgggtgggtcatgggatctgcacagccagctgttccttagttcagagagttcttctttttgagatttacagatccgtttgcatttgacagaccatggcaagtctttgtactgcccagtcccagtgttttaaaggagagcagcttaataatttattaactgcaacatttcctctgggctttatctgtgtgatgctgttgagtcacagaacattataaatatgaagaatttagcagaatcacattctttaaaagagctatggcctttttgttgtggtggttgttgttgccaaggactcctctgagagctcttgttggtttacctggttggaaagcagcagaaaatggtcagctttgtaaagtgggattgcagtaccagtttcgagtttgctaacaaggtgccctgatctacaagatcgttagccatggaatgacagtaaaatgtggttgcagaaggttttgagacattcctgaattgtctgtgtgctgtgctgatgtggcactactgacactctcctaccgcagtgccttggtttctgcggttccttcagcccgaggcacactgccgtccccatctctccacccttcagcaccttgtcagtttatagatcatctcaaaagtgactttttttccacaaggctcttattgatcctcttcaaaatggatattgcttctgccttctcagactcatttatgatacttacatgtcccacttgatatgatgattactgttaacttttgcccaatctggagcaaaatggcatgatgtccacggcagggttatcctggatgtccctgtgtagcccaacacaatcgtgcacatgggagatgcttgttcatttaatagaatagctgttaattctgcgcaccaatccctcttctcatgtttcttgtccttatcctaattgcatataattatttaatgatgttctcagccatttgtaagctatttttagcatggaaaacaaattacctttacagacttttatattagagtaatattaaaaataatagctgccttcgtaagctgttcttcagtttacagaacattttcatacatattatttgatccgcctgtgtagattatgcccatccgtgcccatgactgagaagagggcaagagtctccctttacagattaggaagctgaggcccagataaattaactaatttatccagagttgcatctctggtaaatttcagaagttaaaatcaaacccagatgtcctcaggattctagtacgacttgttccacttatatataatttttcatcaaagttactgagcgctcattgtgaggcttgaatagacacagttaaataaaaccatgactggccctggctctaaggaggccagcgtcctgcaaacacaggcacacggctgttagaaatgaggacgcagccatgttgcctcactgcctggactaacacacaatgaaaaagcaacattcattttcagtaactgagcagattcaataaatgtaatggcatttaatgattatgcagctcgtagcatcttttattcaaaggtcaattccaatgcactgtatagactatttactctttttagagatggcagagataatagattaggagactacctgcatggaagaaacaattggcactggcctgcataaagttggtacttaaaaatgtttattgactaacgccatagtgatttgctctatgtttctgaacttatccttttatggttgacttcttcctctacaaaatgggcaaaaaaaaaacatgcttatgaagtacaattgagaaaatatggcataatatttcatttaaagcagtttcaggcataggctgaacaaattgctcaaatgttttgttccttaattttacaagggatgctccagagaatggaatctgactagatttttccccatttttagttaactttacttataattcaactaccagtactctcaagtcactgataataccaaattgaatggctattttatctataatgttcttttatctcaaatggggaaaagggcacattttcatataaggctgtgggatgtgaacagtgaagggtcgttcttcctctaagcggctctccattgctgcagccacctgctctaccgtacggagctgaggtaattaataagaggtattaacacgtctggtatcaccggggagagggaaaaccgaaatctgttgaatcgctttaactgtgaaacagcaaatgttgatttactcaccatctttcactttaccacccagcttgccatcatttctgcaagatgtaataaaaagtaagctcacaccccagtgtaactttaatgggtttaattacatgtaacttgaaatatgtgtttggctacatggtacgtccagccaccaatccataaccagcatttttggaaaagcacagccagcactcaggagagagatgggaattagaaatgcagactggggaggagagatgaggccttggagccctgagttattgcccatgtggggagcgctgagagcggaagggagacaggcaaagccgccaaacctaggggaatgcctccacgtggggcgggggtggaaacagagaaggaggcaggtgtgaacagtagagaaatagaggcaggctaaagagagggcatcgccacacaaatcaagagggaaattaatttcttgaggatgtggggcttcaggttgcaacggtgagtgaggaagcactgagaaactaggagaagctgtctgagctattttttaatgaagtttaatggtgaatgagaagagctattgggggtgcaaaattgaagagataagaactgaataacgatagaaatttattttgctaacaattgatgagatttgtgagtatctgtgtaggctgaagttaaagactcaatggagaaagaaagtaaagaaaatgtcggtttgtctttgagggataaaagatgctatcggagcgtttcctcttaatgagatccatttccatcaccgtctgtgtagcacaccattaaaaataactaacagacaacgtctttttaaatgacacattattttacttaaatctttacatctgaatcctgttcctgcttattttcctgcacttgttgacaagtcattaggaaaaacagtgtttagttcaatatggcctgtcatctaagagacctgtgtagcttaaataaaaaactgatggattaatagtagttaaaaaacaaaaggcagaatgcgatggatggtcctgtatcttttcacccgccataatatacgcatctttagacatacatacacagagataaaataagcagcaggagggaaataacatatagaaaactagaaaatcaaaatgagatggctagaaacatttgcaaataatttataatcaaaatatagaaataatcattccacaagcctaatttatttaatatatatgtgctgccaaaacataattcttatcttagaatttcataataaatgcaataattaaatcacacagagtagacattgacaaaacagctaatggacttcggatttagcatttttaagatacaggatttcttttatgtgatcctttgcattgatattatttttaaataccatctaatatcctgttatggatttttttagtagactgcttaacaaaatgtcaccaatccatgagagctggcaggaagtcaatgacactttatcacagaggattgctggcatgttcatcataataatgatacctctaatatgcattaacagtttccgtccatttctcaaaactattgagaaactattggatatcagataccaactgaaatgtggccaacttgatattatgacataccagtcatttagagctcttattccctgaccagaaaccatgcatgaaggcagagaacaattatagtctcagagttacaatcctagggaagaagagtttgtggggagcacgtggtgattcaaaataaaattgagtaacagaatgaaataaacatcaccgttgggctatttcaaaacctacagagtagttattaagaaggtcaccaatgcatctatgatatctacaagggctgtgcttggtctctaactgctcgtggaacaacccactggtttcttttgctgcctaatgtatgcttatatttatttccctagggaagaaatctgagaattttttttttattatggggactttacaagcaaaagaaaagagcatatttacctattccttcctgccccccacctatgaaagcaaaactgatcttacgcaattgaaatacatgcgcatacagaagcaaaagttacgaattagtatgaccatgtatacatcagattgaccccacttatcttgtgaaaaaataagattacatgctgaagtgatgtggtaataagcaattaaccaatgaatcagggtggaacttatcctcttaataactgaaatgtggttttactgcatttgagagcagtataatttcaaagagttctatgtaagctctgaggcacaaagttctaagtttttgttttaatcatttctgtattttattttccatagacactgattattttatgccatcctttccacagttgcttgaaaatgtagtctagagaatcaaattgatttttaattatgagttcttgattttagccttcagataaactaaattgaaccagaatattcttaaagcataaacaatggattgtctaaattcccagctctcatttcaagtattcgctaatgtggcattgatcaatctacaattcccagactgagcagaagtgataggaatattggataaaaaatgccgtacaggccagaaagataaattgtttgggttgtctttttgcaagtttgaggtcacgattcattcatcttgttactttgctatatccctttagtggcttcaattgcaggattaaatattgaatggtggcagatcattcaatatataggctctcatagtttggcattagagggcttttcatgcttagaatggagctgtgtgcacacagaatgccaaagataatcgtgctgatgatctagtctgtgagattaatccctcaacaatattatcagacaattcttaacacatggatttgtccctgatatgacacttctgaaacaaatggatatactaagcattttaggagtaacattgagcctcctatacagcctggctttttcaggaaattaacccattaggagatttggccagaaaagtccaacactttatcacaaccagtgtttatgaccacaaaattatataagagtcaattttaagaatcaaaatgcttttagggagtactgattaatagaggattaaaaaataaaaattagtttgggtaaaatgtggccctcagggctaaatatgccaaaggaaagtactaaattaatatactgtcttataagtctaattagcccaagaatattcaatgctgagatattatgtttaaaatgttttaattgttgctctccttatgcactttgataggggagatgctgagccctttaaaagagaaatggaaatgttaaaggttgaaaattcattatttagtcaagagacccggagtcttgaaggataaatgcatatgctttttaaaaataaaatgttttatttataaaacataaaaattaaagtttgacaaggacaaagaggtcattcagtttctcctcctgtttgtgcggaattattttatttcacctttggctgaatggtctgaaatgccccagatgttaatttttcgctctgctctgaaattgctaaaatccagaagttcttcaaggtaaaatcatcttggggtgtttagaggaagagaagaacttgcctaaaattgttttgtcttagaactacctaattcactgtccccaaattgttatttttaataattataatgattccattttatactataagcagttgtataaaatagaattgtcattccatttcagttgtcatatttcattttttttctcaaccgaagcatatttgaattttcctcactttttacaaaagaatttcagctttgagactcaggggtacctgtgcaggtttgttacctgggtgcattgtgtgatgctgttttcttactttctcataagtcagttattctgttgccttcatcgcctgcattcatctctggcttccttccaggctgcccctgtctttctggatgaggctgtctaaatacagttttactatcatgaggaagcctagtatttctagagacagtataaaaaagaatgcaggccttagagtcagccagtcctgatgtcttccacttacagctgtgagactttcatttacttattgaaatcctctgctccttggtttctttctttataaaatggaatgcagctatctacttcacaggttgttgtgattcttaaataaaacaacagtggctggcacaggtaaacaagcaaaaaatagctattattatcattatggtgcacttcttcattgacatgttataaattatttcagattgaggtggaagtcttttactttgatcatttttaaataaaagagattttgtatttgtctatgacttcttttgaatcaagccaggttgggttggattatataaaagaaacaaatcctgaccaggcacggtggttcacacctgtaaactcagcactttgggaggctgaggcgggtggatcgcctgaggtcaggagttcaagaccagcctggccaacatggtgaaaccccgtctctactaaaaatacaaaaattagccaggtgtggtgacaggcatctgtaatcccagctacttgggaggctgaggcaggagaattgcttgtacgcgagagtgggaggttgcagtgagctgaaatcgcaccactgccctccaacctaggtgacagagcgagactctgtctcaaaataaaaaaataaatatatagaataaaataaaataaatctcccactcaatataccaatgaaaagccgtaagtttaataataaaagaatcttggaatcacatgtataatcaaatacaattgcttccatcatcatgttatgaattaggaacagaagagttaactgtgtaaaaaagggaaaaatctataaggatctggacagggagactctgactcagtaagagaaggaaagtgtgagcagagtagggagacaagtaagaagtagtttttaacataaaaaaaaaaatcaaattagctgggtgtggtggcgggtgcctgtaatcccagctacttgggaggctgaggcaggagaatcacttgaaactgggaggtggagggtgcagtgagccgagatcgcaccactgcactgcagcctggtgacagagcgagactccatctaaaaaaaaaaaaaaaaaaaaaaaaaaaaaaatcaaacaagaggtaatgggagagagcagaaaaaggcaatgaatggagagtctaggaggagacagcataattgagcactcactgtatgccagaggccacaggacacatttgtattaagactgtgatgtgccttttatctccactttatggatgagttatcccaggctgagaaaggttagaatcacacttaccggggctactaccgtaacaagcaatggagctggtattaaaacacaggcattcctcacaatatcatgcgctaaaccagtggttctcaaccttcggtgagcacggaatcacctggagggcggctaaaacaaattgctgggcccccttcccccaagtttctgattcggtggctctgggctatgacttgcgaagttgctgatgttgatgctgctggtctggggaccatactatgaggaccactgctccaaatgactgcgctctacttctgtgccgtggtcaataacgatcaagtggcacccctaggttagacgcagtggtgatttcattaggttcttacatgtggcccctccatgtggcaggctttagttctctgtttcggataagtctggcatttaatattagagaagtactttgagtcctggaggaagcagtagcctggacagcccatcaaaatagaaattcaaataaggggactccagttataaggaccctttgtctcaggagcagggcagaagctcatttactacaaagtgaaacaccagattggatcgctcgcgtggaggggacttgatgctggatcctttacgtgttaaactgaagcacattaagtttcttcttactaagggtgagattggctccagatcctggacaggcattaggctgtgagtcctatgcctctagctatgaggagaaccagaatgtaaggacaaggggacacacacacacatgcaccccacacctccactggggttactgtagttactgaacaattaccacaactttttctctatatattcctttatttcagaggtgctgttatatagattccacacagtgtttgttgactgactgcccagtatatattagctgacttaactgtgaatcgctgtgagaggggcatcaaagaaaagtgaaaagtgtctctatgtctttctaacttagtatgctgggttcctaggaatgagtcgcatgcagataggagttgaataaaatctcatctacatacttgattggcagtgacttgaaacaggggtgttacaggcatggaacgtggaggaaaggcagatgccacattttcagtttttattttgctgatagccaattggccaaccagatatagttgtgacaaaagctaagtgtctctctttagggtaaaaggaagtcattacaatagcaccagaaaacatttggtaaggtctttttgaacttggcagcaccttgggttctacgcgaataagtcagaagacctgaactgtgatttgggagttaaaaaatggataattgccaactccttagttcaattcaattcagtgcagttcagttgagttcactcagtaaaatccagcaagtgtctgttgattgcctacttatgtttacactatgcacagtcccgaactcggtcttgtgatggataagtctgggctctgtcgggcgactgaggtaccctgtacacttcaggaggaacgtttcagctttcagatgcattgactaataagcttataaatcattacatacaatccgtagagctaagtggtacctaaaggaattagcagacctcaaatgcccggttcacaccttggctaaactatgagttataaaggtaaatatttttggtaaaatattttggtataggaatgagtgcagacactgttttagaatacttaagtggtacttttttttttcatctttaaaatatcctagactttgtttcttcatagagagaacctcctaactgaattctaaacgtgttaactgtttcctttcagtgaaagctgctgagcagaagctgctagcagtggctacctttgaattcccattatgctgtgacagccagtagtacactgcttaactgggacaatttgtttatgggtacatatttctgcgtgtgaaaattagctatgagttttcttggcattagtgattagtaatatttcaactacctgatcagaagaaacattctaaattctatttgctcctatagacaaagacaaaacaagttttcctctgcaatctctgtgttatgccatggcccatttgagctgtacaacgcactgcttgttcagtttttgttacaaccttcatggaagatgaaaaacataccccaaactgctatgcaataagatcattgctcgcctgccagtttgcagttttatatacagcatgttattgttgtggaatgaagtttatggagagtgagtctctggtagtctgtcacttcacctgactacagtaaaagggtctccaggtaggctgtttgtaactattgtaaatattcctagctttgcagagtcttggtggtgaaatttatgaattaactggcactccttctttgctattttaaaaattgaagtttagtttcaaaggccattacctgttttacttgtgtgtcttggggaaagaggagacagctcttaagatattgaaaatattttcttttattttctgtctccatttttttgttatacttcagagaccttatgtaatgtttaatgtttccatttactgtatgcattttcagctttagtatttgtcatcttgttccaatttaatgaaagcttatttggctatggttttcattggaaagcagaacacacgtacaattttcagcaataatatatatttttccttttctttggatttgaacagccttctaaaattttctctactgaaattctggcagagttatttcttcaacatttggctgagggtttggaatgttttaaacatttgaagtgcctgggatcaattactgtaacctaaaatggataacctttaagacacaaagctcatgtttttcttaatcatctcattacatgacatttttctgtttgtatatcaataaaacactgtatgttggctaaataggctcatttcatttatttccaagtactgttgatattgtaaagctagcatattacatttaacattaaagttatttttaagatataacatctttgtggatgagaaaaataaaatccagaagatggataaacttgaaacaatttagcagtctaacaaagtataataaatagcaaaatcatggatttgaaatgaatctttaaaaaattcacaatgcaagcatatttttaaagctctgtttttctaattaagggagctccaagagctttcttatttattctcactagtgttatttcgttactgaaaagttttttttccactataaaatcactgcttcctctgagagatgcttacttagaagggattatgtaggaatatcctgttatttctatttatcaggttaaccgtggattcatgttatactatgggggtagaaagcaaggcaaggcattgccagcttcaagatttgacttttgataaatataaatgtggagcaaccccgtgctgctggtgcgtagtggatgtgatccatgacgggcagatggctgtagcgatggagagaaatattatagccagaacattcctgcttctgctccactggactcagaatacattaacagggtcctctctcagcttggagtttttttcccgatgatggattagtgataaactcatatgcaggttattccggagttcctctgaaaccttagcttttcatgaatgaaaaggtcctttatacattttctacatcctttaatttttttcccatggaactagattgctttgtacaaatttatatctctgttatcttctttgaaataatagagagcagttgtccagttttaatgccttaattatttgtttggtggtttggagaaactttactgttccttaatgaaatacattacatttagtaaagagagaacttaaaagttgaaattattctttaaaatacaagctaagattctcatgaagccagaagtctccttgctcatttcgtcctaaatgacttttgatataaggccaaactttgtgccagatgtgtggtattttacaataattacatggcacaaacctccagtcatttccactgagaccattcaacatctgttttatcaaaatggctttcagttttttttcaggtccacagatgagtaagaatattaagtgagacactgagtcacttactttattatttcatagtgtgaatttctcttgtatttatctgttttaaattgccacagacctaaagatttcttttaatgactggtcataacagagtttgtttctctgatattttgaggtaaaaattttaaagacattcatttaacatttacactttctattccctttattctgttacacattgtagttccaaatgctgatgaaaacttaataaggaattggtcaggaagtagatgagaagggatggtgcgatccgttattaccatttccactttgagacccctttagcttttgaccagcctacttcactgtaagtcttcttatctgtgctaaacagaatttacaagtatcgactaacaaagacaaatagtcagaggtcataagtggaagggatggcagacccacgtggcagcgtgaaacggttcttactcacctgtgggtgctcccaaagctgcatgaagggccatttgctaatttccctgggctcaggtgaggggatatctctttctgaattcaatacctgctcacgtcactcactttattggaatacccaaatgcacaggtcgtttattttgctattcttaaatattttattcaaaactatacgcggaaagacctttatgttaattatttctatctagatgggcaaaatattatgtttgggaaagtgtgaattccctcagtgacttttgtacagtcgctccacatgcctcaaaatcttgtatactaactggctgctgttacagtaaaaacaaggtcagtgcagctcttcaaaacactgtgctttcccactgacgtttgtacagtagtcagttttctgggccaacgtagacgtagccagccataaaaataaacatgggcacattcatggcccaaaataaatcaaagtggacataatgaaaattttccagtaagcttaaaagaaaatttaatatacttctcttctttttttaggagggtcaagcagttggttcggttttcattggaatttttatgtgggtaaagcttcctgtttgctgcgcttgcctaggattttcttatcccacaactacaatgtgaacaaagagatgagagagaaattatgctaatgcattttggtggatcaaatgagtgtttcatgagacaactcaaatttttgttagctatatggtgttggaatataatttcaaagacaactaagccctaaaataggagatttatttaaaacataacttttccttgaatgaaaggatgtttttgttctttctctgacaaatatgatttgagaataaaaggaaatatataaccatgatggaaatgtatttttgtcccaaagctgatttgtctcagatatttttggtcacagttcaattatttcaaaattatttttaggtttttagattcttgctttggtcacatagcaattttgttccaaagatacgaaaccatgtaatccgaccatttccgaagctgggctcttcaatatttctatctttcagacacagtttggcaaatacggcagctcagtcaagtgaaatgtgctgtaagtcctagggttgattggtcaagaataagatttctccagtaagacatttttacaaaggcacgatgactatactttcatagttcaaacaaacagagcataaggaattattctgaaatataatgatggtacagctgtaacaataaaaaggtctgtaataaataaaagattgtgcatctgttttagaagacctctgactgctataccttgtaacttgccacaggcctgatgcactatatcttaactctaagtacaaatgcaagaatagtgtatatcctacattatgttatgtctcaaagaattttagacagatagggacacactatctgatggtgaagagacggaatcgaagctgaaacatcagactgaattatgtttaagtattatctattcttctgcaaagaaaattagcttttatctgtttttctagaagtagtgatgtgtctctgctaaaagaagcacattcttaccaccgtggaacaattggatgcctttatgaaaccgatgtagtttaatagcaggttcttttgggtgaaaattgttttctagttattttattttattttggggatggggtcaccaggctgtggtgcagtggcatgatcatggctcactgcagccccaacctcctgggctcagatcctccagcctcagccttctaagtagctgggaccacaggcgtgtgccaccacacccagctaatttttaaaaatttctttgtagagaccaggtctccctatgttgcccaggctgatcttgaattcctcgtctcaagaaatcctcctgccttggcttcccgaagtgctgagattacaggcaagaaccactgcaccaagctgtgaaatttgttttcttaattggtaataagaacttgggcttattatcatcgtgctttagaatttgctaattccttttttcaatcactgtcagtacagtctgactccttttaattcctgacatttttgttccccttctcatccagtaaaataagaataaccacagcctttactttctccagtgcagtagggtgtcaggaggactattaaatataaagttcttaacagtttttcagtgtaacctaaatgtgaaaaatctatgaatggttaacagaaagtattcaatctaaatcctccccaaggtcagaaatattattttggaatatgaaaaactacacctacaaaatgaagtaattcatcactttaaaaaacaaatttggagtttttaatagaagccaaactaactcagacatctaagccatcaataaagcttgccagaatttgaagagaatatcacgatgtaactctttttatggatcaagtacaaatgaagttgacagtgtatgcctaatcagagtgcggagaactggaagccgccgacagtatttccgctttctcatgttgacacattgtgtgtgcaggcagcagagccaggctgattaaaaatgtcaagactttgctaatgtgaagcacatgctttcaaaatctgaatttgagttcacgaggccccaatctgcagcgtgtaaataaagtacatttattcattaatgcattcacttatgttgtgttcaagcaggacaactcttaggaaaccacgtccacgttagcttactattgattagaatatacagctcctcatcaaaggagcttgagaactggaaccacacagctgtgagctgaggacaaggccaaggtggaggtgaacaatcattgcattctccttgaatgctctccatcatcgccggtcacagcgctgactctctcccttggaaggcaattgtcttcataaacagtagagagcatcgggaaggtggctgagaatggctgctgaggaactttattgtattgcgggactccttgcactagcttcttacctggcttttttggttaagtgtatgagaaatcaaacccagtacccagaacctgagaaaggtattaggcgtcattactcactactcccagccaaaaggcttcatggacttccatttccctagaacgtccagctggcctcccatgagggaaaatgagctcccagccgccgtcctggaacattccctcacctccccgctacaatctatcgcttctcctgaatgcctccttttgtactcacagtagatgttgcgtaattttggtgagagaaagaacccaaaccaagggctaacgtgatccttacctctctcgtcacttttcctttgtatactgatgagagcgtacctaaggttgtgcattgagcgggaatagattggatgcatgttgagtgtatggaactatgctagacactaaaggagatgacaaatggatagtacccatcatctgtatccttaggggacttgccatataccaaagaaagaattaacaaagaatttgaagtggcacttatccatccgtttatttaacaaacgttcagtgagtacttgtgctgtgtcaagctaggtcctaggtactggggatatcacagtgagtagaagacttggtccctgctcttcctctgtaattgtggattcccaggagagcagtgcaggcaatttatgttgtaggagcatgagagagttgcgctaggcattgaagaaagtgaaatactgatgagtatgttaggatttggaaagaatgaagggaaggcatatttgcttcaggcatggcataaactcagggacagaaggcaggcaagaaagctggagggtatggaggaataaaggagcaccacaagcaggcttgggtcgggagggagcctctgggtttgcaaagatgagccatcactggagatgctggtgtgcgacagtggcataagaagcagtaggttggcatgaataatctggcactattgtgcaggacgaactggactcacactgggcatggtggttcacgcctgtaatcccaccactttgggaggctgaggtgggtggatcacctgcagtcaggagttcaagaccagcctggccaaaatgatgaaaccctgtctctaccaaaaatccaaaactagctgcatgtggtggtgggtgcctgtagtcccagctacttgggaggccgaggcaggagaattgcttgaacctgggagtcagaggttgcagtgagccaagattgcgccactgcactccagcctgggccacagagcgagactccatcaaaaaaaataaaaataaaaataaataaaaaataaggcttttgcagaagcctgggcatgcattaacaggagctatatttgtgacaatagagattagaaaaaagggacagaaggtaaagtatttcaaaagaagaattagtcagcattggtaactaattgtaaatgttaaaaaacaaaaagcaaaaagatgtcttccagatcacatggggaacaatgatggaacacctgccagaaataaggggcttaggagagagggctggccgcctggagaatttagaggacaagtttggctttgtgcttgtcaagttactgtttacagtggatgtctttctgtggtctgtggccctgaaaaagacatttcctccccccagttttaactttcagttaactaattattctctaactccttcacgtgtatctgctttctttcatatctcgctatctataaagtttataatcagctacagatctttgtacatagcagaacattctacagaacgttttgatttttacctccatttccacgaacaaaaataggctgaaatgtctttgattaattatggtttcagacgtttcatgtcctgttcataagaagcagattcgccatctttagatttttaggttagaggagggcaacgaaacgaacttcaatgtaaggcgggaaactaaagaatgctaaccttacgtccagaatgctgtttgctctcattccctatgaaccgattagaattataaagaggtgatttggggaacttttttatccatggttcgactgtaaaataaacaggctgatctgtgatgtgtggccagtggaaatcagttttattacttgttactcatcccgtggagatctcagttcagttctggtggacagagttcgaacgtaaaaacccacctcttcacataaaataaaatcaatgctatgagaaggaataaacttttggttatcattttggaaaaccaattttttacttctaggttgcatcttacccttttgggttgaattttaataagacgtatattcatttaaagtggaatagcgattctcagggtcagctgcttcatttcacagcaactaaatgtatcaaagtatgtcaaaataacatattatagggaagtgtgacccttgaaacctctataaagaaatggctagtagtaagtagttcagatcttttaaataatgtcattctaacaagaaagaaaatgtcacattgtttgtaactttttataacactgtaacctaaatgacactggtgttaggacctgagaccttaagcatttgctgagtgaatgaatgaatgaatgaatgaatgaattttgttacatattgaccttcaataaaaagaaagacttggggcccgaacatattaaagctataaagaatgactctgaattttaaaagttgctgtaatgaaattgacatttgttcaagatatattgcatcatttaaaaaagacatcccaatgaatcattagccaaagacctgcttttccataatatctttgcttctttatgctatcctcaggaattcactcttcattaccaaatcttccttctatttttgtcaaaaagtatattaagtgttaaaatggcaataccaatgcattgaaaatacctttcaaaattgatttgcacataattatatatgcacttaccttgagattttatgtttattccaaactcctgcccaatgttataaacctgaactacagagttcaaatgcacctgtcatttctttctttagtcctgacttactcttactacaagccatccagaagtaaaatcacaaactcttcatgggaaaaaggcacataggaccataatctaacaccccagtgtgcagtaagagatatgatattgaccagggagttttcctttttaggttctgttattagtaaatcattgcaagaatagacataaatatcaacttagttgtatttaaactttttcttccaaattccataaaaaagacaccaatttatcaaccattcctcccagaggccctttcatccatattccttagtcgacagttcttctgtgacaataaaatgtgaataaaatgcaggcagaaatatgtatcatgttctgggcagttagggggtaaggctttgaaagctcattaactggaacggttggttgtgtttccctagagaaaaccttcggaccaactgcaaacatttatcttctgggaacaaaatgggccccatccctgaagaggagaaaaggccagcattcttgacatgagagcatggtaaaggtgggattgcaaggaattagagacaaggctgctagctatggttggttaacatcacctaacactttggctcttgttaaaaaaagaaaaaaatcaaatttaactagcctgattgcagagtttaaaataaagagtcatcctttatagtatacttttcttattaacattcagtggattccgtgtagatgaaatagtattcatccattcgttcaagaagcattcttcctcaaggaggcaggtctctgagccagtgttatttgcgatgcacactcaaaaaatgaatcacatgggatgccccttggggcctttggcagcctccttcccgttaaattatcagtgtgagcattaattcaagatgtgaaacctcaggcatggctgtatcaaggcaacaaagcagcgaagaggcagattacagataacgaggaccagtcaggggttcagacaaacatggcaagcagagtttcagataactaaaaattgctccatccatgctgtggcactctgacaaatgaggtaaacatcgcaaatgagaggaagaacaaggcaagagctagtggctgtggctcctggagacatccactttcagcatcgtagaggtctttctagagatcctttctgtccaggtgaaggccatgcatgcatcaggacatttttggtcttatctcccaaccagaaagctctctcttacctgttggagaacctggcatcccactggggtcatctctcagaagatacgcagggtcctagaaaaatgagaaatgcaatacttctgttataacacaacttctattagaaaatgtagttccttttccagtttgacttacaaggagcatatttcctttcatcccagcagccaaaacagaggcctcctggtctcattttaactgtaatagccccaggagctttggctgcggtattttcccctgtcgggcccagatccaggattgggctagatattccacaacacaaataactgcatcctttccatgtgtacattggtgcaggctctcattaatcacttctggttcttcagcagtcgatgatgaggactctgcctcagccgtctactgacatgggtgatttgtcaaatagatattagctagaggagggcttgttaattttatgtatgtaaatatattctgaggacaatgccataatgagaatattatgatctgcaattaatagacattttctttagttattgacatgtcctcaaaaacatctatatgattatcatattcctttttataattttcttctctttttcttttttcttttttttttttattagacaggatctcactctgtcatgtggctggagtgcagtagtgtgatcatggctcactgcagcctcgtctttctgggctcaggtgatcctcctatctcagcctccagagtagctgagactggctgcagagtagccatcatgcctggctaattttttgtatttctggtagagaaggggtttcaccgtgttgctcaggctggtcttgaactcctggactcaagctgtctgcctgccttgggctcccaaagtgctggggttacaggcatgggccactgcactcagcccctgctttttataattttcagtgtgcagggatcacgttcttctattttaaatccctgctatgtctaatacagaacactagaagctatgaatgctgggaaaatgttggtaatgaagatgacaatagtggtaatgtggttaagtgtataatcactaattaggcaacactgtaattttctggttctgaaaatggcgcagcacattcaggaagactttttgcctagaggcttgtgtggtcctgagtgcacacatacatgcctggacgcatggcccacgcagagcagggcagcagaggcttggcagccaggagtctccttgccctctgtctcccgaggctcacagtatttctctttgcagggcctcgctaaggagtagctctcggctggcaagctgccacacagatttttataaaaaggcattttcctcatataaaataatttggggctttccagttacaccacattgctgtaattaataggagtcactttttacgtagaagatctattagcatcagtgccacatgaaaattaagaagagatgagaggccaacagcagagcaagacaaagatgagaaatcgtcttaaccacgaggaccacagatgaagagcacacgagcaaaaatggaaaaaaaaatcagagttttcctaggttatggaatatttggatatgagcctcacctttagttttgacatatcatattgaattacaagtgagagctggaaaaaaatgtgtattcactctattggaactaaaatatattttgaatattttctccttttcttccttaagatgtacatttcctcctacctgtacattaatgttcatgaaacgagcatatatcatcatttttaattatttgactcatatttcctcccttgtcattgcttcagtgtgctcaaaagcaggtgtaaaggaggaaattaaaatagagcattcacctgctgtgagtccctatcggctgtaatggttggatacgtggacttatccctaagtcccactccagtggtcaagagccattaaccaaagcctgtccctcacagcttccttcactctcgagcccggtgatgccctgtcagtcaccaggtggacaccattgtgattacacagaaagtaatttcttgatagtaactaacaagataacaatttttagcatactttgttgctttaaaggtatttcatggagagtttttgactacaagtgtttactttcctgtatgcagtcaaagtccagctgattgttgcattaaatgccctcactatccctcctgggatcaaatgagagaggacccaagaggttcttagaaacaggactttacaaagaggaggttctgagtatggcattgattctcaaaacttcagtttgcaaaagaaacagctaaaatgcagttaaaaatgcaaactcctggctcccaccctcagatattcacatatgggtaagtctggagggggcccaagaatatgcattttaaatgagtgtttcagatgatgctaatgcaagtgctctgggaaccctggtgtaactaacacaggaggggaggggcgtggaacttttccttctcctaaattcactctgcaagaggagatattttccgtactatgcgttattttgacaggttgccattgaggtgaggaagatagtgaatacttcctgtaaagagggcattatcatgtgagttcatactttcattcatacaccttttgcttcttccttggttctaagtaccagtcacatagataaaatataaaaagggacaaattttaaaacattaatcaaaagcaacttaagtgtgtccatggctaggaataaaccaggaactgaagctgaagtgagggtctactggactctgggtagagaaacagaagcaggtagagtttgcttcctacaggatgatgagggctaacagtacctgatccaacgcctggacccaagtcagcccctgtgtttgaaatcagcagctgggtcgtgactgaaaagtccagagaggaagttgggataaaaagcctgtaagctcctccctagaaagctgggtatctggggttggctggctggagcaaaggcagcctcccagccaagacttgagtgcagatacttccagacttggagactggatgtgtaatacacccaggttcatgacagaacgagagcttcaaggtgccaatacaagatctggttctgggattggggtgcaaggggttaggtgaatgaaggcaaccaaaataccaccaaacagcaagaggtaaatgaagagagacagagtcagggaatatataaaatactattcaaaatgtatatgcaaattaaaattaaatttataaataaaattaatgctgtgaaatcagtgtttggaagatgagttcactgcatatgaaatgaaaatgatgagttttaaaaaagtatgtttgatattctcagagtaataagggaagtaataacatccataaaagaataagaaattatgggctggacacagtggctcacgcctgtaatcccagcactttgggaggccgaggtgggcagatcatgaggtcaggagatcgagactatcctggccaatacagtgaaaccccgtctctactaaaaatacaaaaaattagccgggtgggttagcactcacctgtagtcgcagctactcgggaagcttaggcaggagaatcgcttgaacctgggaggtggaggttgcagtgagccgagatcacaccactgcactccagcctgggtgacagagtgagactctgtctcaaaaaaaaaaaaaagaataagaaattatgaaaacaaatgaaacaaatacagaatatataataaagtactactgaaaattctgaaaaatgattcttgaaatgaaaaacaatagataaaataaactctaggttcaacataattggaaaaaattatgttgacctgacaagtagtgttaaggaattccaccttatacaccttatatataagaaaatgaaaagattgaaaaaatgagagcaaataagaaacatgaaggatgaaatgatagtctacaaagtataatatgaacatcagaaggagccagttacacagaggagaagcagcattcaaggaaataatggttaaggatttttcagaactgatggataggcaggaaaaaaaaagacacttttggtaagaaaatataaaacattagggattcagagaaaaatattacagtaacctgagagaaaagacattatctattatctacaggctgggcacgctggctcatatctgtaatcccagcactttaggaggctgaagcaggtggatcacataacgtcaggagtctgagaacagcctggccaacatggcgaaaccctgtctctactaaaaatacaaaaattagctggacgtggtgtgtgggcctgtattcccagctactcaggtggctgaggcacgataattgcttgagcctgggaagcggaggttgcagtgagtcaagatcatgccactgcactccagcctgggcaacagagtgagactctgtctcaaaaaaaaaaaccacattatctacaaaagaacaactcccaaaccgaagtgttctcatgagcactgatggcaaacagaagattttccccaaatgcttttgacatagagagtaaataagtgccaacctagatttctattcccagctaaactaccacttcaggtataaaattcaagctcctaatggaaaggagtaaaatatcttttatttaataaacagtgcaaggggtgcagatccaagacagttcctatcttagaagacctttcaacctagtgagaacacagtcttgtaaacactaattataacaaatatcttaaatcacatagataatactgtcaatgagaatgtaatttactctgttaccacaaaagtgtactattgttggaatatgttagtatagtgagacaatcatagtagttataacaccatagttgaagatcttgtttattaccttttacacacagagatcatacaatatatttcttccaaatttagtttctagaaaaaattattcttgcaaataaattaatttcttcctttagacagtggcaactatataaaagtaacattttcatttttgctgtagttgctaggaaactcctagtcaaattttatgcctaattgtggtgagtggacttttttgaaatcataccagaccaaaccaggatttattttgctaacagtcatgttctctgctctctgtggatctgtcaaaatttatccctcattgtgtatgttgttaaattttgcaaagtactttaaatctatttggaaggggatactgtgattcatttcttttaaaagaagaactctaagtgaaatctatcattttaataatgagtatagaaaaaatactatgcttcacagaaaaattagtttttaataatttaatttcatgatgtgtgtgcacgaggaaaccgagctttatttttaaatgcatgcaattacatttccaaaaattaccatagcagtttgggtttgaagcaatggattgaagtaaatctttaaaataggaattctgattctaaacttgcatagaaatgtagttcactttaaaatatgtataatattgaactaatctaaggagatgtgtgaaataaatccttataaagtatctcaaagatctattgtgggactatttaaaagctttgctgtttaaataatatatgaaatattcaaaaatctctcacagacacatgcacgtgcacacacatacacacacacaaagataaatgtagataccaaattcacatagagaaaaaaggtacaaagtagatatcagctttacatttaattttgaatcttctatgactgtgacacagtaaaacaattttcagctcttcagttgatttcacttgtgctacttcgctagttttcaaccttcgttattgtgttgtctaaactggtgggtaaattttccaccttgaacactaataggtgacacactgttaatcagcataccatttcgaaatatcttaatgcccattaagtctatttttttccagaagcctatagatttcagatggcctttaacaggagggagaagaaagggcagcttttccttgcttctttagctgtgctttctgaccacagcggttttcaagcctcatggcacatttgaatgcttggttgtgtcatcattctggcactgttatctttgattccaaaagagaatgtagcatttcaaatgtcggaaatgtgctatagattttttggcagtaggaaggaagtcagtttgactttcatgtcttaaagaaatatgtaatgttatgaccaaaattagtactctctgaaattattttgctctgaaattggaaagaggtaatatacatctattaggttgtatacaaaccctttgactggcagccaggtttgaacatttctttttactagaaaccagctcttacatattcatttattcctttggcatgataagagagggagactgggaaggaaaaaaattgcattaaaaattttaaactaatgtaaagtaagctttattagcttagaggcatcatttccctctgttttcatatatgacagtgggtaaacaatcaagtgccagtattctaagtgtgctaaattgccaatatgtcaagaaacagaagagtttaaaatacatcaagatgaaataaattattgcttattgaactttaagaaaattatttcagagtgaaacttgacatgtaatttagctgcagttttttcaattgtgacctgttacgtttctgctttgtttacaccatatagagtgcagttatactgagctacttggagtcgtttaaagcagtttcttggcatgtatatcatcatcctgagacaccttataataaattcaatccccctgcctccccagcatgccatatgttaaattaattaaaaataaaacttttaaccatacttgtaaaagtactaagaaattgtctccactagaaagcacctggagcctatgttttagaatccctatggttagttgctataatatttgtgaaaatttgaataatatgggaaatgggtagtcttaattcacacaccaagatagaagttgctttattctcattgatgtctccatccgcatatccataatatgtttttattttcaacagctgcttaatgtgttattcaagttgagttgaggtatggttaagcttagtgatataaaaccttctgagacatctaggaatgtgatatttctgaccagctgcaaaaatggtaacctcttagaaacaaatgagcataataaaacaaaaagtaggcagtgagtgtattaatcttttttcttccttgtgtttttcctctcatattgctttcttaaaaaaaaaaagaaacctttaatagagctctaacctttaaaagttctttgagtcaagcaatttttcatgatcaagctgtctcatgattgtttttatttcagtttaacatttcttttgattcactacatttttttaaggtatttatgagattttactccagagttcaactgaggttaataactcgtgatttaaataaagtcattgaatatctgcatgtgaccaagtcagtaccactcttggggtcacaattggcttcccaaagtaactataacaaaattattctagatagaatttattgtaaaataatgagtctgtttatacagttatgcaaaacatgctctttcctgttaataataggaaaatatttcattgcttaagaaacaccaaacctgcaacagagtgctttagaaaacaaaccatcggagaggcacacgttgtctgcatcactgcctgcctcacactgggttttgatgttttgtcattcagcatgttgttgatacgaatgacaaaacattgaaatctaaggtggtcaatttacattttctttgttgttgttgtttttttctgagaccgagtctccctctgtcgcccaggctggagtgcggtggtgcgatctcggctcactgcaagctccgcctcccgggttcacgccattctcctgcctcagcctcccgagtagctgggattacaggcgcctgccaccacgcccagctaatttttttttgtatttttagtagagatggggtttcaccgtgtcagccaggatggtctcgatctcctgacctcgtgatccgctcgtctcggcctcccatagtgctgggattacaggcgtgagccaccgagcccggcctccattttcaatacagtatgcagatggaaaacaataatagcaattacattttggaccttgtttctcagtgatctttcatatgtaacattttaatatttattagtttctcactaattaaatataaacatataataccattgtagcaaaaagttatctaacccttttactattgtgaatggtatatccttgtatgacatgctttttctttattttttacttgcattctttttttgtagtttgctaacatcaacttttaggataatgatagaaaaaaattcataaaatacattgattatttaaaaataatgccaggaaggacttagtatctaataaacggctaaaagtcactttgagggggaaaaaattgtcagactggcatcctcaagggtcaagaagcaaagatgaaaataggtattaggacaacaaaagatactttttattcctaaatgatagttacattgttatagtatttaagtgaagagtgaaaatccacctctaggacgaaagctgaagataaagccaggaagagcccatcattttgctattttctttgtttttaacatagctctttgaagatgtagatgattgataacatgtttcatgatttacctaaatgtttgatatctgtacatctctccaaaatgaagatttacatttcaaaagttgaatttatgtctgaagatttatgtgtacgtggttttttaatatccctaattttgaaaaaaattctataatttggccctaaattatactaaaactgaatcatggtatcattacttccaaaacatttatctgtgcaggtgctaacataaaaatgaaagcatactttaagatttgccttggaaacagatgtttttgaaaatactggtgaaaaaaaagcaggccaaaaaagtagggaaacatttcaattcgaatatattgcaggttgagattgttgtagagagtggagtggctagagagagctaagcagtttctttgaggtgcagtttcacttttattttcaaaaagcaagtcagtataacaagtcaaggaagatagaaaacagctgaaaagaacggattctccagtaagcatcgtttatttaaccacggaattcgtaatgtcctttgcttatttagaaaaagtttctggaatttgccagggggtcacagacacagaagtgatcaaacctgcatgattgttggggggtggggtagtgataagaattttacaacctgtttccagcactgggggccctcaggggcaagaggaactgagaaaggatggaaattagatatagtgtttttgtttttgtttgtgtttttgagacgggcctcaccctgttacccagcctggagtgtggtggcactatcacagctcaaggcagcctcgacctccccgtgctcatgtgatcctcccacctcagcctcccacgcagctggggctataggcacccaccacaacaccaagctaattttttgtgtgttttgtagagacagtgtttcgccatgttgcccaggctggtcttgaacccctgggctcaagcaatctgcctgcctcagcctcccgaagtgctgggattacagctgtgtgccaccgtgccaggccaggtcacaggtcttaagagtgggatatgacttgctggggccaaggacagtgccatacctctcaacagacctcagatctgcggcacgttccgtccttagggttatgagtggatacgacaggaaggttataaacagaagatgataaaaatggttttggaaaattagttttcaatgctgacaattcggccttacaaagacattctatatatgaaattatttaagatctttattgttaatagtaattatcatagcaagtaaatacttcctgaacacatgatgcagactctgtactaaatgtgttacccatgatcttattgaacttttatataaactctgtaaaagaaatactgttatttctgacacttctcaaaagaagacatttatgcagccaacagacacatgaaaaaatgctcatcatcactggccatcagagaaatgcaaatcaaaatcacaatgagataccatctcacaccagttcgaatggcaatcattaaaaagtcaggaaacaacaggtgctggagaggatgtggagaaataggaacgcttttacactgttggtgggagtgtaaactagttcaaccattgtggaagtcagtgtggcgattcctcaaggatctagaactagaaatgccatttgacccagccatcccattactgggcatatacccaaaggactataaatcatgctgctataaagacacatgcacacatatgtttattggagcactattcacaatagcaaagacttggaaccaacccaaatgtctatcaatgatagactggattaagaaaatatggcacatatacaccatggaatactatgtagccatgaaaaagaatgagttcttgtcctttgtaaggacatggatgaagctggaaaccatcattctgagcaaactatcgcaaggacagaaaaccaaacaccgcatgttctcactcataggtgggaactgaacaatgagaacacttggacacggggtgaggaacatcacacaccggggcctgtcgtggggtgggggagggggaaggatagcattaggagatatacgtaatgtaaatgacgagttaacaggtgcagcacaccaacatggcacatgtatacatatgtaacaaacatgcatgttgtccacatgtaccctagaacttaaagtataataataataataataaaaagaaatactgttatttccctatttttcagggtgaggacattgaggttaacaaatatattcagttctatctagtaagctatagaaatagaatttgagtaagtctgcctgattgttataattgtgccctatctgtcaagcagcctcctgttttgaaggaatttctaattctcatggatatacatttggtgtttggagaggtagatattcgagttataagacagatgaaaatttgacttaatttaacacatttgtggccatgaaatgaattaatactggacagcggttgatgcagtttcagctactgtcactctgattactgtatgagcgactccagtcatccatagacaataattcattcataactttctctctcagtcaccacacacacacgaactacactggtgaagatttatttttgccgcatacggacataatttgagaggcatggcctccacgactcttctgtgaaatgacaagttttgtcaggaagtttctaggcctttatcagactaaaaatagaacatggctacaatttttccactgtaatacttactcagataaatcagttgaaagagattattaggctcagggccactaagggaaaactttagttcaactctggctgctgtgggggcagaatcctgtggatatgattgtacactcttagcattgacatgaggattgatgaatggatatacaccaaactataggtatgtcaaggtaggggctgttataaaaacatgctgggttagtcataatggcaaaccaataaatcaacagttggaaattctgttttttatttgacgcactcagaagacatatctccatgtggaaagatgaggagttttcttatgtccttatcattaattattccattttggaagccacatgcttattctatacattatcctgatagctaagaattgatatcagtgcaaagaaaaaaaaagtcaaatgccaaagaagtaaatccagttattccagagattgagatggtttcatcactgaacagcttgcagatagccttcagaaagtaatttctgaaatgtatgcaatgtcatcagagatgtgacattttaaaaataaaattgcactgatagactaatcaaaatccacatttctctgagccattgtatctgtcttcattgtcctcaccccctcttcatcttcatcttcaccctcgtcatcaccctttattatctcaccttcttctcattgccaaccacactgagaaaagtagatagagaggacactatctccaaagtaagtgagggcttagagagattaaggatcatccaacgtcactcaagtaagctaatggccaagagagcaataaccacagccctgacaatatatatactctttcctctagatcaacgtttctccccttatttcatgctttaggtatgactttgaaagatgaaataaatgagttgtatagtcttaattcccctttgttgctcagaaatatcctctgagcatttcccaaagaatccagaagagaagacttacttctgttagtaaatgtttagcctctggtcataactatcttcctgttttgtgcaagaagagcaagcaagaaagcaaaatgtgacagggagaatcaaagaaaactcagatttctgctctcacatttatatggatcagatctatttttatatgtattaaggttcttttaaaataaaagaaaataaaatgaaaagagctgtgaaaaaaagaaaaacaatctaaatgctgtctaatcaataaggaatattcaattcttgatttgcaacttagtccataccaactagccaaagtcctcccaaccatgacctcaggggctgaaatggccctttagatctaccaggttcttgctggagctcatcattcgggatgaccattggctgaaggtcaagtcccggggccagctttgcaacttggcttttacattaggcagtttccgtgcgaaatgaatcccactgtggttagaaaaaaaactgttttgagataaattctgaaatatttctggtaaaagacctctcatctccaagctcagtcttcctttttttctgtgttaaaactatttgtaatgtaaatgtgttcctgtgtcttgaaacatctctgaagccacgcaaattcgtatcatccaataaaggtgcttatttatcaacggatagctacacatttttttcactgtttttttttaaaagagtgtagactgtagtgttagaagttctaaagccaagcaagcagtgggctgtagtgctttgaaaacggcatcatgaaatgaagttgcatctttagaaagcaaacacattagctcggtggtgacatggaaggcgtaaccgcgttgttttgacctgttgtcacattgacattccttcttctgttgttggctttgagtaacctcgcaaccaagtccctgctgccttaaaaattaattatgataaggatttcttttcagttcagactgttcaagaatgcctcacgtgcaggctgcaaattatgaagtgtaaattagggcatcactgagcagggaaggtcccaagaaaccaatttaagaattctctccggctttactggggacctggaaatagtcccttctgaaggaagaacttgaaattagaatcgacttgtcattcaatttcactgcatattgggatcaacctttgggaaagaatgtactaaatatatctggacaaaaattttaaaaacttttttttactgcttattgtacagttttcacagctttacttaaaaataatcactaccagttttcagacacccttgtaagcatgccacatgtatattaactcacttttagcaattgtatgaaataggttttattattgttgcccccttcttccagatgaggcaactgaggcatggaaagtctaagttgcggagctcacggagctcgtaggtagcaggttggtctccatccagaggccttgttcctaaccttgaaatgacactgcctcaacaactggactccgtttctgaactcttctttcttccatttacaaaacggatggtagatagatggtttttaagctgtgatccataaaattaatttgttttctaccttccaaaatttgtcaacatctcttttctgctgtcgtggcctttcctgttcggttttgttcttgtgtgtgtacgtgtgtgtatgaattttttaaaatttctttactatcattttcttttcggaggtctgctcaggttgtgtaaagtattttgaaataggactttaggaagagaggtgctggagaagaaaaagaaaatattagtcactccttcacgtctttaaaattcttttttccagatcaccttatgtttgtacaagttaaagttgaatctcaaatgcctctgaatatagtataaaagttttcacagctgtggtcaatatggttgcattattctttccggctctttggtgatgtcctgtattaaggatgtagtgttctgaaaaattgtgctcactcctgagactttaaaaatggagtcaacaaagcccaatgacttttagtcaacaaagaaactaaaagttagaaatgagcactagatgagagaacaatgccactgtaaaatactcttttttaaaaaaatacacgcaaagcttcatatgttaataccccaagctccaagatggccaatttatttttgaaacaagaaacacctgtttattatcaaccataacaataatatgtttaattttgagagaatctttttggcagttgttaataagccatactgtaagatttaaaatagttttaatatattctaatggacttcttataaggcatgagaaaatatatttagatgttttctttgctttcacgtaagttcagcattaaacatatgccttccgttaactttagtcattatttcaccagattgtacttaatgaaaaaaagaaatttaacagttgtgtcactttatcttaccgtgttctgtaactcaagggaaaaactaagacaggattaacagtgacccacaagtacagtatatttttgaaaaagcagttttcacttgtaatgagtataaactaaaacacatgggaagaaaagaatccctataggtaaaaacctaagaatggtcattcaattctacttcacttagttgactggactaattttttctgtattttctttggttgcagtatctacaattaaatttaaaaagctaactaaaatttaaaacacatacacattaaaattagcaattcaactaggagctctttttgaaaaagtgaaaaagcaaaaatataaatgtaatgtttgttataaatttgagcattaaagtaccttaataaatctttaatggcaatttgcattttgatctttcccagatttgagtctttcagttaaagtcactctttctagcatttaccccttagaaagcaaatattgaaggaaattatcttcactgttgattttgattttttacacttttttttttcatttttgactattactatcatctctaggttgggcctatttttttaaaaaaaatgtacatgaccaaaaatatttaatgtaagaatgtttcaagcacatgtttaatatgaggactttgcatcaaccttgccaccatttaaagaaataatgcatggacaaaatcatacaatctgcctaaaacgaactaaattggcctctttttaagttaattccacggaaaagtaagtgtgtttgctagcggcaagatagggtatcaccatctttgtccctcttagttagccacagattattttatgattgttttaaagcaattgaggttaaaagaaattaaaagggagaaagagtagtaatgtagagaaaaatgctgtttttttgaactaattaaattttttgctggcattatgaaatcttaaaattatatttaacctcactagataagccccaattgagtatagaactattacgtaaaaactgacagttctctttgtgatgacatggtgtaatgtagaacaagaaagattttttgagatgtctcctcaaaattgaatacttgcacatcgatccttattttcagattgtatgagaatgtttatttttgcatttgtgactggtattaatgaggaaaatagtccaaggaaaaaactatatgattcattaactctttacttttcactccatcctagctgctgtgctgtttaaaaatggcttcagaagataagcaacagttttaaataatttgggtgattatgttggactccattatagtctctggagcaatatgttcattatttttatttctccaaaaaaagtcaaacaacaacccaaattgttctggttgcttaagacaatgactggaagcatttgtatttcctatatatcctaaatgctgagatctggtctaactcatattaacctcctctgtaaggatcacaaatcttcagataatctcctgtatcttagtaatttattttctgtcaaacatataaaacaaatcatgttaaaacattccattaaaaagggaggggcttggaggaaatttttccgttgtagtatgtgctgccttttctggagttcctgatgaaacacagatgtttcaaaagtgcccacaaggatggttagccatgatcagattgatccctggttactctctgaaacattgtgcttccattctttgtatcaaaatatattgccctctttcgcagaatgaattcaagtgaattttcaaccaaaacttcaattaaaaacactcaaagtgggctgggcatgatggctcccgcctgtaatcccagcgctttcggaggccgaggcaggcggatcacgaggtcaggagatcaagaccagcctgaccaacatggtgaaaccctgtctctactaaaaacacaaaaactagccagacgtcgtggcacacacctgtaatcccagctactcaggggactgaggcaggagaatcacttgaacccgggaagtggaggttgcagtgagctgtgatcgcaccattgcactccagcctaagagacagagcgagagtccatgtcaaaaaaaaaaaaaaaaaaaaaaacactcgaagtagaaattggaggtattagaatttttataatggcttataatgcatttcttcccaaaacgttctaaacataacttgtttgggagtaaatgtctcttttgactttaagcagggccaatatttacatgtgaaccataagttcagctcttgtggatactgtgcaatattctacagtgacaaagaaatcagtttacttgagaaagtaattggttgcgtgggtagctccttccaaaggcccatattggagaagaaccactgagaatgtagtattctatctagtttggaatctttgactttgaaaaactaatgaagaaagtatatgctatactagaaaaattctaaaatcaaagaaacaacctaaagaccattaagatagcttctaaagacaatgacggaggactgccattccatccttgatacttatgcagatctctttgcataaatataaagaaaaatgtgagtgaatgacttttcaaatcatcttgattttcttttcaaatgaccccaattagcaccatacttttattagaagttaaaatcaaattgggactaatctagtcattaatataaaatagttgcatgtatttcagaatatttaaactgtatcacaatatttattgcaatgtctttatatttttagggcccagatcatttcctttagctaatactgtataaaaacctcttattattccattatccagcctgataaggatttttaaatttgatgtgattctgaacctacagttaatactttgacgagtataatttaaatcataactaattgttgaatttatagaataaattcccagtctttccagacagaaattatagtacccctgtgttcattatctgttgaaaaatattgaatttctaaacatgtttccaaaatatttgcctttcagttttgcatacttgtatttctaattttcttccatgctgaggcatctgttcatgatttctagcttattttcaaaatctttttgtgttaatgttttggatttggtattcagattctttatgtgctgagggacttctggagacctactcacaataatgactttttggattcataaatttaactccagtataaacattattacttttttttcacttgggaaaatattcaactttttacttctactcattaaaccaaatctgtgttgttacttttgtttgttttgtctttacactttggacgttaggatatattaatggctgagatcacatttgcagtctctctgaaaattgatttttaaaatacaattctgattccagaatacagagggaaaactttacacgaccaaaagggagcttttgtttgttttagggagggatagtcatattttgagagaaacttatcctttcgaagagcaaggaagctggattccccaggatggaactacttggctctcttttctgcaacagaattgttgcattaaggtaaaagtcaggctgcggttatatgcattttctgttaatttactgaaaaatgctctccttccatttatattctttgtaaactgcaagtctaagagataatatatgttcccatctttatctatggctatagaaaatgacatagataaataccactttgtgctaaaaataagcctatagtaatacagaggtcagtcttgagtcatgcggtacacaaaacagactggattttgagtcatggcatctacacaaaatgcaatactgctgaatttttatattaagaggctttggctgaaggaattcagacacatacacagtatggacccagaaatcttgccaagaaaagttgagttgaaaatgtaggggaactgatccaagaataggccttaaacatgttgcatccattactcgcagctgtgtacatgagaagtgactttttatcccacctcccaaaaccctatccagcactgtcacttttttttttttttgccaacttgctgacctttctgttcccacaaaaggaaaatgtgattatttaaaacatttctgcaacaaaaaatgcatctaatgtatttgctataaatacaacacatttttaaagagaaatttcttataagttcagttttgtgagtaaatagtaattaatcaaaggtgtggagaaaaccaacctggattcagagagctaatggatactgcattaggtgcttttggaaagtaaagatttagaggaactccggttacttaagtgataaggaattattataaaggtacttggcaaagaaagaaaaagccagaaatccatttcagtagacctggaagaaatgaatgtcaatcaagacatgtcaacaattgttcactcaaggaagtgagagagcataaagagatgccataggtacctcactgtagccacctgtctagttcccatgtgctttgcttctcctgcttacgccaccactgctgactgatgttcccattttatctccacgttcactttcccaaagataggatctgatcaatttgatgagtctttatctagtatagagccagatcattttatggatgccaatagttggagttctttggtcagctattgattccgtcagtcaattggcatccaagttacaggagtgatgccatgaagccaagcagaaaatccaaaaaagtggcctttggaaggccttgcttgacttgtgcagcccctatatcttaaccataaatgtatatattagaataataaaaaatatttcgtaaaatataaggtgcattttaaaaataccttattttgttaaaatttcctagcacagtattttaatttctccaagaaataatataaaaaaattaaaagaggaataatttgtatcattgctattttttctgtctctgatggtaactaattcttactgagggtattgtgttgatataattgcttctctgttccagtaagcataatggatttatcctgttttatgtgtgtataaatatgtgtgacatacagggggaaaggtccagtatttcccagtgttaggaaatatctttgtttgtctattgacctaactgatcctaaggtagcttcatccaaagactcccaccatttccattatttttgtgggtgatatgtatttgatgattttagaactgttgataatcacaaacaggagacttacctttttgtctcccacactcaaaaagtgtgatttgccaattcacacacaactaaattgtgacagaaataatgacattattgaattagagaagaatttaggaaccccagaggtaatatcataggactgttaaacattatttggtattattggatataaaaactaactttaatttttatttgtatccatcaaaactgcttaatttttataacttttaaggcagtgtttatttctgctatatttgattgtgaagtttatttgcctacacatataaattgcataagcaatttcttctaaatgtgttgtagatgtttataatacaaatagaaatacttaagtacttattattacttatatcacagctatatttaaaattctttagatccaatattagttttttactaatttattgcctaaaatgactaattgaatttgacatttccattaatgccaaggagtaaaactgttttgccataacaacttaaatgaaattcaaatgattagttttgaagtttggaaaatttctaaatctttattaccatggaatccagtggtcatctaacagctgcagttgtattaaccatggtaattcaaaattgccacaaatttggttcaggtaccaacatttatttactcagtgcttacacatagtaccataagagattgaacgatgaataaaataggaacactgcctttgagatcttactagttcagcactgtaatagctatgttcctaaagtatctcatttaatacaacttaaaacaatccaatgacatgcgtatattactcctattttacagacatatttgaggctcaaaaaagttagttttctgaaaattacacatccagaaagtgtaagaggcagaatttgaactgaagcctgtctgactcctgcgtctgtggtctttagttttcaccattcttcaatgcagtattatcactgagtgacatgacgcagctgtgtttgtggtcgggaggataacataaggcagcaggtggaaaaaacatttgattcatttgcatttgctagtttatcattgtagagaaaaatgttattaggccacttcttctgcaaagaggcaaggtatatttgaggagcagattgtagcacacttaaaaagaacgactgtaggccgggcgcagtggctcacgcctgtaatcccagcactttaggaggccgaggcaggcggatcacgaggtcaggacatcaagaccatcctggctaacacggtgaaacactgtctctagtaaaaatacacaaaattagctgggcgtggtggcaggcacttgttgtcccagctactcgggaggctgaggcaggagaatcacttaaacccgggaaggggaggttgcagtgagccaagattgtgccactgcactccagcctgagcagcagagcaagactccatctcaaacgagaaaaaagagaaagattgtagagtgggttgaagaaaggcagtagattaagattaaaaagaaagtccagtgcctgaaggcacgctgctcatgtgtgtcctcctaaggatattaggtttggctttgtcgatcacaaagcagagatctgagcaggtttgtgtttttgaaagataactttgggctgggcgtggtggctcacgcctgtaatcccagcactgcaggagccgaggcgggcggatcacctgaggtcaggtgtttgagaccagtttgggcaacatggtgaaaccctgtctctactaaaaatacaaaaattaactgggcatggtggtgggcacctgtaatcccagctactcgggaggctaagataggagaatcacttgaacccaggaggtggagattgcagtgagccgagattgtgccattgcactccagcctgggtgacacagcaagactccatctctaaataaataaataaataaataaataaacaaacaaacaaacaaacaaataaataactgactttggtagcatggaaagggggtactgatgaggtgagaaaaggggagacaatgaatatttaggatgctattacaaagaaccaggtataaggtgataagggtctaggtctggatggtgctttcatgaatagaaaaggagggatgaggccgggcgtgggggctcatcctgtaatcccagcactttgggagaccgagacaggcggattatgaggtcaagagttcgagaccatcctggccaacatggtgaaaccccatctctactaaaaatacaaaaattagctgggcgtggtggcacatgcctgtagtcccagctactcaggaggctgaggcagaagaatagcttgaacccgggaggtggagcttgcagtgtgccgagatcgcgccactgcactccagctggcaacaaagcgagactccctctcaatacaaagaaaagaaaagaaaaggatgggtgagattcaagacctaactaaggaacaacagaagcatcaggatttgataatggattttacgtaggacttggaggaaagacaattgaaatttctaccttggttaactagatggagagctatgtgaactgagacactagggacacggggaatgcctgcaggggtcagggtggcaggtggcatttgactttggatgtgtcgcattagaattacttatgagtagccacagtaagcactggacatcatggtgtaatacaatcagaaatgaagagccagggccgggcatagtggtttacacctgtaatcccagcactttggaaggccaaggcaggcagatcacctgaggtcaggagtttgagaccagtctgggcaacatggtgaaaccccatctctactaaaaatagaaaaattacagagggtggtggcgggtgcctgtaatcccagttactcaggaggctgtggcagtagaatcgcttgaacctgggaggtggaggttgcagtgggccgagatccgagatcgcgctactgcactccagcctgggcaacagagaaagtctcaaaaaaaaaaaaaagaaagaaagaaaagaaaagaaaaaaagtaagagccaggggaatacaagagagaaagagattaatgttgattaattggtccaagaaggctttgagaagaagacgacatgaaatgccaaagaatagataaaatttctacgtgtaaaagttgagtaaaaaggcatttaaggtaggctaggaattcacaatgtgttttatgttcactattttgttggacatcaacctaaatttgcacccattttgatatatttttgttataattttctctgacatgcagaagtctttacattggattgtagtcaggttaaatgcttttgtatatgttaaatgctttgcatgatatacaacgttattccaccaacattaaaccaatcatgcttaacaatgtaaattatttttaggacaatatgtacaatgtaataactgctgtgataattatgttttcttcatacagtgaatatatacaaaagccaagtgatgaccaaccttgaggggacaggaaagatttcaggacagaagaggagacatctaagttaaggcatgaaggacaaataggtgttagccaaggaaggatgctcttccagacacagaggagaaatgtcctggccaaagtggtagaaaccacggctgaagccaaaactgcaaggagaggcgaggccacaaaggatcttacaggccctactaaggagcttggatgttatcccaatggcactggggggtcatttacagttttcaaatttttcatcagggaatggatttgggtgtgtgtgtgtgtgttttagtagagatggtttcactatgttggccaggctggtctttaactcctgacctcaggtgatctgcctgccttggcatcccaaagtgctgggattacaggcttgagccactgtgcctggccaggaagtgaataggatcctatttttaaacaggtgtttctgaatgcagtgtgaagaatgtgttggaggaaaacacaaatagaggaaggtatgatactgcattcaagtgaaagataatgattgcattagcagaggtagtgattgtggtgatggaaaatattttgaatctaaccagagggcctgtggatagatttcgcatggtgagtgggggaagacagtgccaataagagaagatgttggagaatggcatctagatattttcctgagcagttaagtggatagagaggtttcattcatggacgcagggaatgcaggatgagatacgagtttgtggaagaggactatttcagctttacaataggtgcttgtgggacatcctacagaagacattaaacaattggatatgagcctggctgaaaaccgaagtcatggaatagcataatttgtgaggtaaaccttggaagatggcagtgattatgaaagtcagagacaaagaaagaaggagacagaagaaagggaggacgagaggaagggcagctaagcaaaggaagtgacgtgatgtacagagggcagaaaaagggtaggggcatgactgagaaaaatcacttcgtcaagtgcaagataaaactcgagtggtctcctgaaataataggctgaggaatgggagttactctcaagtcagtagcattcaatgaggatttgaacatgggaggagcatttgcaaatatgtcattaggaagatttaactagaatatgggttggagtgtgaatacagaggccatgtaatagattattgagatatctaggatagttataatgagatttttgaaggagagtcattttgatggctgggtggcgtgatggctcatgcctgtaatcccagctctttgggagaccaaagtggaggatgacttgaggccaggagtttgagatcagccagtgcaacatagtgggaacccacctctacaaaacattttaaaaattaggctagcatggtggcatgcttgtagtccctgctgctcgggagactgaggcagaaggatcctttgaatttaggagtttgaggtcgcagtgagctaggattgcaccattgcaatctagcctgggtgacagaacaagaggctgcctccattaaaaaaaaaaaaggtagagtagtttcagaagaagtaaaaagaaaacatggatggaacagatcattgtgaaaatagaagtgctacaattacttctcattgaacatggtgaggaccgggaaaggaggtgactgagaatggtgataaccttgagaaaaaaaggcaaaatcagaagcaggacctgtttttggaaatatgtaacttgctctgcatgtagaactttatagttgtacttcatagaattaaaattaaataatagtatagctggctgggtgccatggctcacacctataatcccagtactttgggaggccaagatgggtggatcacctgaggtcaggagttcgagaaaagcctggccaacatggtgaaacaccgtatctactaacaatgcaaaaattagccgagcgtgatggtgggcacctgtagtctcagctactcgggagtctgaggcaggagaatcacttgaacccaggaggcagaagttgcagtgagccaagatcgcaccactgcactccagcctgggagacaaaaaaaaaaaaaccgtatattggtatactttatttttaaggttgcttttttctgcttgagcttatcaaattgcaccccagagattattatcagggtatatttttcttttaccacacactacaagagaaaaaagacttagaaatccattcacaaggaatctccaattagaggaccggtaatctttgccaagggtgatgattggtcatcttggctaggctggacctctacggagaagctgaaagacagccacacagctcagcctggggtctgagcatatcacttcagcagtgatcaacagaacaatgagtacaggaaaggcatggagcatttccacgggaattgccaggacacaagttgttcttttgctggcatctttgaagtctataaaaatataattctggaaatatcccaagaagaatctgatgcaaagtcaaacacatcgagaatgctagatgccatttccatttaagtaactgtccgttctgggggtgaggagaagtgtttgtcatagtctttgctggtggtctctccggttccacggttttatggaagttacggttttgttcagtagagtcaattctccctgccagaccactacagagagctattttccttcaactgtattgcttcagacagtctacaaatatggtgtttattacatgacttcttctatcttaagtgtttatactgcaggtgaattttttttcttctgtgacttgacttgtgagttggttgttattgttttcctttttcagcaagtctttatgccaggaaaaagcgttttgattcccaacaagccaacaagaaaaaagacgggggatcctagcctatagacccaagtgttaagatgctttttaagagaggggcaattggaagctgcttgtaatatggagattagatattctgtctccagcatgggaacagggctggcatcggtgaacaggcaactgcttgcctgcctgcctgccttccttgggccagataaaggcccagaaggagcagctgccagccgggaggaatgtgagaaaataggaaattgatttgaaatagaatagggaaaaaggcacaagaattaatttaagaattttcaaagattccctttttaggcatatgtagttcctgcctctgcagaggaaggtgatctttagctattttctcatgagattaaaaaggcatcaaactcacagttagtacatacataaggaagacctgaagttggtttatttctccataattggaagaaaattgaatatagatttatattttactctttggaaagtcttgttgatccttcagaaaaaaaaaagaaatggcatattataaatattctaactctaggcacaggaaaaatagtgctttttttttctttttactagatacagtgatattaattaaatttcacattaaccagagggggctggacagctttctgtttgactgtgaaggtcgtagggactctcattttctattgacagcagttcctttgctttaacagatgcctttaggcatatcataatgtctctctccacttctttgcttaagggagtatggggagtcatgttaacaatatttaggatcactaataagtaagggagatgtttcccttatccaaacggaccgagttccgagtgcgtaaccctgtgaataggatatcctgggagaacatcatggaaggggcaggattcacaacgactgcagctttgtctgtcttcggggtcatactcaccagctgccctgtgagaaggcaggggattgagcagtaagcttcgagttccttttaggttgcagcatttggtggtgctgcataatctcttctgttaggaaactggtgatgcgctctaacgtgtgtgacacatacaaagagcctcctatttgtggaacgccttatttcaagttgttgataagacaccgaatcattggaaaagagagatcttgcaaagtatgtacaccttcggtaggaagaataaaagcacatgatatggctgtggttagatccttgccaccaccaatttaataaacatatgataatataggtcacacacaccttgttacctctcttgacttctaaaaaatgcaccagtgcaattcttggccaggcatggtggctcacacctgtaatcccagcactttgggaggccaaggcgggcagatcatctgaggtcaggagttcgagaccagcctggccaacatggtgaaaccccatctctactaaaaatacaaaaattagccaggcgtggtggtgggcacctgttatcccagctactagggagtactagggaggctgaggcaggagaattgcttgaacccaggaggcggaggttacagtgagccaagactgtgccattgcactccagcctgggcagcaagaacgaaactccgcctccaaaaaaaaaaaaaaatgcaccagtgctattctcatgaaggaaagaacttctcaacttctcacctcttaaatgcattgaaatgtgcctactatcttaacacaccaaatgttaccatatggggtagaataaagacaaaaatagctgttctctaaatcgtatatgcattaagaagttaacatttggaaatagctgagtgagcttctttaattcattcttcaaaataaacaaaccaaagcttgatctgtaattttatagtggatagataggcaacaaactcaggagggtagaaagggaaaaaccttaagaaaatgaatgaattttaaaatacagctactgaggccagccatcgttgctcactcctgtaatcccagcactttgggaggcagaggtgggagaatcccttgagcctaggagttcaagatcagcctgggcaacatggcaaaaccttgtctctacaaaaaatacaaaaaaaatagctgatggctggctgggtgcggtggctcatgcctgtaatcccaacactttgggaggccaagtgggcagatcactcgaggtcaagagttagagaccagcctggccaacatggtgaaactccatctccactaaaaacataaaaaagttagccagacgtggtggtaggcgcttgtaatcccaactattctggaggctgaggcaggagaatcacttgaacccaggaggcagaggttgcagtgaggtgagatcgcaccaccgcacttcagcctggatgacagagcgagactccgtctaaaaaaaaaaaaaaatatctgggcgggcacctgtagtcccagctactccagaggctgagatgggaggattgcttgagcccaggaagcagtggttgcagtgagccgagatagcaccacagcactccagcctgagcaacagagcgagatcctgtctcaaataaataaataaataaataaagcaacagaaaactattatcctaagacattaaagaaactggaggaacctcctggatggccatttaaaggttgcaagtgatctgagagatttctttttagagggaaaaaatgagacccagataacttaagagttaccaaggttacacagctggtcagaagaataatatcctgaacccaggtttcctgatttctagagaatttatagagaagtagagaaattcttgaagggtgagctgtgatgtttctttgctcctttagtgtgcaaactatttaagctattttgtttcttttaaattattttattttgcagtgagttcatttttatcatcaactgcagtgaccattatttaagtagtctaaagcttaaagatatctgcttgtctgagtttcagccatgcattttcctggcgctggttatgaaactacatgtttttattaaagttggtagaaatcatcatcacgcaatagagtaagcttttttatggcatagatgcccagaaataatttaaggcctttctcactaatcataaattgctgttaatcagaaactgacttgttttttttccagttagaaaattcctcattctagccatccttatgaaaccctgccagaaattccttgaaggtaaatttgcccaacaaccactgtagaatacaaccaaaaaagatgcagttattcaacatacacttgtacctaactttgagaacatttttacttatgctggctgcttatatcatctgtactgaggctatcttagactctgtagttaaggtgacatagtgatatattgatctaatgagtaatattatgaaattaattctaaaatactctaacttcttctgccttaatttttaaaattcatttgaatgatcacattgtacaaagcttttgttgaaaatcttgcaaaggcctttggccaaaaataacatagttctacatatttttacagtggtttctatttcagtcaaatggccaccaaggatgataggctctgaaacatctggatggtccagtgtcaaaatctacacgtggacacttgcctttgtggtcaggatcttcagtttgccatggcctcaggagttacatttaacttgctcagcatcgattaatagatgcccttattttgcctttcaatgactccagatcttttgcaagactcaattccctctgtacagatacatctgtgaagtttgttatcactctgaagctgaaagtccccaggactagacagtaattgagttttccttacctgacagcctctgactctacctgtttttcactctcccttctctcctctttttagagaactctcttctcctatattacttactgtgtatgtttctatgatttcccttaagctgctgaagttgcccctagcaagaccctaagcacattggctttttataaaccaagacagaccctaggtagaaatttgcctaaaagaatttgtatattttttcctacagggtattttaaataatggaaatacggttttctactttagttttaatctagggatgtcctgtgacgattaaacaaggcatttcatgtgaaagaacctaaggtgtttcaggcacataataggcattcaataaatgtgagaggaattcaaatctagaaggtttgaagaaaaaatctggtgtgtaaactagctgtctctatttccccaccatccacttggttttcaatacccattacctctgacattcaccccattattctactagaattattctcctttagatcgaaaattgcttcttcctgccaatttcaagaccttttcttcaatcattagaagtattaatctgtaacatgtatctttgttaaccatcacccacaccattccctgtcccaattcttgaaatctctacttggggcttcttcgtcgttttacactgcagattctctccaacttcccagacggtgccttctgtctccccattgggtgaacttcctctctctggcccctctatgtaagcatccaccaagattccagcttggctggttgctgtcttcgtttactcattgcctctgaaatctcatctgctctcgtaagtatcactgttagggaaccaggttagtaaatctacattatagaacgaaacccccttcttccagctgcaaactcctggtgggcaccttttttttttttttttttgacggagtctcgctctgttgcccaggctggagtgcagccgtgcgatctcggctcactgcaacctccgcctctcgggttcaagcgattctctgcctcagcctcccaagtaactgggactacaggcacgcaccaccacgcccagctaatttttttgtatttttagtagagacggggtgtcaccatcttggccaggctggtcttgaactcctgacctcatgatccacccgcctcggcctcccaaagtgctgggattacaggcgtgagccactgcagctggctctgatgggcacctttaaatacagatagccaaagcaatgctcacttcactccatttcgtttctctacgccatttgtcttatcatagagctttctactcttcctgggcctacatgtctagatctacagcctgatgactcaaaggtgatggttctcagctacctccacccccagtcctacagaggaagttcagagaagagcctttaagaagatgaaagagatgaaaaacagacccatgaggaaatggtagtaataatgagtttaacatgacgatgtggattttaagggaagatttgagaataattatcattaagtatatgaaaggtccttattgagaaaatggtgaccagctgctcctcacttctgcggaagaccgtgcggaaggcattgagcataaattgtagctctagaggtttttttttttttcgacttttatttcaggtttggggatacatgtgaaggtttgttacataagtaaacacgtgtcacggggtttgttgtagatattatcccatcacccaggtattaagcccagttcccgatagttaccttttctgcttaagttagagactcttaaaatagaattgccctcagtaaacaatgtaaaacattgtaatgtattacttggaatggctatggcacggaagggcttttttttaaccaaataaattcatctgtgtgtggtgtaatttagactggattatatctgagagcgatctgggagggtatcacaaaattagatcatgtattaagtttatgttcggttttataatcctgtaatttttataaacaaaaaatgtatgtatagatttttctaaaataatgaccttgaactatcaatggtgctaggtgacattaggtcacagcctctgccctcgtgaggtttatgttagcttaggagtatgtgagagagacacagacagacagacagaaagagaaaaagaaaacaataattacagaatagtgtgatgtatacataggaaagaatcattttaatcagcaagcaattttttaaaatctggattcttcatttccattgacccatccattcatccatccatccactcattcccaaaccagcatttattttatttattattattttttgagatggagtctcgctctgttgcccaggctggagtgcagtggtgcaatctccgctcaccacaacctctgcctcccaggttcaagtgatcctcctgcctcagcctccctagtagctgggactacaggcacgtgccaccacgcccagctaatttttgtatttttagtagagatggggtttcactatgttggccaggctggtcttgaactcctgacctgatgatctgcctgcctcgaactcctgaccttgtgatctgcccacctctgactcccaaagtgctgggattataggcgtgagccactgtacctggcccaaaccagcatttatttggtgtctcttttgtgcaagacactatgccaaatgttaagaaatcagcaaagaaatcgtccctatgctcgtatgttcgtggtctggaaggagctacagacaagtagacagggagcagaatatagtacgatgaaggcaggaaaagagtatttacggagctgaatgggaatgcagaagaggggcccataaactattcttggtgaatcaggcaaggctaaatggaagaactgacttctaagccaagttatgagcaagcagaaattggtcagctaaaatgcagaggtatggagcatgtacttcctctatccacaatgatgcataaatatatgtgcatactcataaatcgtgttcacaaagtcagaaaatcctgaaaaacacattctatatgactatatcatgaaaacacctgaaattaataattattatctaaatttatttgtcaataaagatatgttaaactatttgcaaaaatatcttagtacatatggattcttttgaaatggttgatattataaattgtaaagggttaatataaaagtttgtgtgatttctatgttctgtccactgcataaaggatttgatctatgcacggctattgccactatagacaactacccatctgacaacaccactgcactagtcaccaatgaataattcttcctttctaaacaatcaaaacaaagtacttatagtaatacatttaatttcaaagatttttgacattcaaccaaaaatgcttggtctttttgtttgtttgcttgtttttttagagatagagtcttgctttgtcacccaggctggagtgcagtggcacaatcatggctcactgcaacctccacctccgaggctcaagtgatcctcctgcctcagcctccagactaactgggactacaggcatatgccagcacactcgactaatttgtgtgtgtgtgtgtgtgtgtacatatgtgtgtgtgtgtgtgtgtatatacacatatatatacatatatatacatacatacatatatacacacacacacacacacacacacacacacacatatatatatatatgggttcttttctgtagagatgtagtttcgccatgttgctcaggctggtcttgaactcctgggctcaaatgatccatcatctcagccttccaaagtgttagattacaggcatgagccaccgtgtctggcctgagaaccaacacaagtgttttgggaatgggtgaatggaatgatggttggaaacagatggtccagattgaagaatttgctccataattaaaaacaattcaatcatctttatttatcacacttccatttctttatcttggactgccaaagaatacattcaaaatactccccaaaatgtattcatattatcaaagcctaaaagtcaggtgaaccccaataagttgccaagcatagacacatactgccatccctgggtgggcctaggaattagtgtgtctgcagcccctgaatccaatgtgccagggataagcagcactccctctagcttggccactcctgtccttccctagtcatggaggttactgataaaactaggcttccatatacttctctgtgctatagattgtcttctaacattgttggacacctgatggcttgacttgggttgggtcctcagctcttgctacgtactcagttcctggcatccacagccccagctaactcttgctggccatctggatttctcttgaagctctgccctcctgcctctctcctgctctcaccaccaggtaggaatgatgtccctacctcacccccttccctcctacttggatagttgccaggacaggactgaagctcactaagcctttcgtatacagcacattgcttgactgccccctacaaagagtccagacctcatcacacacacccagatcctgcttcctcctcctccctgcctgcccaggctgtagaggacccagtaggctcctgcccaaggtcatctgaattaggacaaaattaaggaccagtgcttttggcaagcagtggacatgattggatatctaaagaaagagccctaagtcttcatcatgtatcagattccacaaagcatttggtttttggggggtgaaataatttaacacctttaaaagtaaagagaactcacctttagaaatgatttcagatgtgggtcatttattattgtgaaataaatatgtctattgtgggtggatttttccatagggtaaatcaaagaaagaatcacctagctattacactagccttttagatttactgtagacatctgtgaaaaattatgaattggcctttattacaagactttgttttcaaacctttatttctgttccaatgtaaatgataatcgaactttactggagaaaagacccatgattttaaatatagttttatgtcagcttatagttttacatcagagtccatatagctgttagaaagttatgtgctactgacaaaataacagttggcaaaacataagacaaaatctacaattttattcacaggatctaactaatgtaccattattattaccaattgatctcagtgtgctataattttggtaacaatttctttgatatgcttttaaaaatatatatatatttacaaataaaggtataatttttaagagtcagtctaaacagactagattctagagggacagacatatattgacctacgacaatccctaattccggtgtttaggaatgtttgttagccatttttttcctctataagattacagctctcagaggatactaatattggcctatttgtttcctgacctcttgaggtaatttgaaaacacaggagaaatcgaggactatccctttttttattttgctccttctcaaatccacaagttatcaatttttaaatggaatattatgtttccaaatctttggtggggcttatcctgataaattttatttaaacggtgaactacactcctaacaaccagctttcttttttgttgcgatggagttttgctcttcctgcccagctgcccaggctggaatgcaatggcgcgatctgggctcactgcaacctgcaacctccacctcccatgttcaagtgattctcctgccctagcctctcgagtagctgggattacagggggatgccaacacacccggctaattttttgtatttttagtggagatggggtttcactatgttggccaggctggtctcgaactcctgacctcaggtgatccacccacctcggcctcccaaagtgctgggattacaggtgtgagccaccgtgcctggccaataaccagctttaactattgagtcaatactgtctaaatatttagagaaatggttaagcggcaggctcctgagtccatcaaacctggaactgtgtttaggcccaagcactctgtaactatgtgggcacatgattaacttctctaagctccagttcttcatctataaaatgggatgatattactcttctcatatgagattagaaaattaaataaaaatggtgtgtatcaaatgccagtcataaaatgaagtgcttagtgttagctttaatcataatcatctatttagtatagctatgagtgtttgattttgattttgtattagcacctctgacaatgtggatttggtacttaataattagcgggaaaggtaataatctcagtgtcggttacaattcgatttttcttcaaggtttttgtcctaaggagagagaggtcagaagcattcttaatatgaagctaagttggtgccagtttgaagtaacagctcatttgtggactttttatttttttttttaaatacaatttgctttgatttggtttggttcatgcatttttaaaaatcttcctcgtggtgttcggtcattagatttttatgcctaaagaactgaattcagttttaagtaaaattcatttaatattccaagtatgattccacgtggttattcattcacaacataaaatagccacataattcaatatatttgatagtgtctgctcatggaactgtggggaattccgcagatcttagacaagaattgcttaagttatagaaggcgatatccataatgctaattatctctgacatcatcgatatggcaaactatagtagaagaaaacagaagttgaacgtgggcctcattacacgtctctgtggaactctttggtggactcctgtatttaaaagacggcagtgatttaatgtatgcatgggggtgtccacaaaactgtgtatcttttcttgggaagatatatgtggaaaccatccttcacttttcaacaatagaaattgtttaaaaccatgtctcttcctctgcctttgccccatgggctgctactgctactgctcagcttcgttcagtgtaaatccttgattattctcaaaggatcccatctttgtctaatttggaaatacataattagttttgtattcagaaaaggtggaactagatatacatgtagaatactccagtacactccaatataaaattttgcctaacctgtatgtaatacttatatctaattagcattttaaatggaaattttaataaatgctatcaatcagtgaccaatttacatagcattcatctggggaaatgagcaggtcagaggatcagtcttcttgagattcatcttgacccaaacaatggtttaagatcttaaaacctttcattcttccattagtgtgcttatctttctgcattcgaacgttctagtccaagtccagatttgctaacttgtggttgtcaaaaatcaaggagtgcatttttgaagcatagacaagcccccaggtcctagcactttttttttttttttaagagacggagtctccctatattgctcaggttggtcttgaactcctgggctcaagcagtctgcctgcctccatctcccaaaatgctgggattagagacatgagacatgccgcccagcctcttggcaaattttaaccgtgtaatgttctgccaatttaattcttcaaagattccaattgaacaacatcatcttcatcctctgccctagttatatggtgtttatttgcagttacttcaggtgaccccccacccccctcagaagacacatgcattgcattgatttgtgaaatgatccttttcaaaacattaagacttaaggaagatatttgcttaagagcttagaagttttgcagtgcccaacaacatacctattgttctattttttgacccaatttactaaagagaaagaatttcaaaaccctgaaataacttcaaaatttatacagtgtcaaaggaatgtctaaattttaaataaccgccttgtgtttaaataatttctatgatatcttcatagtgtcccaattaaagggtgaatatattgatcattaacggaggaatagacaggctggttgtgacgttgtaatagagtgtgtttgtgagtcacgattttagagacccagagttagtgatagaaaaaaaaaaaaactaaggtgtggagactgcttaaaccctgagcggcgttagatatttccatgtatgaggatggatgtcttagacgtaatggaaaatgagaaagaaaagtatctacaaagaggtagaagagctgtattcatattcttgtagcattgggtataaaaagcgacaaaagtcaaggtaaagctagtatgttcaagaagataaggaaattactgttgttgttgaatcatgggaatgaggaaagcattttgtctttactggaggaaagaccgtgggggaagagagaaattctaattgcagtctgctaatcttactgataaatgaaaagagaacactgatccttcctttcttaaagtattaattttttggtttgggtctgtatttagaaggtagttaaaatatggaatgagagctgataaagatatgttgttgatactggtattgtgatgtaaggtgcttcatgttttccttgtttctttataaaaatgagaggtttggagggattggaagaaagcaccggtgaatctaaaaattcacgaacattcagtcattcaattctcagtttaatggaggaagaggctggaggggatggaatgttctggaagaaaaattaaaggaaggacgttggactggaagcaatgcaaaaataatgataatagtggatctggaggggaaaaaacacaattttttataaaaatttaagtgatgcaatgttgaagtatgttttatttaaaagtaaagctagttagaacaccacatgagctattccggatcagggctgtccagccctggtatatcatggagagtggctcgggccacttgcacacatgccttcagcccctggtaccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcctggggcgggctggcggagcgcggctcccggtgaggctccccgcgcggcagggtcgctcgctcgctccggggaccgcggcggtggcggtggcggtggtggcggcggcggcggcggcggctccgctcttctcccttgtggtgtcggaatgggaggaggctcggcgcgggtttgaatcggtgcggaggcaacattcgcatctgagatgaggtggctttttaacccctgagggaccacatttaaggatttcgaagagatggaggctgaactttctcgatgactcttcgtcacccggagtggtgcaggtagccgcggggagaatggagtcttttgttcccggtatttttaattagatggattttttttttatgagtagtgtactgtcctaatccgtgaggcaaagctgcccttttgcctgcattcggtgacttttacgaattcgttgggagctagtcttagcagtagtgattttggataatttatgtctgaaatgtgcaaaaatcggcattgagcttaaattaataagccctttggttccattaactaaaatccatcatactaattgcttaatgggggaaaaggtacaaaataagcttgctcattaaagagcagtcttttgcctgcgaaatacgtagtgtgatttttgtcaggtttaatagagcagtctctcagagaaattcaactttgcagttgtgcttcgatgcaggctactcctgtgcaaagatagttggagatggtttggaaaaacttgtgctgtatctgttgaagtaaaaatcatttgccattgatgtgtgtagttcaataaaacaaagatctgtggcagctgtgggaatgagaaagtcacatttcctccctctcctgtgctggcgtctctgtctctctggaatatcttataaatgatatatacagctatatgtgcctgtgtcacaaagtcattctgtcttctgaaagcctaatataatcaaattcagtgccttaagatggtgtagttgaagatttgatccccttccactaaagtggaaatactttcagtaattgaaagcagattcacgtctggagttgtacaagccaaggttttcatttttaaaataaaccttttgttctctggttttaaatgtttcagagagccatccaaagacctctgtgtgctaattgttaaagtagtacttaagaaaggattgcaaatacccagagaaggcatttaagaaatcagctaacttaactaagcctccctctcagccgaatattttagtgcagcatgtactggtctgtgccccacattgttttgtttttgttttttttttccagcggactcccaggtattaaaatgcgactgcagcgttcaaaacactctaggcagaggccatctgctataagaggttaaaaaacttgagaaatgttggtgttatcccattttatactgtgatttacacaatgtgatgatgaatttgagatccgctataaagtatgtttaatttaaagaggtggtgattatacattaactgagagactgaaactcacaaaaatatgaatgcaggtggttcacctggttcctttctctcatcttcagagactaagtgttaaaaagctttaaaaaattggctgtgaaagactgaaattagggtacattctagacaaagagggagtcacttgatctcttattagctgtgaagatagagaagaatagtgctgtataagagcgttaccttccttcttcaggacatgatatctaaaatgagttgtttaattatgaggaaaaagttaaaagagttgtacttttaacaatgacagttgacatcaggaaaagatagaaaggcgcattccaaatgtttttaatgactagtttcttaacctgttgtattgatcattaataagatgtgaatggacgtatttccagagtatgacatggcagtttgatttcttagaaactgctcggtagccctgcattttaccttgttttcttgccttctcagtagtttatcattgcagcacattatagtaaatatggccataattcaaatgatattcttgttattatgtaaaagccctcttttataaaaaaatatttaaagtattcagcagatttttaattaccaaataaaatcatactaaattttggctgttgcgtcacgtttcttagatagcagtggcctagtgtggggcataatagaatttaattcttctcgaagatttagaaaaagaaaagcgacttcacatggactcttctactgatgtctgaacactgattttcagtgtaatatccttgtctaaacatttaaactaaagctttttgtggcttctatttactgttagtttttatgttcctacatatttttacttggttaaaggggtgcacaggatcttctggcatctggaataatacattcaatttttcacgggactcctttctttcataacgtaggcaagtggcaaaggaggcactgtctaaatacagtgatcctgataattaatgctgtaaaatagattaaaatgctgtatttcaggtattcattcccttaaaagggccaccagaacagcgttgctaagcacccgtcactactgcaagtaacagaaaatgacccaaattaaagaacctgttctaagctgtattcttgcattttctaaagttcatttcaaaagatttaacaagactcattcaattagtggggaaaaaagatctgttttcagctctgatcagcaattaagagactgggctttggaacatcagttctttatgtttataatttatttcgtttggtaggctttactttaaacaattgtgaataaagatttttaacaagccacctttctagcaatccagatgtaaatgctaaatacaggacaatatatttgttttaaatttttattaaaatgagttattttatagtaactttgcctcatttaaagaaagtttaaatttcacactaatatgatatattaatgctttattatggatttcttactctgtgaaaatctatatgtatacatgcacacatacagacatatgtagtttagattaaaggatggctgtaattattctatcttatcatagatgtgagtgctttagcacctaacacttgagaaataggatgttcttccttaaggatatttgaatgttgtgggaaaatggtaccatgaaggagatagaatggtttggtgaagaaagtaaataaataaattattaggagcagaagttttctttttagattttttttttggcaggggacggggggcgggggggtgtccagtaaactgtacccttctgggttagaccagaacttctaagtagttgtggccaaatggttagatctttcagtggcctggttcttagctaacacaactgcagtcacaaatacaagctgcggaacttcctggcagagagaaaggaatgaaaggataagggctattagaggagtgggagagaggagcaggcgggttcccaaaggttcagattaggatcattagtgaaattttttgctggatcactttgatctagacaaatctaaagcatataaatatggattttaagttatgaatgataagtgctattttggctataatcacgtgaagtgattcatatccagaaacattgactgttttaaagcccaagtaacacacttctttattctaaagagatgttttgcattagaaatttattatgcttagatttatcaatttggtatgacagatagttctagcaatagataatgtgcaataaataaaagttgtataactcttgttggagttttgtctgagatgaaaagttattctaatactcatttttgcataaggccttttgacctgaattgagttctcttgttgggtatttggaataccttgtcttctgatatgtccgagtttggttttccctataaagaataacaatgtgtgtactatagagattatttttatatgtgtatatatatatatatatgcatacatatatagcaggtttgaaaggatggtattttcatatttaagaaaccagttgttttaggattgttgtttatacattgatttttgttacagacccagctcttcagttgaaatcctatgtatttaagttttgaaatgtctactcttaatttttactgttgaaagtaaaaattttactattggcagttgttttgcaggttgaaaaccactacctttttggtctcccagaaacagtttatgccacagatgttatgttggtacgatggtaaattcattttacaagggaggaataataattgaaaagtacacgcaaatatttgtgggcatgtcacatttaaataatagttaaatttgggaaacgacatactatagtatttaaaagaaaaacagagtttctctcttaaatgttatcattcccctcacttaatattaaatagtgtttgacataaatgtcttggtttgtacattgaggaggcagaatatattacaaaatgtaacaaaatgactaatatgggactaacataaaaaacactttagtcttttgtggttatatatattaacttaaaatttgtaaaaaattaaaacgatgtgtggaagtttcagtgagttgttttcatcctggtttgtgcacagtgcctttttttccttaaccttaaactgcagggagagatggggcctgctgtctagagacctgtaaaatgtaatctggatctctttttatgccttttcttttaaataaaacaaaattaccttatataacaagtttaacattgttaaccttttataattatctaaccattatttcattttacctcctgcttcaaagttgtaaccttttataattatttaaccattatttcattttaccttctgcttcaaagttgtacattagcggagtagacacctggctgagctcttaaaagtttatttggctttcaattcctgtgatagtagggggcagtacatctccttaattatctttgttcagggaaatgctgaaaggccagggtagttaaacaaggccatttggatttgtgaggtcgaagtcagatgcaaggaaagtggttaaatgcattatcatcttattgagcccatcatcagtaaagtgaccttgatggaggtggaaaaagccatttggctattttatgacagccacccctgcttgttttatcatttacacatttttacatatggctttatcatattctttcttttcgttttcaaatattatttcctctgattgtagatcgtcagaatgaaggtgaaaattaaaattagtttctttttaatgatagttagagtttctttcataagtgtgtttcatacatcgatttatatggaaataccccttcattaaaaatgaaggtgatcaggttagctaaccattctgtatttgcttttaagggtcttttaatgatgatgattagtctttttgcaaagaagctgcaattctgctacttttcaaactgtttttaagctagtaagaggaaagacttgccaacctcgattttagcagtgggaataatgtttgttttaacaagtgcctaagtatgtttacttgaaagttattcaagttttagtagttctattgctgccgttctggagtcatcacttccattacgaaattaaaacaaagtcataagatttatagtttatatttcttaactttatggccaagattttccttgtgatgtattttatatcaactccaataaaatggcattcttgcttatatgtttgaacaagtattgttcaataagaggaagagttttattaaacgcagtacaagagctaacgtttttggaaactccagttaaagcaattaagtgctgcatacaagatttttgttttcctaggcaaagctgtgaaacattactgattggagtttagcgtatgcttcactttatactgaattctcttttgttacaattaatgggagctgagtatgaatctttttatcatatgaaagaaaaaactggcccattaccaaaatacctaaaataatatttcatactttattggagatatctccttatcatcatgctatgaattatgtaacactaaaatctcagggactcaagatcatcaaaaatagttcgttcaggagagagtcacattttcttgatcagaaaggacttatttgtttaagaatcatttatttaaagaacaaattggatcaaaaggtgtttaaaatgaagtataaactctcattcccccactctgttcccaccatcagggcccaaattcaagctctcttcagttctccttagactaagctttccatttgggttgccctgccttctgcctgtcttttctttaatccagcctccacactgtcgtcacagttgtcattctgagttgtgttttatcagtcccttggtgaccatacctcaccctctactgctcctccactcccaccttcgcaccagtattttcgctggtcggtgctgcctgtgccccttccttgcatctcacagagtttccaagagctgacttgcatggtatttcttttttttttttttttttttttttttgagaccgagtctcactaggctgaccaggctggagtgcagtggcatgatctcgcctcactgcagcctccgcctcccgggttcaagcgattctcctgcctcagcctcccgagtagctgggattacaggcgtgcaccaacacacccagctaattttgtgtattttagtagagacagggtctcaccatgttggccaggctggtctcgaactcctgacctcaggtgatccacccgcctcagcctcccaaagtgctgggatgataggcatgagccaccgcacccggccttgcacagcatttcttgtggctcctcctcctctcgggcttccttagcacctgattcttatttctgtgagcacttaacacattatcctgtagtcatttgtttacatttctgtctcccccactagggggacaggttctttcagaaaaccactttgtctcattcgtccttacataccagcactaagcatgatgctaagaaaatagttattccataagtctcgaatgcttattggatgagtacactaaatataatttaattttgtggtgatggaaggtcattacaaacatcagttattttattgttctgtgtgaaaatataatggcttacataggagctgataaggctgagtatccctgtctaactggcctgtccgtgctgtcagctttcacttcttactactgctctgtcatcaaacaacacaggttattttgttgttgttattgtaatgtatgaatgaaataagaacagaaaggttctgagtaaagactcagagctaatttcattaacttcattagttttggcttctctgaagaccttttggcttaatgcctccatttctttgcattttctgttgggtgagattttggggtagctaagttccgataggtgttaggtgtttaggtgaagcaaaatgttaatttccacaatgaaaagaagttcattgaagcctaacagtaagtttgagtaagaaaaaaatgttaacttacatgtacagttaacttgaaatgtatatacattgataaagatactcatgattataattttttaaaaactggtaaacatcatatctaatgcaactctctttggatgactaaagtagggaagagataatctttaagatgataatttagaacaagaatcagtacaccttccgtgattgtgttaccagaagattaataggtgaggaatgttggaaggactgacaaatgttttgccgtcgagagatttacaggtgaggagtactagaagaagaggaaaagaaactccgtatttctgctctcttgctccatcttcatctaccttaagaacaaaaacagctgggcccggcatggtggctcatgcctgtaatcccagcacattgggaggccgaggcaagtggatcacctcaggtcaggagttcaagaccagcctggccaacatggagaaacctggtctttactaaaaatacgaacaaattagccgggcgtggtgacatgcgcctgtaatcccagctactcggaaggctgaggcaggagaatctcttgcacctgggaggcggaggttgcagtgagccgagattgtgccactgcactccaacctgggtgacagagcaagactctgtctctcaaaaaaaaaaaaaaaagaacaaaaaccccacaatactctaaaaaccaattttactttttcctgagaaaatgaatagaattagagacttttagaactgaagataatcttcaaaattatgtaatccagactggacattttctaagaagagaagccaaggcctaataatagctgacatttattatttactgaaagataagcatctgtgttaaacccattatatatgatttcatctcatcttcagaacaactcatgaaattaaatacttttatgatctctattttaaagatatggaaactaagtcatagaacagttaagttggttgttagtgagaggtttgaacccagacatgcaaatacctaaatcatgtatatctttttttttttttttttgaggatagaccttgtctcgatacctagactggagtgcattggcatgaacacggctcaccacagcctccaactcctaggcacaagtgatcctctcacctcagccttgccaatggttgggaccacaggtgtgtgccaccatgcccagctaattttttaaatattgttttgtagaaaaagggtcccaccatattgcctagactagtttcctagctccttggctcacgcagtcctcctgcctcggcctcctaagtgttggattacaggcgcgagccaccacatccggcctgtctttcttcattactgaattctgcatccagtgcagttgtcaaattaggttttgttttgattttagtcctaaattttgctttacatgtaagttctatttcctattctagaatagaaatatgataccagtctataacttttcataaacgttgtaaccattggatgttacaaacattctcatatttgctcaaggcaaatcatttaatttatcaagtgcttattgaggcaatatatgttttgtattgttctcctgtttttgtttttaattcagattttttaaatgaggtgtgatcatctatggtatagctaatgtccactctctgattaatatctagcaaggattagcatcattgatttgaaaattaatagattatgcttttattgacatttctattccccattgaatggcttgtttatttaattgatggctaatgtttttactattaaaggctattaacacatcagaatggtttttattgaacctggcaaaatgatagattatgtttgtgtttactcctttgtgcctaaggctaattattggtggtctttttatggttttggtcaactaaaaccttccggttaggaagttgagtaaattagcaaacttatctggtggtgtgaccttggaaaagtcgctggacttttctggattgctacctgtaaaaggagggaagtgaaccagatcaatgattttgaacagcgtagcttcttgtagaagttctgtagagtttcttcaattctctgattcagaattcttaaaaaaaaatcaaactaaagtggtaataaaacataatgtgaacaaataaaatagatactaaatgtttacatttgctactgggttagtttatttttccatacatgtcctgctttctttgtgtatgtatttgtactttttgtggtattttggtgaatgcagcttgcctaaggaataagaagtgacagcatcctctgcagagaaatcctaggaaaaaaggagtgtgcttactcaccagcttccagggaaatggttgtgctatggactgcatatgcctgccacttttggtatttggtcgtaatagagattctaaaaatgaagggggttgtccttattatgaatagattgttacttttccaatgttccgttatagtaccattcaccaaacttttttgaaactacttttttgaaattgcgtttatttccaagtcacagataaaaatagttcttgttattataggcattcctcattttgatgaaataccaatttaactagtttgattgcttgccttccttcacaggcttgactaaccagcatttcaaaaaaattagatctattcccgagagagtatttaccacagttaattatattcagaaaaaaataatgctaaaagcctgtgaggccttttcaaaagagaaatttctcagtattatattgagaaatgacttctgaaaaaggcaacaactcctgtgttgaccactttgaaagcaatagtattcatctcggtgaattctggagtttttaagagttgagtgacaatacattatagccctttcacgtgtcatgattaagggctgaaccagaatggtgtctttaatgggtagaacaattaaattttggaattcagaatctaaggctttatacattagttatttttaatgtgcaattgtttgttttaaacaagattcgtggccttttttaaactatgaaggtctgtgaatgtatgataatatgtttgatttctttaaagtatatttaaatttcatgcatattacatttcatacaaaggcaaagctcagtcttcacttctgtgcttccagttaggaataggagattcaaagtacaaagtctttcaaaaattgaaaaaaaaattatttgctttcatgctgagatatcagtataaacacccgatttattcaaatacttatttatctattaatattagtcattaatactgattaatacttgagtttttcaggagttgggcatcagaattgtaaacttaaagtatttgtctcacttcagttgaggcagaatgaatagaattaaatattcaagatttcaaaaatatatttattaaaaaagttgatagtatcttttcagttaaaaataacctccttgtgtattttttgtaaaattcatcgccagcccccatttccaggaatatctcaattagcaataaggggatgtctccttctaaatgcctgtggtgtactttaaattctaacgaggtaccttgttggaaggagaccacttgaaggttttattaacctctgcagtgtgaaagtgaaaacacgctgaaacgagacagctagttctacattctgataaaacaatagatcatcatcatgaccctaggacagaggacgtaaaaattgaataaagaaaggtacatttgaaacaatacattgaattatttatctatgtcttaagctcacatagaatataattctatgtatattagacttatctgtttaagacaatttattttatatgacttagccataatctgataacatgacaatgtcccagagcctgattcacatggtaccagaatatatgtccgtcacaaaaataaacctgcttctatcatgggggaaaacatttggggtggcaagctgaagtacacagtaaatgtactagagttctgtgagtgagaaaatatataccagctatacactagcggttgcctgtgaaaggatggaaagaaacaaaatgaaggagagacaagagaggggtgatagtggtgtttagctgtctctaaattttatttttttaaataaagcaggatatctaatgtaaacaacagtctgtgacattatttcatatgctatttaacacacaacagctacttctcataaatgtaagagcacaaacccatttatatatttcggtgatgttattaactagtattgcactttatttctttttaaaatgatgcttaacccagtaatcactgaattttagttgtacttagtcatgattagtgtaaaaatgtttttctataaaataagaattaatatgtaatatttaactgcagtctattttaggaacttactaatttcttaaggaaaattaattcataaatttaaaaagggaatttacgcagcatttgttgaaaacctactatttgctacctagtaagcgctttatcatcctattcataatcatataattttgagtccatttagactaatttctttccacttacatagtcaatccataatcaacagctactgactctaaaaaccagattttttggatctgtttattataatgcaatcacaatcataatttataatatcttcattcactttcctgccttaaacttttctctttaatccaaaaaagcaaattatcttgcttgggcatcacctgatcttctctctcccctgctcagaaagtcagtgtcatatcaagaagatgcttgagtctgattgaagtacaggtaggcttatggacaagtgacaggagaaggcttttcaggtggagaggcacatgagcaagttttaaaaggtggggtatgaaaagtatattggagaaaatatcaaatgacctacttcgagcatgaagttcacgaaagagaattttggaagataaggttagaaaagtgggttggaaccagaacatggaggaccatgaatttcagatcaaaaggtttaaatgtacctttgagatccctgggaatttagcatagaaaacaatcacacagtagtacggtgtgtttgggggaagatctctctggtagatgctgttagatgaattataaaagcaaggtagtattaatagaagtagagaaacccatttggactcttcctactattactttcaattcatgacttcttcttaaacttattaagaacagtttaccaaagtaaacttcacaaaggcaggggacttctgttcactctggtatcttcagagcctagaacagtgcctggcactggttgatgctcagcgggtacttgttgaattgaatgaatgagacccagaaagaccaagtgactgttttgaattcacacagctaagatagggacagatccaggcctaaaaattgcactcccagtttgctgttttcttgacatgctaggctgtcgtacaggtcattactattagcgtggctttttctttgtcaactcttgtcaactcttaccctaaattcttctgaactcttcttgcaagtgattgcaaactgcctcatatcttacatactcatcacagcctcctctgagctttttttttttttttccaaattgagacagggtctctgtcatccaggctgcagtacagtggtgcaatcatagcttactgtaacctttaacttccaggctgtaatgatcctcctgcctcagcctccagtctggcccacacattgccacacctggccaatttttaaattttcagtaaagactgagtctcgctacgttgcccaaggctggtctcaaactcctgggctcaaacaatcctcccacctcaacctcccaaagtgctgggattacaggcatgagccactgctcccggcctaggatcttaataggttgcttttatctacagacttaatgggttgaattgtttattgttacttttttcagatggtaaatcccaggtcagagactgtcttctgcttgttttatttttcagcagccctcctctctgaacagccgcactcagaacgcctttgagtgcagaagctggttgactgattgcccagcctccaagtctgtcttttagttcaagttcttatggcattacaaatatgtagttaaaactgtttttgtcagattggtaaaggaccacttaaatttacttgatatggccaggtggacggatcacctgaggtcaggagttggcgaccaggctggccaacatggtgaaaccctgactctactaaaaatacaaaaattagctgggtgtggtggtgggcgcctgtgatcccagctacttggaaggctgaggcaggagaatcactagaacctgggaggcagaggttgcagtgagctgagaccgcaccaccgcactccagcctgagtgacagggtgagactccatctcaaaaaaaaaaggaaaaatttacttgataattttgtaatactgatcactctgtataggcagggcattggttccaggactcccctcctcctacaccaaaatccatgtatactaaaggcctgcagtcatcctacacaacccacatctagtcagccctccccgtgtgcaggttctgcatcccataattttgatctgcgtttggttgaaacaatcctcgtgtacatggtcccagctggttcaagcctgtgttgttcaagggtcaaccgtagttgaaacaaatagaaaaatgaaaattttaatttttttaagctctctactgaaagtaatagtcttgtgagcctaaattatttatcattttgcaacttaaaagaaaaaaaaaactcggtgttactctgtttgattctgtgagatcaccttgaaataagataccacgtaatgagaactattgtgtgaaaccactacaaaaactgtgagatggccactgtcatttattgtgtagattttacctagtaagatcattagtcagtgtgttgctttatttcagtaggaaagtgcaatgggtgcaatactttagaccatgtagtatcactttttttttttttcttgagatggaatctcactctgtcgcccaggctggagtgcagtggtgcgatctctgctcactgcaaactccacctcccgagttcaagcgattcgaatcaagtagctgggattacaggcgcctgccactgcgcctggctaatttttttttttttttgagacagagttttgctcttgctgcccaggctggagtgcagtggcgcaatctcggctcaccgcaacctcggcctcctgggttcaagtgattctcctgcctcagccttccgagtagctgggattacaggcatgcgccaccatgcccagctaattttgtatttttagtaaatatggggtttctccatgttggtcaggctggtctcgaactccgacctcaggtgatccacccgcctcggcctcccaaggtgctgagattacaggtgtgagccaccgtgcccagccgtagtatcacttttgtgtgtattttgttataatttctttccctgaaaaaaaactattcattaaatgtaacagaggctcttattaagattaatacaatagtaaggaataaatgctcttaaatagaccaagaaattgctacacttttataaacatatataattgttcatgaatcattaacctttaaatttagagatgtttccctcacagttgaaaggagaaaagctaaaaatactgtattaatgatatagtgactttctctacaatatgaactattcagctatgagtcaaagaagtcgatattattataacttatcagatttaacattaaaaaattatacagtacttctttttttgagacagaatctcactctgtcacccaggctagagtgcagtggtgcaatcttggctcactgcaacctccgcctcccgggttcaagtgattctcctgactcagcctcccgagtagctgggattacagtcgcctgctgccatgtccagctaatttttgtatttttagtagagacagggtttcaccatgttggccagcctggtctccaactcctgacctcaggtgatccgcccatctctgcctcccaaagtgctgggattacaggcgtgagccaccacgccaggcctgttacaatacttttaatctcaaaatgaattaaaaatactagagtatgaactaggtttatattaaatatgacagtaatatgtagttctagaaggtatcgatttagtattttaaaggttatgaagttacaaaataaaaatttttaggcttttcatgctatggaaagagatgatatcagagaaatatgtttatgttttctgtgagataggttttgtgagagaaccatagttctgtattgtactggtttttacttataacctattaccttataaactgttgttttgtacataataaataagactaataaaatttttttgcttattcaattagaaggtttttaaatatgtcccttctcaccccctaatgatcagtattcccttcctgtgttcattcttttgatgtttactgctgaattaaccaggtttttgtctttaaaggttctttggcatattatagaaacaacttctgtgataatgtcattgaggtactttttgcagagtggggcaagggaagggtatgttgattaataactcttaggagagttgcataaaatattttctcaacctattgaagttagtttctagtaatgtctttcttaaggaaagagtttgagcacagtaaaataaatatttgcactgggtttatataaattactaagatcaaacattaaaatggtcagaatgcttgtgtcctcctaaaatttgtatgttgaaacctaatcctcactgggagggtatgaggagcttggaaccttgggaggtgattaggtcccgaggacttcaggaaggggactggtccatgatgaaaaaggaggctcctttgccccggctgctgtgtggagggagactcagggagcacacggctgtgtctgaatgaggaaacatgccttagtagacactgaatctcctggcaccttgaacgtggatttccagcccgttagaactgtgagataaaaatttctgttgtttgtaacccaccccgtttatggaattttttttatagcggccggatctaaaatatggggcaaataaataaatgattttaccaaagtcttagggaattagaatactccccccagctatttataaaaaaagtatactgctagagtcttcaattcaatttaataagtatttactgagtacctactatgtttctgacatcggtgctttattattaataatataagatacaggaaattcactactaaccatatacactgttgtaagaaagtaaaagcaacagtttttataatactgtaactcatataatttaataaatattgaccagttgcatataaaataaaatgtctttaaagtttttttagttttaacatttttattgagaatgttttcttctatttttttaatataagaggccaaagtacacccaagtctcatttctctattaagcttgactaaacatagataaacctgaactattattgaaggctgaaaccaaagtacgttatggtttattaggctgttaggctgatggattagtttaaacctcaatgtaaatcaccaaagaatacatgaagacaaaacaaaagcactgtatgggtgcaagaaagatgtaattcttcattcactgggtttttatgcatttaagggtatgattgttccctagggctcccataatgaattgctcagtctgagtggcttaaaacaacagaattgtagtctctcacagttttagaggctagacatccaaaatcaaggtgttgacacagccatgcttcctctgaatactctagggaagaatcctcccctgctttttccaacttctggttgcccagacattctttggcttgtacctgcatcattttacctccattttcatgtggacttctttcttctgtgtctctgtgaggctcaggtgatcctcccacctcagcctcccaggtagctgggactgcaggtgtgtgccaccatgcctggctaattttttttatattttttgtggaggtggggtctccctatattgctgaggctggtcttgactcctgggctcaagcgatcctcctgccttggcctcccaaagtgctgggattacaggtgtgagccagtttccagcctctgcgtgtccatttatcttataagaaccctgtctttggatttagagctgctctaatccagaatgacctcatcttaaccaattatacgccaaggaccatatttccaaataaggtcacattccgagcttcttggtggccatgaattttgagggcacgctttccaacttactacagaggaaaaggatacaagaaggtaaaaaaatgcttctctttgctgtcttcagttttttttttttttcctttcccattccttagggggtttagatacgttagaattgagcattcttgccttcacactcctattctttaaagatattttatctgccaaaactgacttatgtttcttttctcccaagagtctcacattatgggaagtgctagtaagccagccatagaattttgaatgtttgctattcaatcataggggaaattaaaatttagtttttatgctttttttatttcagaattttaaaaactagaaacaaaaattctggagactgccatactctagttgtggcactcaaaatgtagttataaaccttctggtggtaaattaagcatcttagagtatcctagtcattagttataataaactttatgtgagtatggtctgttgcctcaatttctctttaaggtttaaacttacaaactttttaatgtaaaagagaaatgatataagtgaactttatgattgtcaacaaagctgatttgtaatttattttgaaaattatctttggctttcagttttaagtggcaaaactgataccataaataccaaaactgatatccataaatatacataaagcatattttgataaacacatgacgtatttatctgtaagaatgaagggatatctaggccaggaatttcaagaggtttgtcatcatttttcaagacaataaatgatatcctgggatctaaagtgttatgttcccgaggaatgatgcatgagatccttttctgagagcagctattggttaattagatatgggaaagccctttcagagaagtggacttaaggaggccacagagaagagaagagcctcaggcacacactgtgtctggcctacaactccactttgggtcacccctgccagtaggagagtctatatatgaactataatgacatggaatatagtttaaacccatctttatgaacacgcaccctgtaaagatccaatctggtaattagagtgttagagtggtttatgcctttttaggggagcaggatagaggtggaggatgggaaggggttctaaatcagggacttcaatctgatattttgtagtgtttgtaaatgggtgtcatctactgagattcctcattcaggcataagagaatgtcctcctttcctcaggttgcacaggaagaggagaaagaatgggtgatgatcttacctatgaaacttaaattcataataatatgaataggcattacatttatgaaaaccttttgccagtttaaaaatgttttaggccgggcctggtggctcatgcctgtaatcccagcacttggggagtctgaggtgggaggatcgcttgagcccaggagtttgagaccaacctgggtaatgtaggggagactgtctctacaaaaaaatgcaaactattaaaaaggcattacataacaaaagttactttgttaacttgtttttatacaaaattaggatgctccgtatatttgacagtggtcagatttccgctgtgggtggggctgtgtggtttaagctcaaggtaaggtatatatgctgtgctggatgccagaagacatgagtcctgatctgtgctcagctaccaactacatgacttgggctggataacaaaaccctaacagacgcctcaaagaccttcaaaagcaatggtttggattttttttagttctgaaattcttccgttatccttttatttaaactaacacataacatctgcatttcaggtgtctgttagtattgatcagaattgtattgtttgtctactactacctggaaatgttcctgatgatgaaaataaaacattcccttgttatgatctgcttttttggttctgttgatttgtttagcagaatagcagcttggcatcatactacttttaggagactttccttcaatactatgttaggctctgtacccataagttctttcattatttttcaggagtcttcaagtaaattgaaaataaaaaaaatcctgtgtgcttgtgtgtgtgtgtgtgtgtgtgtgtgtgtgtgtgtgtgtgtgtgtgtatgtgcatgttgattaggctattaacatcgtgtcttcttttttccaatactaataatcactaatttatctatattttgaactattggccagttactctgagttaaagaaaaaattaatctctatatggatttaaaacaaagatcagtaaatcaatgacgatgagatgattttaggatcttttttacttagccagaagggtcatcaactgatttttgaaagttatgtttgtttgtgcatctccaatggaaacattatttgtgattagtttatttttattcttaagtattcttgataagcatctgaatgtctgcctgaatgaatttgaaaaactaaaacaagctgagatttaatgtctctgttttagtgttagtctctgctatcatatgccccaatttcataattttattgtaataaaattaaagcattaattgctgcatttttagttcacgtaattcatatttcatatattaaagttcagaagagttatttgtaactctagatagagaaggacttaaccaagatcttgaggaaatgaagacccaaagaagtgaagagatttaggccaagcacggtggctcatgcttgcagtcccaacactttgggaggctgaggcaggcatatcacttgaggtcaggagttcaagaccagcctggccaacatggcgaaaccctgtctcaactaaaaatgcaaaatgagccgggcatggtggcgctcacctgtagtcccaggtactcaggaggctgaggcaagagaattgcttgaacctgggaggcggaggttgcagtgagcagagatcatgccactgcactccagcttgggcaacagagcgagactctgtctcaaaaaaaaaaaaaaaagagaactggaagccagctttctggatgcttaaccagtattctctccattataccaatagtttgttaaaataatggcatttgctttagagaaattcaagtagctttctggtctgtgtgatatctatgtaaaatcctgttttataacataaatgtaaacagtgattttaatgatatttttttctgttgtctcagatatcccaggacatctggaagagttcctataaattttagttttttaattacaaaatatccagcggggacagggccattttagaaatgagtaatgaaatcatagagttagaaagaatcccaagtgaccgtgaatgctaacttgtcccttgggtaaggtcatcatttaaaaaagtacgaaaccattttatatgctgtagaaactggcttcgtaatgggcccctaaagtcatttatctgtttgtactgtcctaagcaagtcatttattaactagtgaaaataatatgtaagtgttctgttgtaaatgtgatgatcaaaaactatagtaaacagagaaaggcaacccctaatttatgtaaacctgtattttagaagtttgtttataattcagaaagtattttctcacaatatcttagtttcccagggtaatccatacattctatttaaccccgtttaacatatgaatgataagaaggaccatcccgaaattcttgttctcaattctagttctgaatgccaagaacacagctcctttggttaagcatctggacttcaacctgaccacttgcactagaccatagaataggatgtatgtagaatttcaaaatgaggaaaggagagggaaaaacatacattaatggctgctaagagaagagaaaagggtcatatccttggttactctttgccaaaaataaaaataaaacacattgtaaggaccaccatgcttttgagctcctgtagacaccaggcaaggatttgccataggacatttgtgtcagttagggtgtatccattatgtagaaagctctaaaacttcaccatgggaatgtgggaatgggtctgttctgagaccttttcaatgttgtaagtcattagagaactagcctcaaaccaaaactctccatgattcccaggtaaattgcaacacatttagttgcatagctctgaaacttttccatttgaatacaacaattaccgggtgttcaggaaattagatttgttgcaatattttaagtgatttaaatgaagatcagtattattttttagtatagaaatcttctagtaacagagtttaccacgtccgtcaatgtgaatacaattatatttgcctcgaattttatttgcatttgtttttctgcctattttcttgtggaaattttaatgagcagtgaaatgaccaaaagctgggccacggagaggaaaataaagataatctaaaacatgtttaattatcctcagcataatacacacttcactgtaatagggataatgcaagaacattcagattatctaaacacatttaaaaatggccttccagtgttaggagcataagtatgccactatgaattgtgtgtgtatgatgaactttcttacacagtcatgtgttgcctaaagacatggatgcagtctaagaaaatctcattgttaggtgatgtcattgtagtgctacgatcactgagtgtacttacacaaaccaagatggtatagcctactgcatacttaggctgtatggtatagcctgttactcctaggctgcaaacctgtacagcagagtactctactgaataccttaggcagttgtagcacaatggtatgtattggtgtatctaagcagaaaagatacagtaaaaatataatattacaatcttatgagaccagcatcatcatatatgtggttcatcattgaaatgttatgtggcacatgcctctgtgtgtgtgtgtgtgtgtgtgtgtaagtatatgtttataacatgtataaatgcttttacttataaagtaattatattataaaataaacatgtcatgaaatagtgtacttaagaaataatccgaggtgaatagattatttaagcactattccttaggatagcacagtacatcatatgtcttattcacctgttttcttaaaaattgtattcagaagtcaacttttattttaaaacctcattaaatcatccttataagcaaaggtaattaagatggtgtcatttcattttagtgagttatagttctctggactctccctctgtcactgtttccaattagaatttctctaaaagttacaagagtagttaattttaattactaaaaatacctagggggaaatttgttgagtggactcttgaatttcaagggatttttgtcttgcaagtaaattatagagcagaggctataaattagttctccattctttttagaccttgaactttttattattctgcctaaatgtaactgtaacttccattttctcatcttaaaatttgcaaatttatgttctctatatttctttcatgattagcaagaggtctctgtcttacatattttttgaaccttactttctcaatttactaatttgtaatttctactctaatctttattaatccccttctttttcttagacataattatggctattaatatgctgctaaatgcaactttgtccccattccatgtgtaggtgttctttttaaaattgttctgtgtacattttgtgattgaatatttgattttctagacattttgatttttactatttaaaactttctaggtttaattcattgataacagaaaatgtggcttggatatgtaagctttttaaagatttgtaagggttttctttgcctcttacatagtgatcttcaaactttttgcttacatactcactaaaagaatttgatgaactcaataccctcctacacattttaaagttgaagtcaaatacttttcatcacaagtaaaaataattgcaaaggattaatttccagtgtatgacaaatattgatattttaaataaattgttatatcacaatttttttttaagagagtctcgttctgttgctaggctggagtgcaatggcatgatcatagctcattacagctttgacctcctgggatcaagctatcctctcacctcagcctcccaagtagctaggactaaaggtgcatgccatcatgcccggttaattgtatcattttgttgttgttgtggagacagagtcttgctatgttgttcaggctggtctggaactgctggcctctattatatcatgactattcagtgtccattgataattataaacaaatactatatgctcttccaatcggatgctcaccatcaggtatttattaataatttacgaaactcctcaacactagaatattttacattatttcttctctttgaaatttgtattttcattccacatttcctggaatattttaatataatatacctttattcttgaaattcctttattgttcaacttactgtacccttctgcaacaaatgcagccatatatatatttggaaaatgtctatggcttcaaggtcctaagagatagaaacaaagatcttctttgaatttcagaaacaaatgctcttctttgagttccaaatactgttataatctgtacacacttgatccaaaaccaaacatgtacgctctaataaaaaattattgtttataaaaactggccgggtgccgtggctcatgcctgtaatcccagcactttgggaggccaaggcgggtggatcacgaagtcaggagatcgagaccatgctggctaacacagtgaaaccccgtctctactaaaaatacaaaaaattagccaggcgtggtggcgggtgcctgtagtcccagctactcgggaggctgaggcaagtgaatggcgtgaactagggaggcggagcttgcagtgagccgagatcgcgccgctgcactccagcctgggcgacagagcgagacttcatctaaaaaaaaataaaataaaataaaaaatttgtggccaggcactgtggctccgcaattttggaggccgaggtgggaggattgcttaaggccaggggtttgggcaacatatgagaccctgtctctacaaaaaataagaatattagcaaggtatgttggcaccacctgtagtcccagctactctggaggctgaggctggaggatagcttgaactcaggagttcaaggttgcagtgagctatgattgtgccactgcactccagcctgggccacaaagtgagaccctgtctccaaaaataattttaaatataaataaataaaattgtattggaaatgtatctcctgatgagatgaggtggtaattataattgttcgtggctctttgatttgctgctctagaatgggcattgcctcatggtaagtttctaggtagatgagaaaagaagctcttctgtaggtaccagatcagccaagtcaatataagggcctgaaatgaattcctttgcaactgttcaggcttacctaccccttagaaattttttactcacaggattatagataccatggcttgaagaccactggtctaatagatggtacatttttatgtatgatcatattatgattattaatgcacttgaaaatattcttatttgtaggcatcagcatttgctctctatgcattcaaccatatttaaatgtatgatttagatgagtgagtgtaattcagctagggcactatttagcattgtggatgggataattcctctttttgagaaactgtctcttatattttagggacatcacttagtctaagtatccttagaggctaacagacattgtggcaactcaaaaacttcacaccccgtttccagacattctcaggcaatgagaactgtcccagattgaaaattaccgacataaatcccaaacatcctttttaagcctgtttgcttctttagaggtttaaaagacctgttaaactgttttgtttctgttctttgtgtgcatatttcttactgttttgctttattgacacatagagttcatgcctattatattttcattgtaggctgtaaccttaatatatatccttttttatctaagtgaatgctttcttctatcataattctattttatttgatattaatattgtatccccttctttttaattgaacttacctggtttatgtgtgcctctagctttgcatttaaccttcccattatcgctgctccctaatgctgttgtcctcttgtgcataatggttgcaagtcacattgtcccatctctctgagacctactcgtatctacacacttcagctcttcaaaagagttgatgttagtcatgcttcattaaaatttcccccatataagtcctctgaactgcaagggcttctgaagatgggcagtgcacacttattggaggtaccttccttccactagtcacaactgctgtggatccagcagaaattcctcactatttctggaataggaggactcctttagtggtaggttaccccctggtttggtatctttaagtcgtttcatttcatattagaacggaagactgttagatgcctatgcctaagttgccgtcttatttgaaagttggttattttttaaaaaattattctttttaaaatatatcagtgattatcaaattatgtaaatacaaaactggtcgtggaatggagaatgggtgtgtctactattggtgtatattacttatttaaaactgatcaatttttttttttctgggtcagttttgtgaaagtgtaacttactcaacagaatgacttgatggaagttgtagtgaacaaatcatatcattgatgacgggggtgtgtttttatatgcctaataatgttagactgaaatgccataatactagaggaaatttagaaagcattttgtagctcttaaaagattgatactttggtagcttgcattattagaaaccagaacatctatctgcatacatatacatacttctttattcagttcataaatttaacttgtgaaaatgacaagtagtagcaagctcacactcgggatttaatcttcactgactaattcatcagacattttacctttctgtagtcacagatggttttaatgtctgtctgtattgaacaatcactcagatgtgtccatcttcgtctttattggataaataataattcagtatccctcaagtgactatgataattggattccagaagagaattcaaggcttctaggtactatcatattcaaaatttgatctctgtgttccagtctctctcgtacatttgaatattttccagcttaagtggaatatatgggacagtagtattttgtgtaaattacttagaatagattttgtagagaagccctaagtgtaacctctttgctttttaaaaatggcatttgccattccaaagtaagtccctggtggtgttacttgactcattccaaaatgacctacacttgattaagtgaagtctcatctaatagctgaaactccccagagatttttagtggctgtttaaaatgaatgtctgtatttaaacccattttagtctatagccaacctttatttcctctatatccagaggcagaaaacagatgtatttcttttttcatctcttgttggtaaaaacagatagatgttgtggcagtggttatgtgtatgacttttaattgtttgggtttggagagaagaaaaacctgatagcatattaaagtatttaagacaggcttgatgatttctgtgatgctggagaaatgtatatttttattgtcaatgttttgaagagttagaaaatgtttatttttaaagaatggtactaagagcataaaatttcagcagtccattctatgttttcaagatttatgtatattatatatagaaacatacatgtgtgtatatgtatctatatatttggacacacatatatttcatttctcaagtttttattgctgtaattctctgaatttactcatgctttccttaggagcctctatatcaactgcagaagtgaacttttaggtctgacagtgagctgaacaatacttccacggataaagtacatggtcttgaagatcagctgctgtaaatgttataagaacttattatcgatgggagaagctgaagaataccatctctcctgttgtctcacaggaggtcattactgacattggttttgacatacttgaatcttcagaaaggttattattgtccacttcttaaagtttagtctgaacaggcttgttctacttctaaacccaattgaaatgagtctgtgttcaacactgtttataaggttctccatgccagaggacagccgctatctatagcagaatgaagatgaggcagaactatttccgtgagatatttttacttcaaatatttatttcaaggattgtgccacagttagtattttaatttgtttttagtagtgaccttggctgctgtgtatattggtacagtgtgctagaggcagcacttttcactgtccattttcttcaaaatctacgatttgatcaaaaccttcaagcactttacagtctagaacctttgaaatgactagagagttgtatagggattgttaccttgggtagaaagagccttgtatgagcatcctgggtgactgttttctgagttttacccggaaggaagtgtgaagacactgtcttccgtcttttgccgtcatcagcgttccaccttcattgagaccctgcaagaccctggcagccttggcttccaggcatggtttacaccatgtgaaagcaaacaagtaaacacaaatatcaagcctaaatttattttttatggtcacagagttcctaaaggttaaaaactttcagaatgggtctgcatagggccctcccaccggcctcctgaatccctcctccagtgactttcctgtcaggtttataatgtcttttcgttctttatttcttgattgcattctatgattttcccctaagacaagctgtatgattaaattacccaagtttccaggattatacttttctttacatagcacaagctgtttaatacattttgtatctgagatgcaacaaatcacatctgagatacacagataaacagcagttcatctactttattttttaatacttatttttaataatcaaataaaatcatactttatgtctttaaatcatatttttaattacagaaagtgaatattgaaaaacaaagtaaaaaataatgaataaaattatgcagatgctctggaaaatacctggagagaacctgtgactaatttggtacaaagcagaacaaatgttaatttagttatagattatatatacttttatatcataccaattgtcaattttacacatagtgagaactgtttcaactgtaaaatgtctttcaggaacaaatctgaatattaatttagcttacttgtttctgtggaacttaaacacttttgcacttttctttagaattttgaattttaaaaaattaaaaataacttttgtaattgaggtaataatcctcatttgtagtgttgaaaatattattttcatactactctcattctttaaaaataaacactaaaaataaccagtccagtaaaattaaagaattagtcaaattttttctaatgtcatgtgaaaatttattgactattttattttttgaaatattagtgccattgtagtgccagttaaaatatttaatggttgatgtacggtactttgctaatattcattctgcttatgtcattcttataatatttttaggaaaaaaatttgagtttcatatgtagagttttttttttaataattaatctcctgtaaagaagtgtgccatatggtgtaaaattttgctgtactatttttcaagatttttttgtagccctcaccgtgagtcttcccaatcacaggctttcatccttatacagtgacttgactctttgccactagagggcagtaaaaaaatttatatgttaataaatataccattgtagcatttttttaggcttttgtactattgttctagaatatcaaccctggaaagtttatctagatgtctgctcttcaaccagaaaggaaatacacaaacctgggtaaatttatcttcaaatctttatggattatacttaaattttgtgttggttatattaaaactagttatgatattatagataaaatattatttaatcatgcagagtttctagaaatgtatggttttaaagtactccttttgttttattagggtggggattattttaggaatggaagacttttatgattgatggttgttggctaaattttattggatagattcttatttggtacattttatttactagtatattttacttgaaggaatgtttgtcttttaaaatgtttttcaattttttgaaaattgtagttggaaactaaaagattcagtacgtaaaatactttggacccaatacttgtcataattttccttaacaatatagttaagtgttcagtttagtttcctgttagacacaaaatacagtcttttagcttggcaagttaaaagtctgtaattttcagaagtgggtagaattactgagggatagaaatgttaaaattttctaatgatactatacatgtttataatttatttagttctgtgatgaaataccaaagaccacttttatggattagtcaggctacgtttttatattaacttacctttttatttattttattttaatataaataaattcatgaatttgacgattataaatatatttattatagtcagcccatcatccccagaacactgcagcctaaactcaggcttatgagtacttaattactaaattggaaagtgtagcatcttgttaaaacagcaaggcttatgatatcgaatgtgtaattttgaagaaatgaggaatgccatttgtttttattaagctgggatttgagtgtttgaagaaagcattgagggaggcatttctttagaaactgaagtaataatcctcatttgtagtgttgaaaatactatttttacagtactctgactctttataaataaccataggatctactgataaattgttttttgtcattttccattctatggagaattctacgtaacttcaaaattagaagtaaatatttttgatctcttaatggagtataattttcttgtgagggaaaacccaatatatattgatttaggatttctgagatataagaaccttttttatgatattgatattctgtaaaaacaaataaacggatggaattataaagtctttttccctgaagtgttgcctgcacgtttagaaaataaatgtatttagaaaagacaaaagtaaagaatagttattttttttcacataatctattaatatattgtattcttccttgggtatgatggatagcaacaggaagtatttgattatagtttcaaaaattgtatcaacagtattctgttttgagaattacgatctatattattgtagaattttaaaagtggttttccagatatcacatttttaatctctctgagctgtgtggaagattcacttattttggtcatgctaagcttccttagtgaaattggcactaaaaataaaaccaataataataatttaacaagtaaaatcttgagtggagtctagaattttacagtaatttagcaagatatcttaagtttcactctcccagtctttcaaactgaagccttttgcaaatatagctgctggaggctcttggtatcgttaattgtttgctaaaatatcctagaaacacagcaggccagttttctaatgatgtttttcaaaatcacaatttccttttgccaaagtgtgaaagaattgtttttgaaatacagtttttaagtttgcttgtaggccttaagtaactaatatattaacacatttgctttaaattcatatatatgcatatatatttaattttaaaaagtgtcttcgtaaagatgaaaagttaaaatttggttctaattctatttggaactctgtatctttgaaaacagtactatttaatgaacaattggttgtatcattttaatttttcttttttttgaaaaatcaaagcatatagatattttatgaaattttcttaggcttcttgtattttaactctgaatttatgtggtggatctctagacacaatatgaattttctgtcaatgactaaaatatggttttattatgtcaaatctgaactgacatatttttaggcaattgtttcagggaacagagaattgggtatttgattttgagatatacggagtcattttattgagtttgaaaggcacaagtagttgagagagtttcctttttttctgttaaatactagtctatttgaagagtcgttttcttttctttctttctttcttttttaatataatcctcttatctattgcttggggttagaagttgagaaattgcattttgccaaagtgaataattgagaatttgtaacacagactctgaaaaataattcagagagaggccaagagagtttctataacaagtcgtaaatatattttttaaagaaacagactgaaaaactaatttctaaatcaagatttaaatgtaacaataaacaaggagttaaagagaaagtccagatataaacctaaaagttaaatcgcttttctttatcttgaactttgtgacaataaagaagacacctcattttctcttttactttaccttgacttttctgaaattcttatgaaataagtatagctcctgttagttatctgttttaaacaatcttttgtgcttaaagattcattattcagtagggtaaatcctcacctttacacttacgttgagatttttttaaaattatttttctactttaaaatatgattataggccgggcacggtggctcacacctgtaatcccagcactttgggaggccgaagcagacggattgcctgagctcaggcgttcacgaccggcctgagcaacacggtgaaaccccgtctctactaaaatacacaaaattagccaggcatggctgtgtgcacctgtagtcccagctactgggaaggctgaggcaggagaattgtttgagcccaggaggcaagggtttcagtgagccgagatggtgccactgcactgcagcctgggcaacagagtgagactcttgtctcaaaaatcaatcactcactcaatacaataaaatacaatacaattataatttacttctaacaataacttaatgattttttgctttatatcaaaatttaagaagtgatattttctttgttactttctttcatttctggttattgtaatggaaggcaaaatatgacataccaaagaagtaaatttctctagacagtgcacaacactgaagtaaatgcagatactgtatcttaattgagtatatttaaatgcaatgttaattaaacttatacttcagtttttacctatgaacctaaaacaaaagccaccaattatacattgaattttattaaatattgtatctataacttataaaaataatgtaaattcagtgattttcattgagacatgctgacctagaatcactcactgaaaaataggttttgaagggtaactcttattttactataaatacgtttggcttaattacaataatgcttttcaatttatggttccttttctttcaaaataaggataaagtaaacctagttattaatatgcttatatctatattgtagattttttgtatgttcctatgaacataatacatacattgattttatttgccttttaataacatgggcagaatgtaatgtggaaggtaccaccactaattgtgattttaaaaaaattacccttcagtgtaatcctgcaactattattgtggaatatatcaatatgattaaattttggcattgcagaacagaatcttcactgcactgtaggttagaatacaagaaaaattgaaaataaaatgagaaaatttctttcttaaccttttgcaattttagtataattttgctaacctgtgaaaatgtctacacataggcattgtcttgtacatggcaagacagcattgtctctgacacacctgcattatttgagatgtatgcattcatgtcagttcttttcagaaacagtaggtaggtattacacaggaatatggtctatttttatggccttctcccataagatgccttctttgtaacatatcacagtgtacttaaaagaggtcattaaaattaaaaagatccaaggaagcagttacgagtgtagaccttcaatatatgaattaattttggatttcagattccttttagatttgttttagctctctacatgtcatatacttaaagttttcattgaaattaagaatattacccaaattttcatattgctttaggaatatttacaggaaaagaaaaagaacatgtttgttcttcagctatttttttctttacggagcatatcatcaccacaatttcatattcaagctttaaagcagaactcattaatgcatgtttcatatgcgttgccaaaaatacaaaattgttttcttgctttatctagtgctgagatttttagctggactaacaacattgtgtttgtctctatggcacattatcaacgtgtctctgtagcagaaatagtagatggttggaataaatagtagacgtgcactggtgtgtgtttatgtttatgtaacagtaccattttccagagctatcatttaataccagcactttatgccatattgaaggacagttgcaagccaatgacttgatgctagtttgtagtcacatagttaatgtaagagcctaaaggatcaagcaactcagcttctcaaatattagggtcatttgataccagttctcctagatgtgatttaaccattgtttctagaaattagaaatggaactactatactaataacaaaaggagcaatgtgtgatcccatatatctcaacaatgaggtatgtctaggaaggtatagcaatataacaagattgtcagtatatccattagtatgtctgtgtattagtctgttctcacattgctataaaaaaactacctgatactggtagtttttctttataaagaaaaggggtttcattggctcacagttccacaggctgtacaggaagtatggctggggaggcctcaagagacttagaatcatggtaggaggcaaagaggaatgaggcatgtcttacatagccagagcaggaggaagagagtgaagggagaagtgctacccattcttaaccagatctcgcgagaactcactcactatcacaagaacgacaaggaagtcctcccccatgagccagtcacctcccactaggcttctcctccagcactcagggttacaattctgcatgagatctgtgtggggacacaaacccgaaccacatcggcctgttactttcatgagagcgggactcatgctttcttactatcaagttatttctagcatttatgacaatgactagacacccacacagtagcaaataagtgatgatagcagcaaacatcaagtgccaggtactgttctaagtactctgcatagatgagtgtatttaatccttacaccaatccgataaaataggtactatttttaccacccattttacaagaaatgaggtgaaaaagagatgaagtaactggcctgaggtcatgcagctagtcagttgtggagctaggatttgaacccaggcagtgtggcttaacacttaatgctccgaatcattaccatacttctcatgtgtatagagtgcactattaccaatcaattttataggctctgtttccttgttttccctttcacagctgacagaacagtggtaatactttaccttatttgttccatgtggttatttttaatacatggggaaaacgagaaagttttagaagttggttgatatgaattaccctttgaatacgattaattttgaatgattgtgtgcctacctatgagaattgtttgttaaaattttgtatgtcaggaaagattcaggaatattaatattaaataaattaatgataaagaaaagctgtcgtgttatttctgaactggagtacccatttcaaaatgtattaaaagttatgcaaattggtccttcttagagttactgataattgtgtgatttactgttaatgatcatgaaagctacttgagttgatactatgtctgaattaatttatttatggaattataagacaaaattaacttgttaaaaaattcagtacagtagataatgcaaatattatcatttaatatacactactaaattaatagttctctaatggccacagatactccgtgttttaagccatgttagacattttatgatgtttcattttaacttagaaagatacatagtacctttattataaatctgtttttcatagtttattaataattcaaaaactttcaagaagacattttatcttatacctcctataaataaaggtataccatgttccttgcaggcactgaaaaattgtggtatggtatataaatcagtattttctggtaatggatgtgcaaatggctttcacagccctgtcctcgtttgtatttttaggagtgacataagtgtatatataacattttccccttcattacaaatgcatcagcaaaactgctgatactggagttgtaagagtattaactggttaattttaaaagagtgacagagatccctttgtctaatggcaactttatggaaatgaacatttcagatgacttcacaaatttttttttcagactccaaaacaaaggatattatatatcaatttatcatcctcatccagtaacatgcaattatacccaatttcaatcctgaccaagcaatcaataaatttaaccaagtaactataaatacatttgtctcacatactgtatgtgacacatatatgcatacatacagtatgtttataaatacatactggagtctcactaaatttttcaatatttgatactttgctttagaggtaaatagtgaacatagaagcaaaaaagtgtgatggagtttgatatgatttatctgtgggtttctggaatttggtattttaaactaaaatctgaaaaaccagtatttcggtaatattttattgagcaaatgctggtgttaggtgtaccatgtgagctgttgggatccaatgctgagaaagacagcatccctgttctcaaggtgtttatagtcgattcagaaatgcagtcaaggaaacaggagattgtagagtatgacactggttttatacagttttatgtacaggattcaatggtagcacagaagatgggcagctaacccaccttaggggattctatagagacctactggaggaaatcacgtttaagctgatacctgagcaatgaagagaaggaaagctgagctagggacatatgtggtgtcggttttgcagagtaggtagcatgtccaaagctggagccggaagacagtgtcagggagctgcacatagattaaaaccatcagagtgcaggtgtggaagaataaccataaagatggaaaccaaactgagatatttggactttatctggaagtagatggaaagccactggaagatttttaagcatccaggcttttaaaaacccttttaaataaacttttaaaaagatttaaaaaagaaaaaggttctactttgttacctttcattcttaagaagtattttaattgtgtgtgggggggagggtgggtgggtggtcatccctatgggaaatatgagctactataataaataaactttaaaatatagggaaacaaggaactatattaactggctggatggccacatcccagagacacctcctttgtaggaatggggagcatgattttattaacagtttatagctgccaatcactgacacaactagttacctaaaatagtcaatgctgttctcatataatgaacagttacttgcaaaaagaattaagctgatcaaagtaaatcaacaaaaatcttggtaatagaaattttatgtaaggtccaggatcacaaaagccacagaaaaatgcagagctagaacccccatatgctgcacttttattgcaggagagcctgaagagtttccatctggactgtgtcttaccttctcagacaagggcatgagggtgatccagttgtggtccagattgtcttattgtaaagggctaagcttaatatagataaccctcaatatacactgccttggccttaaggaaactgaaatttctaaaatggttttaagatgagtctagtcccttgggggtcttccagatgatgttagttatctaagctagaaagacatccagttcctggcaaaagaaacggaacaaagcattgtattacatgacgagaccccctgttttctcttttctcttcctctatgtgagtcatctagtaccacatctcactcggtatcataactttgttctgaatgtcagcagtgttaaaggagctccacagcggacatttcctttaacccgctaattcttgcacgtggtttctagaatttggtgagtcaccagagtgtgggatacaatgtggaagagaaacagccatagctagccctttttatgactgctgcaaactagtgttgtaatatagttttatgttcctcttatctgataccaaagttacctgtatggaaagcccgggatgaagtgtgaaactggtgattattatggttactattattttgtgtacttgtctctttatcgttgaattactatagataacagattaactgtatttaactatcgcatatcaaggttgtgtagattacaaattaaaatttttgaaaaagaataatagagtaatttcattttcataatgcaaaataatgtgcatttggttagggcggtagaattaataaacccagttctggtttcattatttggaaccttggtgtattaagtataccactgaaaataattttgatgggccagtgcagtttaggtcttcagtctaacactctcccaactgagctacttaggctactctggccagtgcagtttaataagtgcccttttaacgctaagcatgctggctagatgttcatattttacaaaatgtaaaatatgatttttctctaccctcaaggagttgatgcaggtaacataatcacatgatagatgcttgcgatatctttaaaatgagacctaaataaaatttaagggattcattcaaacatttattctcaggtccagtgggtgaacatagtacgtatctcataaatatttattaaatgcagtgaagcagtttttgtagtgcaaacagagcctttaaatggttgggcaaattataacaggaattctagaatatggtgggttaaaataggaagttatgtatggcaataatgagttttaaaccaggtttgcaagaagtagagataaacatttatacagatgatgaggaagtgcatgtattttggataagatggcaaaagcaaggacataaaaataatgattaattgcttgcaagtgatgacaaacatctgcaacacaagtggataatgatgggcaagacggtgctgacaagcacaaaggaataggatttgccacttgaagggggtcattgttgaaacagtttggtttgagagaccagaatcagagaggcaggaaaggagtctaggcttgaagcaattagcatagtggctgtccaaatcgaaagagggttctaaaaaatacataccagcagaaaaaaacaaagtatcatgatttggtgatgtatttaatttccaagaaggagttcttttagatggtgtcactgaggagggggagatgagtgactaaatatagcaggaaataaagagctttgaaattaagacttgctaagttatctatataattttgttctgcatacaaatagagatattaaacatagtgctggagagcatggccaaacctgggaatgtcaatttcattttgttcttttacttatatcttgtatagaaagccatataaggagtcaagccaagaaaacaaaggaagaaaatcatcagttcaaggggaaataagaagctggtagttaatgaataccacggaaagaagtcagagacaggacaactgaaagcctaatgtcatcgaatactaagatagaaacaatttcaagaggaaggttttcattttagttgagggatctagaatgaagactatataaaattatgtaataggtaatgtaatttacgtgtgtttatgaaaccagaacgcattagtaatttaaaagttctaggagaatgctgggacagaagccagtggaggtgggaagcggaggtagcaaggggtgaggaactgaaggacctgggcctaacagtcatttgcagctgctgaaaaaaatgattcattttcactcttaaatgagtaattacataatgttattcaagagttaaaagatgactttctactcttcatttttaaatgattttattactttcttgaaaagtgagtatacatgcttttctggacataagatacttggcagtcttgacaggtttttatttgtgcagtggaaagaatttgatcgttaagggagactcttaaattgttaagtaaacatattcacttttggagccagaattttattttgaacgcatgaagccttatgagaaatagtacattttataatgtgctctaataaagggaaaatgtgtcctctcaaaataattgaatttcttctctaattttttatgtatatgtgatctctaaagctacagttttataattattcttaccagacaaatattactctgacctaaaatgatttagagtagaaatttccaaaccagtttagtatctttttaggaacagtgaaataacctttggttattttagtagtaaattaaatattcagggtttgtgtggatttataggacgggggtaaacatgccaagtcacatagtgggcatgtgtaaaatatttagactttaatagaaagaaaaaccaacctgtattgagttataaaaacaccatactgttgaaatgattgatggttttctcatcacatgtaacagactaacataatttcatgaaacctttgcttaccgcttacaaattatccaaaattcttttgcagtaaagctaacagtatgtgctccttaagcaaaacattgcctatttcttttcttttctcctctttcttccttactccttcccttccctccttattccttccattcccctctcctcctctcgccctgttccttccctccctcccttcctttcttcctccctccttccttttcttcccttcctcccttcctcccttcctctttctttcctcctctctcccccttctgggatgttgccttaatagaaataacagtctactagagaaactcaaaacatgtaaaaaatattatacaaggtagaaaatgataaaatgtgtaagaggagtaaagaccaaattctgttggagaaagcagaaactctcagctgggaagattaggaagggctttagtagagacacatttcaaaggtgtgaatgtcttaattctcactatattcctctagaaactcatgaccaccgttcggacaatgtagtattataaattgttaatagcgagggctgtatctttgtaatgatgatgttgttacgtgagatacttggccttttgaataaccataggtattcaaatatttcagtaataaataagagtgtttctcaaagatgagctatagctttgtttttgtcatgtttaactagccatgataaccagctgagattgacaggagttacttaggttatcctgtgatcaatttttggatgtggaatcatatgaggtcattggtactatctttaaaattctgcccttttttgccttgatgagggacagtgctgggtgacagtatcctcagtgctctcctctgctgggcgttgtgagtcaggagctcaccaaacaataaatcatattgtagtgcgtgcatacagatgtcagattccaggggaaaaaatggttataatttttgacttcatggaaaagtgaatgggatggagtgctcaaagtgttgcatgacgtaaaataccccgttatctatgttagttgtgcgaaaaattgcatgaaaaatacatttaaagtgacgttgtgaatgacagagtttctgagatggtaccttatgaagggacttggcaaccttggtggtatcttaggcatcgtatcaagcttaaacttgctaactcttggcctggggagcaccagctcacactggatgctgaactgcacacttgtcatttcatgacctctcccagccgctgcagttgtgtttcatgcctgcttgtgtttttgttaccttgcctcttgccttcccaggatagggcacatagtagatacaggaacatttttgagaataaaaaggtaatttaacctacacagatgtacatagtacttcatatctactatttcagaacactgtagcaaatcaagaactttaaattattttcctgaactcagttttgaggcagtcagcctgctcctggtttttaaatactgtgttttgcaaacaaaaatgtataatgaggtttttctctgaatacagtgtggtcagtactttttaattaataaagtaaacgttaaggcaaaaaactacctccacaaaaccattaacagacaaatattttatgtaaaccttaggagatgtttattaatcgtggttcggcttggggcacataggatgtttgtcaggttagtgaataaatttccctaatgtatgtcactgaatattgttaaacaatactctacctgcttaattccattactttaaaaattgcagtgaaatttatgtgtgtgtgtgtgtgtcttttgtagaaaagttattacaatttacgatcaaactcactagccataaatgtttttgattaatttatataaacatgatactgtggtagttttggtatgtagaatatttatatttatatttttgtcagtatatttcattaatgttcaaatggtagtggcggatagtgttttcaaatttgttgaaggattgcgttgaaattcttgaaacatggtagtgaaaattgcattttttccagtcttttcttttaaaggtgaattatattcagttgattataagaagtcccaaggaagtactttttactagctttaaactgttcaccatagatgttaatgtgggacacctacagaatccacttttgacatggggcaggttgcaatagtattgcattacactgtcagcaggtgctgccatggacattggtgtaaagtaagaaggaagggattgggatgcagaacagtaattggaaagagagaaataaatccttctctttcagttgcttcactgattcccaatgttccaggtaaagtgcacctgctgagtgcctgagaagaacaggtacatgctagccctccattaatttcagaggaatggcagtggactgcatctacccagcaggtgtgctgagctgaaggaagaagatggatggggacagagtatagaaaagaaagcaggtagcccagatagggtggttctcaaaataagagacaataagggtaggatctctccttataagcttgaatttatcctcctctaattcctagtggcactatacattttaatagtatttgaagccacgttagaattatgacagcatatgttaaaattgtgcaagtggttcagtaatataagctaacatttcctgaaatgatttaaaaatctggcagactgcaaagttatcctgataaggaacttggttttgattacagtaatgagatatacgggatggtgtcagaaactgtcttccagttgacacaataatccataatttatagattggcttaaaaattaaaagacaaagtcaattataactaattatgatgctacatttgctcgaggagttactatatcctttgggataaaggaagtaatattcatgtcagtcaggaatctttagctacagtttcctggttctatcttaagaatttttcagtttcgtttcatgagaatcctaagccactgaaagcctgaaaccctgctatttttagaaatactgtagtagcttctgtgtatcactgcacatttgttcctattctgaacttcttatctgtgccaaatcttcagagaggttactggaagttttgctcgatgactgctgaatcagtcagaagtgaattttaaattatgcaggagaaaataacaataaactgagttacagcatcaagatatcattgttatttctgttgatactggtttcatcacttgataggatttaaatacccagactattgcatatttactaaagttttatttcatcatgtcaacatttttttttttttacagtcaaaagccaaattgtcagcaaaggatattacaaggataggtatttttagcatcttttcaagaagtgaaaggaaggagtggtttatatttttctataattttatgccatgagacgtgacaattttccatcttaagaaggacaattagttcttagaaggaaagaaaaatgcattcttatataaacttcctagaaaatttagtgagttgataaattcctagctgcatatcaactttctactcttgtggccttcttttgtgtgagctttgatcatcaagcagtttctaagtgtttttgaagcacatgtgttgcatgtgtggagcaggccacagtgcatatatgtagcatgggcttcttccagaaaaaaagcattctgagagtaccattgagggaatatgtattcaaaggagacaagctgcaataaactagttgtttaagtaatattataaattgttatcctttttagatatttaggatttcattttgttggaaagctttcaaagggtgacccagtacgtgtgccaatgacaaaagctccttggaacaattcagagcatgctttatgccttatgaaatgggattgtaaaaatcctctcaaaaatgacatccaaaatagcattaaaacacaatttcctttgataaggctttacggcactcatatgaaaagtgataccactttgagtgagactgtgtcagcattatgtgatgttgtgttgctcataactgacactaatccattaagggtgtgagggtcatttatttttcttatgaagtcattaaatacagttattgatttctgttcagttagattgtaccttcatttaatgatcgctatatacattaatgctaagacttgatttcatgcactttaaacaaatagatattgtatttggagtttaaaataaagttaatgacaattattaaaaagaaattgtcattgattcactaacccaagatcatgttgacctagaactgtaaaaataatattggttttttaaaaatttataaccatcttcagtgtatttgctaaatagaacagatgacttttatttcttaaattaataaagtaaaattaataaaactagtatgcaggtctatgtagtattcccctcttactgctactgtttttataactagttgtattattttctgctgatttgcagatgggtttcgtgcattttctaatttcctattttttgccaagtaaatgaaaaaagagtaaatacctaaccaaaatcctttttcttgagtgtgttaagcaagaaactgggaaaggaaaatgaaaagacatcagtgtatgatattctgttctggaaacgtagatgaatattactagggaccagatgtgttttggtatatacagtagtcccccctgatcacttttggcagtttcagttacccatggtaaaccacggtttgaaaataaagtgcatacagtacagtgaggtactttgtgagagagaaaccacattcacataacttttgttagttatactgttataattgttctattttattactggttattgttgttcatctcttactgcctaatttataaatcaaacctttcctaggtgtatttaaggacaaagcaagtatatatagcgttcagtttcaggtatccactgggggtcttggaaggtatttcttgcaaataaggggcgactaatgtaatctattttatattaaattgcttgtttaattggaatcatgcagaattgatgtttctgtacattcccttgaaataattttgtcaaaagaaacagcagtataaagacttctgtaatttcagatttctgtcatttattaagaccagtcattttttccctgattgaatatattatatttgtgttttactcgaaggtatgccttaatagtaccaggaacttctaaactttcatagtttggcaatgttttaaattatttcttttacctatccttttggaatttgatgcagaaattattggtctatgcaatagtgagatgacgtttattagatcacctttcacatgggaagtactattggaggtctttagcctctagtgcagtagcaccaagtggtaccaagttcattacagcagcatctttggagatgttgtatgctcagcactttttcataggcatcttgcctggctcattgaaggaaacctgggcaaggctgtgatattaatgaattatgacaagccttttgcctgtcaagcagaggttcccgccttcctcctttaagacaaaaacttaatggaagatgctcagatgcgcgagctctctgatgataccccttaagtgctcttctctttctgatgcgaatattcagagagccgtgaagctgcaagtggcagcatttaatattgcctttctcataatgcctgaataattttccagagactgatctctgcagctgctgtgaacatggttatttgtttatttttcaccttggtcctggtggaatgctgacctagccaatcttcaggactcacagggaaaatggtttcagattcatagctctcatcttttctttcaaataaacacaaaactgaagcttgtgacgttgagtaacagaaaaataagagggactgtttctttagtttcctttaaaagtgaaaaaaaaaatgactgtatgaatgaagaatttatttggtgaaaaatgaagactctcttgcatatttttaatggatatttgtgagaggaaaggagaaagcataggctgttgtggtaagctatagaatgttttcaagatttccccccgtagtgctgctcattatgttaaacagtctagcttttagctactgtagttttcgttttatgtgtattggccttcatttgctgaaatgcttcaagttcacagtactaaagtcattttgaaaacgggatgtaattacaaaggtatcttatgcttaccaacagcttttttggatcaatttaattatcattacttgtggatactgtaaattgaatatcccgtccctaattacattaaactcaggggttagctgcttaaacgtctaaatgagaaaagttcatcctttgctataaataggagaattgttctcttatttagactgaccttggaagctaagcattttacatgatattgtcaggtgagcattataaagacagcctgtaatgagatctgtaatgaggaactaaggtatagtagccctttgaaaagttaatttattcagcattttcttattgcatgatagaattaaagtttgtgtatatgtccggacccctttttaaaggggccagtctcactgttcttggtttactcatattctgccagtagtttgaagtgggttagtattactattccaccttaatggaagtcaccattaaagtagtgaattcatcttgcccttttaaacagagctaatttatttagggagtaggaatgttattttccctaccttctcctcacttccttttacagaaatgatatatcagaatttattcaaaccactttaagcatacattttcctgagaggaaaaaaaaaatgcctttagacatcaataaactggaacggcatttccctgttctggaaaatcagcctttaattagttgatgtgtgtgtcttgggttagtatttgttgtctgttcagctcaagtgatttttgtgctttataagaaaacggattgttctggtgggagatttgattgatttctgcttgttatagtcattgtaaattttagtgccatgcatagctacttgcttttatttactttgttttctttgtcaattgtagcttcattaaaaatctcttatctgttcacagtggaaactcttaaaaatgtaagcgtaactacttatttccatagaacagctcctgctgagtgtgctttacgatttatcataaaaacctgtaaggacaaattgaggctggatgtgctaggaaatgaagccgtccctgggatcactagaagagatttctattatgcaaaagaagtagctaaaatgattgattttgagacttcagtcaaaacataccctgaatgttttctggattttctaatgagacatattgtagaatacaccagaataacgtgaaaaatgtagacttagtagcataaataattaacaagtggttttgggctctggggtttccaaagcaattccatgttatactaagtatactgggagccatccacttacagctttttttttttttgagacggagtcttgctctgtcgccaggctggaatgcagtggcacgatctcagctcactgtaacctccgcctcccgggttcaagcgattcccctgcctcagcctcccaagtagctgggactcaggcacgcgccaccatgcccggccaattttttttttattttagtagacggggtttcaccatgttggccaagatggccttgatctcctgacctagtgatctgtccgcctctacctccaaaagtgctgggattacaggcgtgagccacggcacccggcctcacttacagcttttaaaaatattttcaaccatactaaattccagaaatttacttttagtgtgctatactaaataacaaaacaacaattctagaaaacttgaatttaagtatagtgtgtcttttaatatcttttaaaactagttttctaaaaatatggaacattttacacatatcactttagtggttaaagttatgaaattgaatgttcatacaactggcagttttcctcatcaattcaaacaggcagtgagctttggatgaaactacatttctaatattagaggactaatcataggcaacctaactttttaaaaacaggcaacaattttatgcttccgatacaattagatacagttaccaatcatatcagtccattagctgtcaagttttattcttcttcataaaaagcaatcagaggtagacatttaaacatagattatgtagacacgtgatgtatatatatatgtagcatataccccatctctactaaaaatacatatatatatatatatatatatatatatatatatatctcaacctagatgtatatagattagataggaatttcacaaagccttgtacatgtaactcctccagaaaatgagtcttggtaagaatacttagatatcagttgttgagtaatgaaaactcaggatcatgaaaagtaagaattgttagaaggtgatttggggcatcagtgcatatgatgcttttcctattcaaaattaagtagagaaagcatttttgtggaagatggagagtggttatcttcattagcatatagatgcctcatagttaaaaaagagttgacgttctcagtccagagtttgtgggaccaaaatatatctaagacataggcttcttggaaggaaggctgactcgtaatttctttaacacctagtgaaacacccagatgtaagtgttttgatgttggtaatgataattgacacacactaaatttagctcagaaattaaggcctattaggaaaactgcacttcatcattcgtcttcacctcttgagaaatttgtgtacattgtggaatatttatgctgttctccatgttcagttaatagtgtcacgatccattcccatcactctaattaggtttcaccgagatggtacccaattgggcagttttgtgaacacttttcttccattagctttttcagtggcttcctatgtaccctcagattctattaaaatttttctcaggatcttggccgggcgtggtgtctcacgcctgtaatcccagcactttgtgaggccgaggcaggcagatcacctgaggtcaggagtttgagaccagcctggcaaacatggtgaaaccccgtctctactaaaaatacagaaaattagccgggcgtggtggcgtgtgcctgtaatcccagctactccagaggctgaggcaggagagttgctcgaaccctggaggcggaggttgcagtgagttgagattgtgccattgcactccatcttaggcagcaagagtgaaactccatctaaaaaaaaaaaaaattctcagcgtcttattaagagtcagttttaaaatacttctagacttcagtgcacaggatggtttataaagcagcatttgtgaaaagtttgccattaggcaagtttctaaagagatctcaggagtcttaagttatatcaagtatttgccaaaacttggaggtgctcagtagtataattctggtagaagcctgaaaataaaggcatagagtttttactttgcacagtttgtggtcattcaatgtacttcaacagtggtaggactgtgaaatgatttgatttggtagtagaaacattcctctggtaaggaagaagtgaatgaggttatctaatccagggtgatctgaacaatgtcactaaaattggaggttaaagaactcaatatttagggtaacaaaaaagaaaataaattacagcctcaattgcaaaagatacctgaacatgtaatttttacaattacgctctgaagtgttggtcccactttgcagatggcttagcttagtctcacaggagttctagcagaggccttccccaacaacacagaactgagaaggagactgtctggtatttgaacccaggtttatgtcactgcagaggctttcagtgaaaagctgcctacccaactctattagagcccatgggtttggctggcagtataaagacaaagaagaaatactgagaaagagaaacccttcccctcctgcctcttttcctgttccttttttgtgagtcccttgcatcacagcctaccaccagattaatttcccatcatcttcattacttgtcctaaactcatagcaaattaaaaagttctagtactttcattgctcacagcacctaagaactaaaagaaatagacaactgatgacagaatatgaagtttaatagcattttctaacgaactgaaaattgaataaacccaaccacaagccagattcccagctactaaaatctccactacccttctcccaaaatctattttttctttataacatttacagactataataatgctgtatacataaacattgagtagtaaatgtcatcataaagtatttatgtgattttaaggggaaatgtacaaaagctttttccatcatgtacctcctgaattagcaatagggccaaaatccaaacgagtgaaaagtaattgtttaagacacttatacgacttctggtttatataaccatcaaaatattgcttctaagtgttagaagttgttctgctgtgtgtctgaagcatgggatcccagaagcaaatactcaagtagctaaggcataatgggcccaagtaaatttttgggattgatcaatgaattaattgagaaatactgagaaaatacacgataacttgacaaagaagagctttaaaaagaagctttagaaagagacaagtaaatgagttcatggtaagtatgagagagggtcagtattcttaatatataaagagctcttacagatcagtaaatttaaaaagggacaatagaaaaatgaggaatttgtaagggacatggatagctaacaacgagaaaaatggtcagcattattaatgattaatgaaattgaagagcagtgagatatatttcatttttcacattgccaaagattttaaaagattgctaacatcactgtcatatgcttctgatgggatttgtttactggtgaatgctttaagcacaatttagcagtatatgtttaaaattttttaaagcaagaatatatcatctgacttaggaatttgtatttgaaattcaggaatttaagtaaataattagaaaacgtgtacacaaacatattgtaagagagacaaatgtatggggagagaaatgcatacatgcaaacacatgagaacatttatcagcactgtttgtaattgccaaaaaaagaaaatctcaatggccaacaggatagaggattgattaaataaagtacacggtttcacatgataatcctagaaagttctgatatagatttatatgatctctaataattattaagataatttagggtatattaagaagaaaaattggttataggagatgtttttatttaatatatactctgcatatttgagtggaaaaagtacaacctaatatttctgggtggagagagttggagagatttcctttatttctttatttagtcttgatttctttgactcttctaacttttctagaatggtgagcatgtcttatgtatgtacaaagtgaggagaaagccacacagcattggtcatcgaatgatttaatccactcttaaaattctagaaaaagttatatcaaacaaatacttgtcttgcttgggtagtaagagccaaataatacaggtatctttagttcaacagcggcaccttctgtgttcagtagagtgcttaattagcacagtcatcctgataacatgaaatcaatccataaacaggcaataagaaatgtaaaatgaaaagagaaaaatttagagttcaaaagtgctcttgaggttaaaaaaatagttaaagctatgtctaaaagtgggggggggggttggcaattaatcttattactacatgacatcttaggtatattaacagtgttttatccagaatttataaatatcctgagttgagtcatattttagagtatttgttttttcataaatttttaaaaattaaagtcatttggatacatagtaaatcaaatagcattgaaaggtccatcaggaagaatgtactgtcaccccatcccatttccttatccagaagcaactactcagcaattttagctgttcatttgatagttacatccattttacctgaagatatatcattatttcttaatgtttcattttaaatattatctgttgacatcttgtaacatgaggacccatctttattataagcttgtctgcatacttttctccattctggcgatatagttatatgactttttttagtcattaagtgtatattgttaactttaaagccatagattgtactcaaattgtatttattcttttcattcagctctttgatttttcttcttttacttgagcatgttcttgagtcttaatttacttcctctaagggaagtaaattttctgagtccttaagtatctaaagtaaactttttttctgcccctacatttgttggatcacttgtatggaaaccacttgtgtgaaatcatttgctgtcagaattgtgaactgtggaaatcacttgtatggaaactcacttgtctgaaaatcatttgctctcagaattgtgaaggcactgctccattgtcttttactgtctgctactgttgttgaaatgtctactgccattgtcattcttccttgattatattctgcttaaaccctaccaccctgcacctcaaggaagcgtttaggatggcgactttgttccaggagttgtggcctttcatgaggatgctgggggcggcagaggcggtgctgtgtacttcattcattgtgctgagtactctgtgggtgttttaaagttggaaactcacaccctctgttatggtaaattttcttagagtatttcgttggtaattttttccttctattttgcagttttctctttctggacctcacattcattggatattggactccctttgttgattctccagtttacagttttcttctttcacattttctccttttcaagttttcattgtacattctcagagatcactcatcttttgtttctgatttttactgaattttcttttattttgacatgatgtttttaattttcaagacctctttttttattatttatttgtcataacatgctggttttgtacttggataccgtatcctcttttaactctgagaatgttaccatttttggttcttcaatttaagtttttctgttccctgcattatccatctatttttggtctcttttatgccaatattttctttcctcatatgtcagatgatccttggttattcatgtgtattaaattgtgggatgctaagggttaatttgtagctctgtgggcatgggttggagcttttaattggtgggcttcactgttttgtgattggatgaagtcagccttttttttttttttttttttttttttacttacctgcatatgtctgtatgtgaatgtcctttatctgaaactggtttatttcttcttaaaataatcttctgctctcttgtccaaagtttagacaatccatctgctaatgagattgagaaagggaattattggttcaactattccttatttcaagctacagttcatttcacctctgccttccagtaagtccccaaatctccctcattctttttctccagcaaatacaccagtggtttcttgctttgggtgaggactggggagagtgtatacatgtggctgctggaattctttacatttagatgggcatggttttatatttagactttcaacctgtcccaaacttctcttctgccatttgtcttacagggacattcagtctttagcgtctccagggactcaggtttcttctcattgcttcagtgggttcagttggcagactctgcccctcagttattcctctccagttttgctggccccttgcttatttgtgtgtataggttagacatacttctgctgcagggtctttgcattcatgaaatgcacttactacatatatactcatttttttctgccccaagtaacaatccccaaatctgaagaatttgtattacttaaggattgcaggttggcagtggcattcctgggattggcaggctcaggtccacacatctcatttcaagatccaggtaatttttctggattagatggttttcacggtagagggcagaaactcaagggaggacagagccaaatttagccaatgcacttaaagcttctgtgtagctgtgacacaccctgtgagcccatattccataggtcaagacaaattgcatgggaaatatgatgaggaaagaaaaaataatgagtaattcaacctactacaccccagatatccacgagacttactccttacttccttcaaatctttgttctaatatcaccatctctgtgatgccctccctaattccaccctatttaaagttttattactcttctattttctgtttcccttccctgatttatttttgttcctaacacttcatactatctgacatattatctaatttacatatatatatatttttattttatttactgcctttcccaactagaatatttgtaagcaccacaagcccagagatgttggtttttgtttattactgtgtactcagtacccagaatagtgcctgacgcccggaaactgctcaaacatatctaaatatcccttccttcccatggaacttttttttttttcttaaattttaaaatcactcatcccctgatgaatctgcatccattttctttggtttttgtggtttataccttcactattattaaaggctctgtgcagagagagacgtaaatgctttttatcaaattagccattcttaactacaaatctgacttcttaaatatttattaaataaagaaagactcttgatttaatgtgctggctttcatacaaattaccaaatacagatttgattgggatgtttctccagagttaagtcctctgtaaaagtgttggagtaaatgaattacttagcataatagctatacaagatatgttttggttggtgatgccaccctctgtgaataggtgatttcttgtttgtccttcatttgaaaaagtaacataatagtcaacctacttgaaagcgaattagttcttattcgcatgcgaatgaagaggcctaggtgggattaaaagcattttctattactgaatacatatggcgttcgtaatttgtattcaaagacctgtttgctatttttggcatggcttccaacctcataaatgcaaaaagcagctccacttcttatagcaatatgccagcctggtctgtcaactacagttatttcccatcagttattcatagtcttagactttgtttcagtaaattgttctgcattgtttactgccctcactacttattatctccccagcccaggtcataatacaacagatacttgggtatcatgatgttatatattcttttccaactcagcatggtgatattgggagggtgatcttattcctgtttttcatatgggagattgatgaaacttgtttttcattttttattacatcataatacttatttgctgacaaactcatcaggactctgagggagccataaatttgtatcagtataatcaatattgatggaaacactttgaaactcctcctgtagaattagagtcagcttacaagccacattacaatggtcttatgattatataccagactcttagttctatgttaatttagtatgaatgtctatataccctagcatttttttactccaaataatgtttatttcccaaaataaatttcattctgcaaagatgaaaatctgtatcacacctaaaattgtgcaatacagatcttaaaactgccagatagcattccaaagtgcttactttggaaggaaaataattaaatgtctaaattattatacatttttttaaagatttctttattgctgtaattcttactgcttcctctgcttttccttttattttattttattttactattactattatttttttgagacagagtttcacccttattgcccaggctggagtgcaatggcgcaacctcagctcactgcaacctccacctcccaggttcaagcgattctcctgcctcagcctcccgagtagctgggattacaggcacccactaccacgcccggctatttttttttattttcagtagagacggggtttcaccatgttggccaggctggtctcaaactcttggccttccaaggtgctgggattacaggcgtgagccaccacacccggcctgcttttctttttcaaacccaaatcttagattcagtttcctcatgacattgtcaccaccttgatataaatcattcctttgttgacattgtcatcatgtgcttactgaaacatgccctacataacaaggtagaaagagacaggcttcggatttcttcctgttaaagcaaagcattaattttctctaaggaaaggtagatgttgagtgtgaaataaacttaaaagaggatgcatcacatataaaatcccagaatgttacaagtggaggggacctaagatgattgcaaataaagataaatgcaacagctgtggtctagaaggaggcacaaattattaagagctcagcaagacggagtcaaggaaaaattctgactgagcatgaacagtgtgttgcttaatagttacttaccatcggcttcactttagccctgtgcatatgaccccgaaaccatgtttataatgtgtaagcccctttgattgtttttgtttttgttctgaagacgcttgctacttttgaaatgttttccatatttagagataatacggtgtggtcgaaagagggcatattttggagtcagaaaacttgaagttcaatcttgtcattaccttaagctaaatttctccatctgtaaaatgggagtagtaacatttaaataacgattaaataataaggagaagtaacgtaggaagagattcaagcactggcctggcacatggtgcttaaaaagtgtcttgctctttctctctcccttctttattatttaataaaatttgtctggtatgtgtattataatttgtacatcttgatcttatatactgtattaaaattaaaaaatagtcaaaagctgaatgcctggtctcaaatattttaaattctggttgggatgtaacataagtacatgtactccaaatatatttacagagtaggttttattaaatgaactaatagatattgtacataaaagattaaagtgaaagaatgatcaggttgtaaggagtatggagtaggtgaacttggcgctgtatacgaaaaccttccatggaagagctcgagacatctttttgaacttccttaactctgttttgatagtacttaaacggtcaattcgatggttcttcataccttaaagatcactggcctttattatcctgatagtagtgaatataagcatgttaaggttatcttatctgtgtttaatcttcataggcacatactatggaacatctttatctgtcatattcatgatccgtgaagcctcttttgaagtcaggttgcatactgcaaaaaagtagagctctaaagtaggtcacagtcctaagagagacactggaatcaacatctgaaattgaaaagctattctccattcgtattaagtttttaggttatcactaaggaaaaaaaaagcacactaaaattagatgaagtaaaagaagcccgagttattcaaaatgtaaagaccttagaatgaatgctaacatttttcttttgccctttttcttccatcattatgtctaaagattgaagttagtctaaataacattaggtcccataatctctgagaatttaccagctttactgttttctttttctttctgttccaagtacatctgcccttatgccattactcttgtcagaaactcattgccaagtgtctttaaaaatcagttactgtggagttacctatttcaaaacagaactaacccctcagtttgatttttcaggagtcattctttcataggcaattccgtcagaattttttttatataaatcagtgtgaaagcattggattttcttaatacagtcttgtccaggaagctgttaaagctttttccccattgaagagagaacactaaattgtcagtatgtactcattctatgggagaagttttgaaagcagaggtttataaattttcaacttagagaacgagattctttgcaaaagatttggtcaaatatctggaagtcttccacttttgaaatacagggcttccaaacacatttcttcaaatgtcttctatatagttactgtcttttattttggcaagttatgccaaagagacgaaatagatcttagagaccttagaatattaatatccttaggttacattcttatagagtatccactaattatttcacatacttaagtgatgaatatattagtatcttaaattctagtttggtcatagagatttgtgctttcatgggtcctggagcagatggttgctgtcccccgagtggttcatactcaggctctggtatcaggtttcctgggatggaatcctagttctgtcactaactaactgggtggactgaaacagttcatttaaccctgataggcctcgtctttgtaaaatggggataaatactacctatcttgttgagctgttataaggatgagacataccacatgtaatattgacaatgcctggctcacagtaaatgctccataaatgttagccatcattattgttgttattgatgatggtttttggaaggctcacttgaattttctcagttataaatattgtgtagggcaaggtctgtgaaccttggtttcattaaagtaactattcctataagagtatgctccgctgtgattatggttgtataaatctcatttggcaattgagtaccaataatacgatagtcatagattaggtataactatctaaattgaactgctgtcaacaactactgaaagagcattttgcaataattatcactatcatcattatttcaacttcatgaaatccatgaaatatttatctttccttatatctaatcagaatgatatactcttagatatcacataggtgagtaataaatgatagaatggggtccctttcttctgatagatgcatattagtatattctgatataatgatatgcagggtactaattagtgtgcaattaactgtcagactttgtgcaattgagtgagaaagattttgtgcagttaaataaatgatgaaatgggtcctttcttctttcctttgaatcacagtgacaacctaacttagactttcaattaagctttccagcttcctacctgtgttcttgtattggtttcttaggcaggaatattttctctgcatggacagaaacagttgataaactcaactccaacagagaaataaattacatgccagctataatgagatatgaacgtccagtaaattttcttttgcatgtaaaaatgtggcagtatgaagtaagagtcaataattatttattgttaattccctaatgtttgcttctgatgcacatgtaaattgtgatgtgactaaattgaatggaattatccgttatttttaacatattcactctaatgcacatggatgaaaatgactgtgataatctagcagggatcctttgtgttttggtgaagcatgtaggtccgcatcctgcagtctagtataaatggatttcaaaccgaatttaatgaaaattacctttgctgacagtgagcctgagacacagatggtcactgtatcctcagatgtgtttaactccatttcagtggggccacctttgttgtttataacttctaggtatagattcttgtgggagttccaagatttgttttaagcagtttttcctttcttaacaaaaatagtaagcaccatataatgcttgcttcgtttcagtgatattttttcattcttcactctctcttgcacatttatttgatgctcaagtgatgatatacaaatcactgagaatattatttcctagttttctggaatattagaaggacaatattacatagaattttactttcacatatataattatttcaataatgttgccagaagaattgagtatctcttctgaacaaatgccgtgtctaagaacaagaaggatagaattaaatcaatgaggggatggaaagtaaaaaatgggtcagacgcagtggctcacacctgtaatcccagcactttgggaggccaagacaggcggatcacctgaagttgggagttcaagaccagcctgaccaacatagagaaaccccatctctactaaaaatacaaaactagctgggggtggtggcgcatgcctgtaatcccagctacttgggaggctgaggcaaaagaatcacttgaacccaggaggcagaggttgccatgagccgagactgcgccattgcactccaacctggacaacaagagcaaaactctgtctcaaaaaaaaaaaaaaaaaaaaatgtagggagatacaggtatattgtttgtaattcagatctaagattatttctgaacctgaaccagaagatagacatttgaaacagaaattcacactgtcagttaagatcttagttgtgtttttgccaaatactgtaagattaaaacaaattctccaccaagttttagcctccagtttactgctaccaccatagttcagtcccttcagttggattatttttgttttgttttctaataaaatggccagattaatctagtttacattgctttatcaatcactgtgtttcttagaaaactacaaaagtatcctcatttcctctccatcagtactacctgttttcttctgcgcaagccttttttgctctagctcgcctctagccctctagccttattttctctactctgaagacaaaccccttggctttggttagctcctttacaatgtgattatgtcatgtcccacttgcctaaaagacttctcactataatccttagttttgaaatcctctttatcttttaagggttaacctctagaattgattaattttctagttattccagttctgattggcaattctatgctgttaagttctcttatacatacatgtagcatttaattatattatggataatgtgaatcttacaatcaatgacatttccctatttgtccttaccactaggaagtgcagggctgagttatcggccagtctttagttactgtagagaatcttcgacatgtatttctgcctatgaacttcccctatagcattgtcttaaccataaagcttcttttttgcaacatttttttctaatgttataatcttattatatattctatcttcttgtaagccacatcaaatccttattaggagaggcagtcttccatgggatctgagcgcatcctgcacacccttgctggccttgccaaaaatgtaagtccctgactgctctttacccaggagatttctcaggatggtttgtagcaagaaaccttgagagatgaggcattagccaagagcaggcttgttactacttactgtcaaacagtggattccccaagctcagtgttcctcagctgtgacaagcccattgtgtgcatagcatccatttgggcctgccagagttggggaacaaagggaccaacgtacaatccaatactcatgctgcttgctgtgctatgccatgagtttttgccccttacccaggagttttgtgtcaccatttatgacagcaggaggctgtagtaggctgtaattaggataaaatcaaatactatactaatactcatttatggaagatagaaactgttccataaattaataaaaataaacgtgttttgagcctttcaaaccaacccactgtgcatatcactatcctgaacatgctgaacatgtaattagatgtcagtgtatacttattatgctttgaagaacttagcttttatggaatcatggcagctgcaagagtaattaaattgataatttcttggaattatgttgagaagacttaagatattaaaactggctggatttgtctgcttcaactaaaaagatgaatagagaatatgtttaacttcaccttgcctctgagaggtttctgaagagaacttcagtgtaaaatttagtgtcttatttagttatctaccttagtctgtgttctctctcctttcatcagttgtgttgcttttttccatttttaaatttcattctcactggaattttgagaatgtagcatttgtaaatgtgaagaaaaatcagtaacataattttcaatttgtttaggttttttaaaactatggccttaaaagataaaattaggatcatataaataaatgacatatgacctctgaaggactgggtagaaaaaaattaatatttattgattaactagcaagtgctaagttcttttaaggtgctttacatgtattatatcattaaatctgccaataatctaagagttaagtattattaaaagaataaactagactattagaaaatgacactaattagatttaggtaactagcccaagttcatactgtaagtagcaaaagaagactctacccaggtagatcagacattctcatcaaaggcatggttcttaaccaggaactctcatctcctgggatagtgaaagtaaaggaggatgtggaagagactatttcatattaccagaacctatttttctgtcttccttgataaggctacatttcccagccctccccactcccttgcacgtaggtatggacatgtggctagttctctacaatggaatgtgaatggaagtgaggtaccaggccgaaaatgggccttctccatggtctctttttatttgctaaacggtaaaagcaaaggacctcagggaccgtagaagatgacagagtcaccagatgggaagagcccacgtctgagttaccacgtggaaagttgtcccattgaacaccagcattagactaaggttagaatgagaaagaaaagcttttgtcatgttacatcactaatatttcagggtttatttattaaaacagctcacattaccttaccaaaatagatgggtatgatcaaatgtcactactaggagcattagaggattttaaatatttgatgaaatcattatgacattagttatttttgagacttctaaaacatttgattattaccttgaatatatgaacgaaaagtattgtaattgctttataagaagaaaaaacactctgaaaataagagcatattgggagtgatatccagatagtcgtgacctggtccttgaactgcctctgtttaatctggggcaaatgacttaatccctctgagcctccctctcctaatgtgtaacatgaaacaatctaacctctttagggtggcagtaaaattgctataggctaagagtatacagaaacacagtagtttgtatactccttgaagatcaaaatagtgtccagtttatacgtctatactggtactgttttagcacataagaagtgtcagtaaatattgaatgaatttttggtggaataggacatgatatccttttagaaaacgttttggcattttgagtcaaaagccataaatatatatattcttgttgtcccagtattaatgcttaggatatttatgaataatccatgggaaggaagaagtgaggataggatagggttgcagaagcctcatttcaacctttggaaatagtctcagtgtttaactacagtggagtaatttggtaaattttcataaacttcacttgctgcaaagttttcctgctattaaaaggcaagtaagaaaaaccatattcgtacggtgaaagtttatactagaaaactatcagaagcataaaatacaaaacagctacatctttactaaaagcctggaaaaattaaatgtatactcagtaaagaattagaaggaaacatacatagaaaatggaaaacagtttgatatattagtgataggattatggaattatttttttctttcagttgcatttgcaaacaagatgggagaagaagctggaaaagaacataggctacctatttaaagatcctgaatgaaaaaaaaaaaaacctttgtgtttcattttgtaaggtttttaaaaaatagatctgggattaaatctggcttttagaaagataatttgtagtaagagagttagtaatagggagatggattagaatattactgcaataattcaggtgacagatgtggaggaactgtgtttcttatttcctgcgttttgttgctgtgacatctggggccttgctgaccctggagggactgcccctcctagtgtttgccagttctagagataataaataactcgcccacaagtgcacttttccaaaacaaatgaatcaacccagagcgcacacctcaaccatctcctttagtgggctttcacactctggtccattatccacctgccctgatcaccccagggccaggtacagagagctcttgtgcctcagagccaattgaaaatatctaaactaccaatcctaatgctttttactctgttttgcccatttcttcccaaggaaaccacaataaaggcttgtttagggtttcccctctctccctctgcctcctaaccaaccctgatgcttctttttgtggccctgttggggcggcatgccccctcctcttgggaaccgtgagtaacaagctgtattgtcagtggcagtcaccttctactctgctggccttactacacctcagagcttccactagtacactatatttttaaactaaatgttgtgcgcctaaatgaaagcagtgaaaatggggatgaggagaaacattcagagatgtgtaggagtgagaattacaggtttttgatggtgttaggatatgaagagtagggaaatggaaggagcagatgactactgacagatttctagcttgacagtattaactgtgagaaaacagactaagaaaaagaggtttcaaaggggaaagataataaattcgatttggaacctgcagagtttaggtgcctgaaagacatccatgtagaaatatctagtgagcagttatgaagatgtgtcctgaacagtggttttgaaacttttatgactatgaaacacagcaacaagtccattttacatccggccctatatgaagatatgatttcatatttcacagaacaatacgcctttcttagtgtgatgtagtctgatagtttctgtctgtgccattcattttgtttcattttttgtgtgtgctgtaagccactaaattgagttcatgaactactaaaagggcacaactcactctttggaaaacactgatctggagcattaaaaaaaaactcagacttggagagatttagaagtcataaatatacagatgttagtttaagctatgggatattttctaggggctgagatgcagatcaagaaaattgcccagattattgctccatagaataccaagcatttaaaatttttaaagcttacagagagagaggaagcagcaagagagagtgagaaacaatagtacatcctaatagtagactcagtcaattaatattgagaaaccaagaaaggagaacatttcaaagagggaataatcagcagtgtcaaatgccaataatgcacaataattttttatccagactaagaagacaatttatcatttaagccgtcactgatgataagtgaaaaagcaatttcagtagtgttctgggggagaataggttgcaatgggtgggaaaaatgaatcggaagtgaggaaagtgaggcaaagaagttagactgctttttcagagagtttggccttaaagggaaaatatattgatgtgggtgacagtcactaagtgaggcgcagaaaaaatccaagtgaaaactttggaacagggtggtttgtcaaggatgcatgttaaagacagaataattgtttgctgaatttttttgaaaaaaatagatgagagtgatgaacaggtggaaaaacagtaggaacaattaaaataagattacagccatttcagttatttagcttagaaatggacagcctagaaactgatagcaagaatcatctaataactgtagccctagattagaaagatgaaaaagtagtctgttgtatatatatatgaatacataaatgtatgtacatatgtacacaatatgtattttattaattactgtatataatatttcttaggtgtaaattagtttggagagacttaatatcaacctccttaagcagaaggatgaggtttaatgtaaggagaggagacttctgtaatacatatttttaatacatattttggatgatttagaatcagtcacctaagagaaatggaataaattactactgtaagttatttacaattctatgagtttgtgatgtctgtgatacagtaaaagtctaatacccatttaaaaggtttaaatagaatctgctacataaacttttcacattttacattagaaaaccttgtgattccacacacagctctaagaagcagctctataatgaccacattttcaccctacattaatctgcaatttcaagtcatagcgtggttatgctacagcaaaaagtttattgttgagtccaggagaagagcatgtcaatgcaaaagtcttaacatgatgctattttatcacaaatttaaccatgccattggtcagctgtgaccctaggcagagagttgactaaaaatccccacataatttgttgtgggagaatgcagtggttaattaatgtgagtgagtagaaatagcactggactgtgagttaggaactattcattctgcaaaacatcaaataagtcaatctcatctttaaattgaatgggaaatacctgtacttctatctcacaggcttttgattattattcaatgagataatgagtgtcgaaatcctttaaaaagttaacaaatgtataaacgtaagttggtagtattgtggttgtcatggttatatctactgaaagcactactctcagatttgcttaaaacagaaagttccagggtgctttggctaaatcccaatggtacttttataatgcctttattagttccctacctcacggccaaacactttttattagggttctttttcaaagttattacgaattttttttagagttggctgtactttcccattatttcataaagtctgtaacgtgtaagcagatgaattatgcctgtaaggccaggcgtaatggctcatgcctgtaatcccagcactttgggaggctgaggcgagtggatcactttaggtcaggagttctagactagcctggccaacatggtgaaaccccatctcctctaaaaatataaaaattagctgggcgtgatggcacacaccagtagtcccaactacatgggaggctgagacaggagaatcgcttgaacccaggaggcagaggttgcagtgagctgagatcatgccactgcactccagcttgggcaacagagcaagacccagtctcaaaaaaaaaaaaaatgtaggattattgtatatcacatgaaaaaaaccagagagttgttcatgttttctctggggtacatcctctttggagtaggaagaatgagtgtatttcatataagaaaaaaaataaggaatttcaaggcaggtaattcctattggattataaaatatgagacctgtgactgattcttagattttcaacagaaaaaaagataaaggaatagaaactctgcattttgaaagaacttctttcatcacttttactatggagccagaagcaaagatatgtccaaacccagccgagaatataaaaaacatagttggagacgcttatggaaacggccaaaaccataatctaaaagtagggaaaaggcttctgaagtgtcgtgattgttgtctcagagcttcacggtagcactagaattcagcaggctcttcggcctcttttctgtagtctgttatttggtttaaaaaaaaacaaagttcattcttttttttttttttttttttttgagacggagtctcgctctgtcgcccaggctggagtgcagtggtgcgatctcggctcgctgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaacaaagttcattctaacataatagataatagtcaacatagtatggttctaggagaagagattgaagtttagccaatttttataccttatttgcatacctatacttaacattcatcttcaattatttcaaaataatgtgttgcaaatactcatagtacactgaaaaagctgtaattctactaatgcatataaaacaaatttagaagtatataaccatgagtgaaaccacacgttaatctacctggaaacaaatacaaatagtcccctacatgtccaaacagtgctgcctctgcttgcttcaccaacaccactacttgatgaagactccctagatcctctttttcttgatctttttccttctcttttctttttcttgttctttttgtttctgaagccttggaagccttcaattcatattcataggagtctactgtgttcatggtgcctgggacctcatagtaataaaagtctttgggaatcttattggaatcaggtacaccctggaaacactcaaatcatcaggaaacaccagacagtataatagaaggtgactgtgataggcagaattccaagatggcccccaagattcccacccctgggtgcgcccattctgtatgaatcgtgactgtgagtgggatctgtgaatatgatggaatatcactccagtgagtatcttatgttatatgggaaaggggtttgtaagcataattaaggtccctaatcagttgactctgcattcatctagtgggagatcatcttgggtgggccagacctaattgaaagagcccttaaaaaagataagaagcagcagcagatgctttccagttagcctaaaaaaaaaaaatagcaaactgctgtgttatgaagctgctgttagagagaggtggcctctagggcctgagggcctcagtcccatagctgcaaggaagtgagttctgccaacgacctggatgaattgcaaggaaatccccaaactctagatgagaactgcagctcagctgacaccttgatttcaacctggtaagatcctgaatagaggaccagtaactcagacctggaccttcctgacccctgcaaactgtaagatcataaatttgttgttctaactggctaagattaaatggtaatttgttacttagcaataaaaaattaatatagctacacagagaataaaatcaaagagtacctgagaatcccaaacctattaaggaaaacaactaataataacttatttatttagtacctgctgtgtacggggcatatactggaagttttttctaattctcactgcaggttttatgaacaaaactaagactcagtaaaatgttgaaacttacccaagttccttcccagtccacccattacactgtccagtgtggtaaccagtagccaatgtagccatcaagcacttgcatagtgtccaagctgaattgagatgaactgcaagtgtgaaataaacactgcattttgaagctttagtgccaaaaaaaaaaatgtaaaatatgtcaattattgttatgtattgattccatgctaaaattaatattttggatctctcatattaagtaaactgcattattcaaattaatttcacctgcttttaaaaacttttaaatgtgggtattaaaaagttacgattatgtgtgtggttcatttatatctctgttggaaagagaagaatttgaaaaacaagaaagaaaatgaaactcacatcccactactcagaaataagcattgttaatattttcatatactcccgttctgttatttttaaggtagaaatttttctttccctctccacagtttatttcagtatctcaggaaacatttgtaggggcaagagaaagcaaccccaggaaagcttaaaatgcttgcctgagacgttacatttgttaagtgaaggagctgaaatccaatcccatgtctttctgagaattccacttctatttgcttccaagacctgtgctctttctgctgtagcacagtacatctcttcaaaaacctttacaagaaaaattaaaagatgacttacagtattacataatccaaagtattgagcagaaaagaaaactcatcagggcctgaagttttacatttttatggatagttttatttgggaaggaaatatttctatatttcagaatttctaacggaatttctaaacattggtgactacttatgtttatacagttgttgtatttgggaaaaaacctctgtatttcaaaatttctaagtgaatggctaaacattggtgactaccaatgtttataggattgtttgtaatttttttcctaaaatttattgaagaggtataggtgggcaggggatgctggatatagttaatgttggctgttaatgctagcaattattaataggtatgtatagaattaagcaaataattgctttagagataattttttaaaaatgaaatttgaaggaaaagaaagatacagataggaaggaagaacgaaaattgtcttcgtttgcagactacatgatcttgtcttagaaaatcttaaggaatctttaaaaaaaaatttctggttgagcaaggtcataagatacaagaccagtataaaaaaatcaattgtatttctacattgtagcaacaaacagtctgaaaacaaaattaagaaagtagtcaatcaatagtaaatctagtctctgcattagcaggttcatttccaccagaggcaaatagaatccttggtgtctagacaagcccatagatgtgtatgtatttagggtgtttggtctcaacttcaaagatttcatattgcttttgtttcagaatatatattagtaagttttgagcactcatttctgaattttactgaaagtatctcgtttcacatattagctttttcaaaaagcagatacaaaagagttttgcattaaattattcctgctaagtgtatgagctggcacaacagcttggctgctgcttttatggtacaacagatgttggcatttcaaaataaacataaacttttttccctagaagtaaatttccttctttataaattagttctggacaagttagtataggcttgtatcttctagagagtttgtgatttattagttttataacaaaatggcttaaaagaaaaataattatagtaccatatgaaattcatacatcagctctttccttctctcatgggccatagttctaattattttttctaatggtaattgataaccaggtgaattcccttgccgttgcagctttatagaatttttttgctcttagctttcttgggaataatagaaaatctccaagttcaaatatatgtcagactgatgtgctccttctgtacatagataataactttattcagaagcctgttaaagatggctttcattttttatttcagatttgcatcagaaaggtaatgacagctcattagcccttgaagcatctaaaacttagaaaatatatttcacaattcaaggttaaatgggtcatcatcagttatgaaaggaagtatcatgcactctgtagaatgtttcacatatttcaaagtgttatctttacagggaaacacgtcaccattcttcttcagagaagcaacttgatgataggaagatctatcccatcttatcctttcatatatttatcaagatttggctatgtagacttttcctgagggaagtctcacactgactttagtagttgtctttggtactaaaacattagatgaaaaggattgtacagttataaattatcatgctttgtttgtgcttttggaacaatgctttttcatactgcaatatttgcatgtagagttttaattaagagataactgtctccacaggttggctgcagaaggctgcaatctccagcagggagataaatgccagtgccaagtcatacaggttgggtagcaaatgggggggtcgctaagataaaatgggcttgaaattaaaagcatgagagtcacttctttgtactttaatgaaaagtataaaatatttttgatgtattcatttatttttaaataattccctatttttaatgcgtttcaagagtatcctgaatgttgctgcctcagtaggatatttttaaaaaatttcagcatatggcttatttttctaagcaattattatttaactctcaaccaggaacgttatagtccatgacagtttttttccttgtttttccctgattcgttagagtcaagattctcttcccatgttcacaaacgaatttttcttacaagtgacctagatcaaacagaaaatagtctttattgactctagaaaaatcattcagaaaagagacttatatgacgttctaactcagattggctcttaagaactagtggctaggaatgtttcatacaggaagggaaaaaaatttaaacattttttattgatagagctgtacgtgtttttaagtacatgtgatattttgatgcatgtgtacaatgtgtaaatgatctaatcagggtaattgggatatccagcaccttaaacattaatttttttctttgtgttgggaacattataattcttctcttctagctattttggaatatacagtgaattattattaactatcatttccccattgtactatcaaatatagaacttaatcctcctgtctcactgtattttcatgtccatcaaccaaattatcttgatctttttctcccgctttcactttgcagccactggcaactgccattctcccctctacctccatgagatccacttttctcagtcccacgtatgaatgagaacatgaactatgtgtcttcctgtgcctggcttatttcatttcacacaatgacctccacctccatccatgttgttgcaaatgacaggatttcattcttatggctgagtaatattccactgtgtatatataccacgttttctttcttttttaaaaaatttatttgttttaaattttactttaagttctaggatacatgtgtagaacatgcaggttggttacataggttacgtaggtagacatctgccgtggtgtataccacattgtctttatccacttatctgttgatggacaattaggttaattccaaatcttggctctcgtgaataattctgtagtacacgtgggagtacagatatgtctgacatactgactcctcttggatatccagcagagggattgctggatcatatggtagttctatttttagttttttgaggaaccttcctactgttttccataacggctgcactactttacattcctaccaacagtgtgtgagcatttcccttccttcgcatcctcaccagaattttttgtttttttgtctttttggtataacagccattttcatgggtgagatggtctctttggggttttcatttgtattttcctgatgcttcatgatgttgagcatttttttatatacatgttggccatctgtctctcttgagaaatgtctgttcaggccgtttgtccatttttaaattgaataatttggcgggttttgttttttgtttttgtgtgtgtgtgtgtggttttgttgttgttgttgttgttgttgttgttttgctgttgagtaggcacatgttaagtaatgcttaattgagacctccacttccagtccagacacagttcatagaccaaagggagaatgctgttgccaccaaggctgtacttctgatcaagactcactgtttctcctttctgcttttaccctgtcaaccaattaattatgtctgctttgtcctcggttatgttagccaattataaccttttttggaacatgtaaggttcctttgtgcataatgtgatgggtaggggcaaccttccattccctgttctcatagtaaattagtgggtactgagaagagaagagaattgctgtattgtagtatgacatagcataatatagcataatataacatgacatgtcataacatcgtggaataatctaccttctccattaagtattaaaaattagagaaaatgttattccccaagaagaagctctgggcaatttgaagctgcttgtgttagtgacagtataggttctgatgtcttttattactgtttgtttcttggttgaagattttctacatatatatcacttacagcatacctggattggaaggggcaagatttgagtcaactccccttattttcctatttaaaaataattattatttcggagagacaaattgaataattgaagagaatagaaacaatacattttactttattactttcttttataatatcatataaagattctataggatatttactttcctcatatgtatcataacatactacaaaggaatataaccagtttagagggaagaattttccgtaggaaaaaaaagagctagaaatctgacatttcatgcagtccctttcatatcactccttcccattacctctgttattcgtcactttcctgtaacttggatgcagtcatcctctttttacgtttaaagtccagtctattagaagacaatagttgctgaagtttatttggaaaaaaggaagaacgtgctcacaacaggagagcaaaagtcaaattgtacaattaattattttgccaaatacttgaatgggttatcatttcaaattggtgacatgtcaaaaatcttgcattgagaaccactataccatcttttaattcattcagaatggtgggttaatatacctccacactgatgagctttttttttttttttttttttttttttgagtcagagtctctctctgtcacccaggccagagtgcagtggcatgaccacggttcactctatccaccacctcccaggctcaagcaatctttctcaagcctctcaagcagctgtggctacaggtgtgcaccaccatgcctggctattttattttatttttttgtagaggcagagttttgctatgttgccagagctgatctcaaactcctgggctcaagtgatcctcctgtctcggcctcccaaagtactgggattacagacttgaaccgtcacacccgacctgacaaacctcttttaaaaccaaactcatatttgtaaatccaaactcagagtcattgctttttaagacaagagggggccaggcacagtggctcatacctgtaatcctaaactttgggaggccaaagtggatggatcccttaccccctggagtttgagacatagtaaaactctgtctctacaaaaaaaaaaaaaaagaaaagaaaagaaaattaaactacctgggcctggtggcgcgcacctgtggtacggtcccagctacacaggaggctgaagtggaaggattgcttgaacccaagaagtggaagttgcagggagccaagatcacaccactgcactccagccttggcgacagagtgagaccctgtctcaacaacaacaacaaaaaagaccagagggaataaaatttcatgtgaggaaacaaagacccaggaggtgcacagtaattttcatagtcacagaggtgggccctagtgtccttgagtttagcatctgtacctgccgattccctgcctctgccttgagtaaggaacgaatttagtagtcaggaaatttatgaaagaattgcccatagggctgttccacaaagtggactccatagtctattaaaaatatgatcttaaaaattaaaaacaaaaacaagctatagcagctgctggttgcagacataaatttaatcctcacagccatgctgttggatgcatattatctccagttttacagattaggatccagagacttggagaggttagttaggtgattaacccaaagtcatacagtaatagttgccaaaacataaaattcagcctatctgacttcaaagaccaaacactttccatcacactatgctttctctcctttatacttttcaaaaaatccatttctgatgaagcaaagcacatgtatgtgacttacgaatgtaatgctgctatagagttgtccagaactgtgtgtatgtacacccgtccctctgacatctgccacgtttgggagttgtagtaaggaatttctgttgcccttcgagttctattgtccccatgtgtattgattgcctgcaggagtttagttgtcaaattacttgcctctttgtcagttaacagcattgtttgcttgagtggagtaccatactcaaaatgaagccagcaagatttccaaataaaggaaagacattctgataagtaatatggaaatattcaagcctcatgagaggacataatcaggaaaacactgaacaactcattactgatttagattattttctgcagtttccaatgcctgacacaggttttcctattgcattagcctctttctttctttccttttttgtttttgtttttttgagacagggtcgtgctctgtcgcccaggctggagtgcagtggtgcgatctcggcttactgcaagctctgcctcgcaggttcacgccgttctcctgcctcagcctccccagtagctgggattacaggcacgtgccaccacgcccggctgatttttttgtatttttagtagagacggggtttcacagtgttagccaggatgggctcgatctcctgacctcgtgatccacccacctcagcctcccaaagtgctgggattacaggcgtgagccaccgcgcccagctacatttgccgctttcttatgtatctcgtagaggcagtccctaactatcccatttcaagtgcaccgcccctctcactgtcctgttgtgattggtcgtcccctcagtagtgctgtacatagtctaatcgtatgacattccccttcttttttcactttccttttgccaaatcaaacacacgactctctcttcttcctttagtgggactctatacctgacatcgttgtcaggtatagacatgcactcaaagttaaaggaaattaaaatgggaaaagaaaatagtgggaaggaagaatattactttgtttagtgtctgcaaccctcactagaatgtaaactccatgaaggtcgagctgtaattgtgttttgttcacctctcaaacagagaacacatttgctgaatgaccgactgaataaatgaattgcactaatttactgtggagcctcaatagctgctcatttctcttaactattttacttgctaacggatttagcatggtagtacatctttattcattaacatagacaggtagctaccgttctcatgctggcttgttgaattgtgtgatgatagtcctgaatctatgtgatgatagtcttgaggctgtattcactactatatgtaatattattggttacttgtctctcttttaccttcttgaaactaattagccctttcgctcctttctgagttctttaatttttttttttctgagctcctaatatggaaatctgctggtatgtataatacatctgacaaatgaaatgtggataattatattgtttttctttagagatataatgagttgtctaaagtattagacttgaaagcaaatatttcaattaaagaagtcaaaagtagttaacaatcaaaggaggtaatacagtcaaataaaaagttaggcaacagcttcttaacatacatttgctatttgttgcctaccttatttcctccaattttgaaacatacttttgttttttaactttctgaaattgggatgtatttccaaaaagaaacttgcttgctgccaggtaagaggaataaattatgacgcggttgtcaccatggtgctatacctaattacagatgatcaagtcattcagaagaatcgttagactttaaatgaaggaaaggctcgtgattgtgttactaaaacaaaccaaaaaaaagggtatttaattatgtagattaaggggaactattatctgttggtttaaaaaaaaaaaaacctaatgatgtacctgtatgtatacattaacgtggcattttaccctgtgtaagatgtaattaaatggatgattaatgatgttacaattcatgatctcacagatagaagaaatatagtgatcgtgtgaatttggataggtcacttaacctttctaaacattgattttctcacctgtgtaaataaggagttaagtcaaagtttgttttttttggttgttgttgtttttgttttttttgtttttgagatggagtctcgctctgtcaccaggctggagtacagcggcacaatctcggctcactgcaacctctgcctccggggttcaagcagatcttctgcctcagcctcctgagtagctgggactacaggcacatgctgccacgcccggctaatttttgtatttttagtagagacgaagtttcaccatgttggccaggatggtctccatctcttgacctcgtgatctgctggcctcagcctcccaaagtgctgggattacaggcatgagccaccaggcccggtctaggccagagatttttaaaaatcctttccaaccctaatattcttgtgttcttatgttgaaaatgaatcttgaaaacttagcaagattttaaaagtttgtttttttattttttgagacagtctcactctgtcgccaaggctggagtgcagtgtcacgatcttggctctcggcaacctcctcctcctgggttcaagcaactctcctgcctcaccctcccgagtagctgagattatagacatgcaccaccacgtccagctaatttttgtatttttagtagagacagggtttcacagtgtcggccaggctgtaagttttaatcactacttaaaatcacattctctgtggcgcaggggtttctccagtgcctgctcctagaatcagtttagtagaggaagatatacaaatactgtattataaaacatttaatgaaattacagaattctgaagaaaaaataggctatttctctgatctatgtatgtgttttaggggaagagtgattcttttttatcagcaaagaccttaaaccaaaatctgagaacaaacaggagtctcatttattcatgcaaaaatgcttcttttattacaacagtttattacggtaaattatgcattaaacaaaccaattttgtattactatgaatcactcagtatggtgaatttggatcatttaaactgcagggttgtccagtcttttggcttccctgggccacattggaagaattgccttgagccgcacataagaggcactaacagtagtagcccataagttttaaaaaatagcaaaaatatctcataatgttttaagaaagtttatgaatctgtgttgggccacattcacagctgtcctgggttgcatgtggcctgcggcccagaggccacaggttggacaagctggatttaaaagattgtactttgattgtagaagttcagagttcgtatttactctgtaccttaagtacttaacgcatgatcgttctctgcttacctgtgtcaacgtttagctgcggtaacaaatttttgtgatttctatgcttgcgacaaactcactttggcttatgaacttgtcaatttctattcctatcattctgaagagatttccaagtagattatagttttcaatattttcatatagaaaggaagaacgtcttatatactgggctagtgccataattgaacctgaaaggagttgggagggagggcggagaacattaggaacgctggtgttctaaagaggaaccctaagatgaaccaaaatgtatcacttggtctgaaaagattatcactgtggcttattttgtgtcttatcgataaattatggtggactttcaagtataaaaagtgttcaacatcgatttttcattaactttcttatcacttaggagttccagggtataatagagataatcatctggaaagacaggccttttctctctgctttgcccccactaacttttagtgtttgtctagggttgtgaatccaggatgagtttttagcttccatttcattcttcttcctttcttctacgtagtataaattttttccactccaccccatttggttcaggggcctagatagtactaaaggcctaccataaccttctccctgtaataaccagggagcactcctttttcctatccatctattccttcattcatttgttcatttattccttgacatatgattttaacaaatatttgttcaacaccaatttatgggctaaggtgttccgtatataaatcccagttagccactgacaccaaagtcatggtttacagtgtagttacagagaaaagtcaacaattaccatacagtgtgataaatacagtaagtagacttgtgtacacgtgccaaatgatttaaattgggctctagtgaggagagaccaatattgttttaagcctttgctctatccttgccagtgggtttttatgtggtagctggtttgagtatatatgtaagcgaggtatcttgataccaagtagtaaaggaaaattactttttgaaataactgggaatttcagactggtctgtgagaatttgtttctgttttaaaattaaattgtagatgtggccaacatctcatccacaacttgttcacaaacatattcatctcatagtcagagacttgtttataaatttttttggaacatgaggaaaaaaatattaggcattgaaactcagaccgcaggctcatattttctttttgtcattggaattatctctaaattttatgcacgccacacattttcaacaggctgcctctccaaagtattgtgtttcgaaacactgcagattttagttgaactttgcctttccctgtttgtagtatttctattttacttatattgccctgttccagaaactactcctgaaagtagttcagaaggatacgtgaaacagaaggggaatgtacacattaaagctagaagcaagtaagtgctgcagcactctgtattgcttggtctcgagtagagttcctcgtcttagtactagcgacatttcgagcccacaggtatttattgtggggctgtgctgtgcgttttaggatgtttagcaccatctctgacctctacctactagatgctggtagcaccctcctagtcatgacaaccaaaaatgtctccagacgttttctaatgtccccgggggaaaaattgctcccagttgagaactgctagcctggagcatagttgcagagaaatggatctgttttggaggtagaattagtaggacttgtttatggattccctgtgaaggttgagaaaaaggaaagagctcgaagtgaatcttagatgtttggcttacatgcccagtggagtttggtgccatttactgaaatggggaagactgtgggaggacaggtgataaaggggactgggcaggtggaaatcaaatcgtttttgttgacttggacatagcaagtttaaatccaaaagagatgtcaaatgggcagctgttgagtctgttgctcaagggagagtattttaaagcagagtctggagagagtgtagatggaggagaaaagagtggtctcgaaaccaagctctgggagtggttggaggagaatggaccagtgaagaaggctgggtgagaagaaatcaaggagcctgtgctatcgtggaaatcaagaaaggaaagtgtgtcaaggaggagtattcacttttgttaaatacttccgagacattcaataagaaatgctaacactgttttgttataaataactgaaattaattttagctgtgaaaaaattaggtcctaaagtaaataaaaagatagtaatggggacataaaataggctgtgaaatgaatttaaaatgccaaaagttacaaatcccaaagacataacccttgctctggatgtgctacagatcttggctgtggacattctaaaagccattagaaagccttcagtcacttccagtattcacaatgaccataaagtaaaaggggtccccaagaccaccccaggctagatgatttgctgggaggactcacaggactcaatatgttagtcatactcacaagtaagatttactagagtgagaggaactacagcaaagtcagcaaaaggaaaagacatgtggggtgaagtctgcaggaaaccaggcacaagcttccaagacctctcctgtgtgtgtctgccacaggacagtccattcctgtggcagtgagttatgacagcatgtgtgaaatgtgttctgccagggaagctcgtaagagactccgtgggcaggtttttactgggactggtcatggaggcaccctctgcccggcatgtaccaaaatcccaggctcacagaaggaaagcggattcagcataaactgcactgtgtgcataaacagtttaaacatggtgagctgctctcattagtctgagaatggtgggaaccttccggaaatctgggttcccagacaccagccacggctagccttgcaagcaggccttttaaagccgtctcgggactgctatgtgaactctgttttttgtaaacaggccaaagcccaaggaaaatacaagcatagttggcactatgactacatcagaatttctctggaatgggcatttgtttaataaactgtttctaacatattctaaatcatttggatagctagtaagctaaaatttttgtctgtatgtattgggaggcagtctagcatataataaaataatcatagactgtgaaatttgacaaatatggcttctctagtcatggctcagctgcatactctctctgtacctccatttctggtaataaaacctaccattttgaagattcagtgatatatgcatatagtacctagaatagtgactgacacgtggtggccattcagaaatactggtggcattgatgttaataattgcaacaagagttgttttattattgtctttcttgtgttagacatgccattacttttcctggattaatcgattgtaatatccactctcctgtattttcactaaatggctttcagtttttcaattaaactttcagttgaacagtatcagaggcattttaataaaaaattttactgagcttgattagttgatgagaagtaaattgctcgtttttgattaccacattaactctttctggccattagggtaccatttagtaaattacttctctttttgtacagtactcaaaatgttacccaagtgaccagaaagagttaataatgcaccaacaggctgaacacttgactacctccttactattagatcagtctcattatattaaatgtttcccttcctataattgtcattttctttaaaaaatgaaatattggatacagttatttatttttaatagaccttataagctcaatgaaaagtatgctgagttcactcatataccttctaaggggatttaaagtatcggtactcactatataatatgcaaaatcaatccgatgtggataataaatgcacctttcacagtgcgcaagaagggcattatttcccaagggtacaagtgattccccgattatgatctgagtactaaggagtcatattattatgcctccctaagtgcttgagcactaaagagagttgtgcctcatggcattgtagcaggtaaactttcatgtgggcaggaatcctgccttttaaatgtatacattatcagtactcctgtggatgtgtttttatggctaattctaatacagcttttaattattcaggagtactctttactttcttatgaataggggtctgcaatctattcttaaaattacatcttttgctgggcacggtggctcatgcctgtagtcccaagcactttgagaggctgaggtgggaggattgctttagcccaggagtttaagactagccagagcaatattgagacccctgtctctacagaaaatttaaaaatcagccaggcatggtggtgcatgcctgtagtcccaactaatgtggaaggatcacttgagcccaggaagtcgaggctgcagtgagccgtgatcacaccactgcactcctgcctgggcaatagaggaagaccctatctcaaaaaaaaaaaaaaaaaaaatctctagtcaaatatttttccaggtcacctgggaaaattgttgttactctcttggaaagaatattcgactcctgaagtactagtttttgcaatataaaaggttgtctttcactttgggaggccaaggcaggtggatcacggggtcaggagttcgagaccagcctggccaagatagtgaaaccccgtctctacagaaaatacaaaaattagctgggtgtggtggcaggcatctgtaaacccatctacttgggaggctgaggcagagaattgcttgaatgtgggagggggaggttgcagtgagccaagatccactgcaccccagcctgggcgacagagcaagactccatctccaaaaaaaaaagattgtcttttcattgatatagtatagtccaataatccatgagccacttagtgtttactgagttgtcactgaatgtgtaacattaagtgctttcagtgatacaaaactaatatatgactggcttgctcattgattcagtagatgcttgcttagagagctatgtgctatgtactctaagaatacaaaacatcaaagaaattgaagtctgttgggggagatgattaatgatgacatcatagtacaataccattgcagctgtaaacatgcattcagaggaacatgcccagctacttcagcatgtcagagggagaaccgacccagaatggaaggagtcagggttatttacctccaagagatgaggctgagctcaatcttacaggataaataggagtcatctggctatttgtaccccagaggacaatataaagatacaaagttgagaaaaaagatgacgggcagagggctagtgctataatagtctcttgttgtttatttcatgtgcaaagcagaaagcaaggctgagtaagtagagagacatcaggttagggatatgccatggtttaaatttgctgagttttttgtaacctaattagaaaaaggagagtaatgtgtgtgtacacagtggagacagtaaacacatggtcactggagttcattattttatacattcttccccagaatccatatggggcatagtattatttttcctgttttatatataagagcttgtttcttcgaaatattaagcaaattgcctaaggattcagagaagataagcgatggagatagaattcacttctacagaattccaaaatccaaacttgcagagatattgaacaacttgcccaggattatacagtgagtaagcacttaaaaacgtggatttggaaagtgggatcagattatgttttctggttataactggattaattgaaaatgaggacgatcactgatttcacagtgctttattcttagagatgtgccagattacaaaatggatcttttttcctcttatactatgtagcaccttgtccaagcaagctgaaacttggtggatggtttttgttttataacatactttcttggatgattaagagtcaggattgctgtggtactgacttgcaccctcctcctcaaattagcccagtgcagagatgtagccttttaatacatacaggtggaaaggtagcgtggattataataagaaaacaacaaccaagctgtacattttccttagatgattagatctgcctcaggaaatcctgcagagtttcaaatagaaatgtgttcatctttcctatggaaaataaattctcagtgagactgcttacttattttcaaactctgaccctcacgtacatattttggtcaattttgatacttgttctgaaattcttgttggtatttctattgaaaaaatgaactattgtgattattgtattcttctcatagactctgaggcaaggcagaatactgcttaggccaggatttgggcagagagggagtctttttttcataaagaatttttattgtggctgggagtggtggctcatgcctgtcatcccagtgatttgcgaagatgaggtggaaggatcacttgagcccaggagttgaagaccatcctgggcaacatagtgagacccccatctctacaaaaataaaaactaaaaaattagccaggtgtggtggcatgcacctgccgtcctactactccagagactgaggtaggagggttacttgagcccaggagttcgaggctgaagtgagctatgatcgcgccactgcactccaccctgggtgacaaagtgagaccctatgtcaaaaaaaaaaaaaacacagaatttttttgtaatggcatttaatctgtaatgaattatgataaacattattacattattatatgttaataatacctacctctcaggattagtgtgagaattaaatgagtaaatatatgttaacatatgtgaaatgtttagaacagttactggcacacaataacctctatacaagtatttgttattattacacattttttattttattttatatttagattatctattttaatattgtatatgtattggccttacaacaatgaagaattccgtccaatatgtaggaaactccaaatgggaattgagataaatgccacgaacaaatatggtgtatttttatttactttaaatttgcacagattaactagattgttgtttctgctgttagtagtaatatttttattttctgtttatagcaagtctttcttcttcatagatcaagtttgtaacttgcaattatgttggggcaaccagtgtcaactggcactgtccagagaaaatccgttgagatttgtaagccattcttataaaattaacatgcaaatagcctctcaagtctttcttctatcagtgtggccatgttctagcagtaggactgaagaccattgaataggaatgttacaactaatgcctctactgggcgccggagcaaaatagctgccaataggcatgccatgctttttagcttcagtgaaattccagttagaaatcttgagaggtttcttagtggctgatggcagctcacaagtgggtcagaggatcacatcctggccgccgcaaaaagtacacacttttttttctttccttctgccaagaccaaaatcactgacttgctggaaagaaataagcagatgtgactgctgctcatcttcaggccagcctcctatgttttcctgctttgatggcttggcggaacgctgggcacatataaatattttatattggtttaggcttcattcctcagcatggagcctgtttctgctagctcatggtgaacgtttctgtgaagtcactccttcttaccccatatccatgaaaatctcatctgttgcctctcctggtgtcagaaagctgaagtttaattcatgtaatattagatatttcatttgtttgtcagatggaatgtttattaaatagttttttactctatgtcaggggttcttttttttcccttgtttgctttttatgcattcaatgattattcactaaaagcctgacagctggcaagatatcgatacactaggtactttgaaggagtgtccagaagaatgaaagacataaatacagttaactgtgtgtttcagttagggaaaaataaggatttcaaggaagtacagtgtgaatgaagtgttaggagctctgataatatctgccatttctctgctctagaatatcttgtctgatttcttatctttctcctgtttcatcctttttgcattctctcgtcatcctgtggaactcttacataaatcagtgtcattggtggtttcttgactcagttttcaaaaaggctagctcctgcagtcatttcatcatgaactacagtctgtaattgcaggatctaaactcttggtttataaatatcattgccgtctctttctcttctatgtaagatctctctcttgtctagttcaatcttctaattacgtacttcgaggtcttttaccaattgtttgcaccagctactttatctttctgtttcgtgctccattactccctaaaccaaattctcagcttcagtcaagtaaactatttatttaccattcccggagcaggcactttgctttctgctatttcttggcctctatacttgcaaatgcttaacatttgcatgtagaatgctctccttccttctcaccatgaaaacgtcttctgccctttttcaaaagttttctatgacaccgtctgcataatctcattgcctctagtaattctacattttccacatgtgtttaattatttagccatgactagttacttgacgttaattttctatcaggtttctgtggatacgtttgtgtccctgtctctgtgttttgttcatgctgcagcgtgttaagtttccaggtaccccatacagtgttctgtgaatgtgcacagatgcaaactgaaatatatttatatgaccatggaagatgattgattcatcttgctgctcactgactgctattttggagagtgcattgtttgtaatcttcccagtgatttaactgtttttattaagtgagggctttaaagcacttaccatttgcttttggctgttctttttgaacaggagtaaaaatgctcatagtgcttggcaattgaatgcttaaatatatacattaattagtctaatataagcttttagatagtgttttttatgttcacgttttgggcaagtattcaggcatccgcacgtctcttctgtttaccaaaggtgtacccaggaagagtttgaagaaacaatgttattaacaattatttatggagttcccagaggcacaaggcatttggctaaatgcttagaatacaatagtaggcaaattcagaaaagggagtttacaagctaacaaggcatattaatgaaatgatcacacaaataaatgtcaagtcaccactcaggtcactcagggaactggtacttaagcagagatttgaagggtgaggacatacctggggacggaggaaggagagaaagaagaaaatacaggtaaagggtagagcatatgcagaagtagcaggtgggagcctgacatgtttgaggaattggaagtagatgattgttgctggaacacagagcaaagcagcataatgcaaggtgagctttgtttaaggacttggatctttggccagaaagcagtaaacagtgctgggggttagaaggatgtgaccagattgctattttgcattattaccttggttacaatatagagcaaattggagactgcagggaggtggtagtggagttgaagagaagtgggtgggtgttggaagatatttagagaatactaatatagtatggatgtaaaagcaaaggaaaaggaggtttccaagatgacagctacatttatgatttgcaggaaaggatggctggtggtaccattttctgaaagggggtatgctaaaatagaacaaggtttgggggctgaggaaagatccttagttctgttgtgaacattctgaagttgagacattttgcagcattcaagtggagatgtcaagccactagatctgtggctgagtagctcaagggaaatgtcaaagctatggatatcggtgttataaagtgatcattatatagatgataactgacactgtgcgtatagatgagattgcttaagaaaaaaagcatagattgggaagagaggcctgagtgattctgtatttcagtggcttagtaaagggacaagaggctacaaaatagactgagaaggtacaagcagaagggcatggaggaagtgctgagagatgaagagtgcagagtccctgcaggcaagagaagagaccatttgaagagggacctaatcagtggtgtagaaaaccatcaaacatcaagaaagatgaaaaataaaaatgctctgcttgattcatttacgtggagaatactgatgagctagcagtgacttctccggagggatgggagtggaagccagagtggatgaaggagtgagcaaggagatggagacagtgggaacagagaactcctccaagaagttcggctatgaataggaatgagaggaataacatggtatctgtatgttcagggaatattttaatgtttttaaaattatagagaattatgagtgctcaagtgctattcagatgtagaaggaagatattggatgtgtaaaccaggtttgtgatcatcaacaaaccataaggatcattcgaacgatattaaattttcgtacagcattaaaatttctcctctaagcacaactattaacttcattccttcattcagcaaatagttattttaacactttctatgtgtcatgcactgttctaggttctgggaatataaatgtgtataatatttactgagatggagaagattcggtgtgggtgaggttgaatttgggggaaaatcaagaagtttgttttggccatgttaagtttgagctgtcttccagacacccacgtggagatgtcagatagactgctggagaagctgactgtagagtgtggcagatgtgaggacagggaccttagtgtccttattgctgtatccccagcgtctggaacacagacataatttgacttgagcactcttcctaatactcctagagaacctaattgatacaaagtttactgtgggacacaataaagaatagaaaacggtaaatctaagattgacaagaaagtttgatttgaatgtaaacctttgtaaccttagccctacttgtagcttttgttcattttaccttcaggcctctagcatttcctccataagttattatgaagccatggtggagggaggaagagggactaaaattcaagatgttgtatagaaaaacaagaaattgctaacagagtattcgtttccaccagataaaaatttcacttaaggccaggcacagtggctcacacctgtaatcccaacactttgggaggccgaggcgggcggatcacctgaggtcaggagtttgagaccagcctgaccaacatggagaaaccccgtctctactaaaaatacaaaattagccgggcatggtggcgcatgcctgtaaccccagctacgggaggcggaggcaggagaatcacttgaacccaggaggcggaggttacggtgagccgagatcacgccattgcactccaacctggagaagagtgaaactccatttcaaaaaaaaaaaatttttcacttaaaaaatatttatccagtgaacccgtgtgtctcaccaaggattgagaaaacaggctgacagaatggtgtcagcggtgttgagtaagcacctacttcatgtcaagaactgggctaggaattgagatagctcggtgaaaaaaatagatgcatatacatatatggcttctgctctcatagaacttagtaattttgcaaagggcaatgaagaggaactgcatatgctaacagagctcctaacgaaggaactaacctagttaggaggatcagggaggatttccctgaggaatcagtgttttgctcacatgtgaaacatacatagatcatttcaggcagagcgagcgagtggtactaaggttagtatttactgagcattcactctgtgcctggcacagttttaaacactttcattatattactaaggtagattctatcactaatcccattttacagatgggaaaactaaaaccgctaagagtttaaaaaacttgctcaacttcaaacagttggtaaatggttcccagaattctagctcaggaagtctgatttcacagcacaaattcttacctctattttggttttttaaaagcatggtgtttttgaaaaactgaggaacatctaacatgacttaacagagcaatatcatgtgctatcttatgggtttgcaattttggactttatcctaagccatagaaagtgattctgtgtgtgtgtgtatagaaacgaaatatttttggacttccttcatttccttaaagcctcaaaatagagagcagaatgttaagaaatctgtcatttgtgcacatgagcatctttcaaaaacacaatcatccaacaatatactgaattgattgtcttaaaattatagggtggtgcaaacattttcaatcatgccattggtcaagggaaaaaagttagatgagaacttctattgaatccatgctattttataggaattttgctagtggcttaacatgcattatcttatgtagtatatgtaacgaagagtaagctgtgttttcataccagaactcattactagcaattcagcacttaatatgatggagaagattagaaaacagattttaaatgctaaaagccaacaagctcaatagcaaaatctggttttaagtaacatttaataagctatcatttaataaaatagtaacaacaggccaggcacagtggctcatggctgtaatcccagcatgttgggaggctgaagtaggaggattgcttgaggccaggagttcaagaccagcctgagtaacatagcaagaccccgtctctacaaaacttaaaaaaaaaaattagcgaggcgtagtggcgcacacctgtagtcccagctacttggaaggccaaggtgggaggatcgcttgagcccaggagtttgaggcctcagtgagctatgatcatgccactgcattccagcctgggcgacacagactctgtctctcaaaaaaaaagaaaaagtagtgacagccatatatagcagttttcatttattgagcacctacttagtttgaaggttatgataccaaagccagaaccaagtattttatagcaaagtctctcccccttgtttgtaaattgagtgcttattttgtgcctcacatcatgccagcatcttcagtttttggctctgaggtcatgttcattggaactgtgtctgtggaaatgccttgagttctggctctaggggaactctttagcagacgattttcctttgtttctgccaagtacctgaggcacagcttacctgggacacttttttcctctgcttgaggttttcagacacaggtaatgtaaattcaatgggcaaacccatttgagggctacctcttggatacaaattcttgaaggagatgtttttctttctccacctagagccaaggtcaaggcaggcaggtttctttgtgtcactttatatagggtagttttgttatagtttccctatactgagagcacaattctttgggagccttgctttatggaagggtttttattaaactctctactttcaaagggacaagccctgggctttatcttcaccccagcgttccgtgtactctttcatgatgaagctcgaggtcaagtttcggattcaccttgtttttggcctcttagtatactttactttcttacaaagtcagtgagatgagtaaaaatgattctatacaattttttatcctttatttaatgttagcaggagagttgttcaggtgtctactttccatatcactgtaaatgaaagtttaagcttttaactatgcattaagctgttgaatcctcacaacaattctcgtggtagatgtgaagaacacacgggttaaagaggtttgtatgactcagctaagatcatacagccagtaaaaatttgaaaaggagtttgaacccaagccgtctaactttggaagctatagcaaatgttggtgacataacaaaggagttcctaacgaatgtagcttgtgattgacctatatctttcctactagaaggaacaaacacaccagtaatgactcgatggatgcatggatgcaaggatggagggatgcatggatggatgcatggatgcaaggatggagggatgcatggatggatgcaaggatggagggatgcatggatgcatggatggagggaagggagggaggaagggaagtgtctcaacatagagaccaggagaagaaatggcactacagagtgtatttatttgaacaaattcaataggagaaagaagaaaggttctatgtcaggaggttcatgcaattattctgctgcatctggtagggtcattgcttctatttggaggttacatgtatcttcagaaagtttagctgtattaccagttgttggtgtatgctgatttttatgagtgaagtaatataataagaatgggcgagcacaaggagaccagcattctgcttttaataacctctaaccttaaacaggttactgaggcctcatctaggcatctgttcccttatctttaaaaacaaaagttctttaaagtctcatcttttttttcaccaaaaaacttaaaaaattgagatagaacatattttcatatatatatatgtgtgtgtatatatgtaagttgttgatacatgcttttttggtggtattccatctatagaaaggataattttccagaaaagtatattttttttttagtttgtgtcagctactctattttaagtgctttacatactgtcgctataggatagtcggatatgaatctttataaaagtaattttattagggcttattttattctttggaataccaattcagatgatatcatcaatataatccttttggattaaatagacgaaggaggttgccttttatttttatatttaagaaccagaatattgtgtagtaccttttgcttcaagatgttcaggtgagaatgtttcaaaaaactaaaataaagggaaagataacacactgtcagttttcctctcaatgtttcctgacaaataagtgagttatcagatttcagtttatagttcaataagtttatataactaataacaaatattgtattcagaaaggtatatacatgtaagtttttagttgattgtgcagaaagagagcagtactctgccctaccctattctgtgttttctcgcctttccaatttctacttgcctttcaagttccagctcaactttcccctgcaaggcattttcctagctccctccagcacagcattgtggattttttttttttttttttttttttttgagactgagttttgctctgtcactaggctagagtgcagtggtgtgatcttggctcactgcaacctctgcctcccgggttcaagcgactctcctacctcagtctctcgagtagccgggattacaggggcccaccaccatgcctggctaatttttatatttttagtagagacagagtttcaccatgttggccaggctggtcttgaactcctgacctcaggtgaggattacaggtgggagccaccgcgcccggcctgcattgtggatttttaaataggtaacctctcagtctccttagctctcatgactatcaaataaaagttgtgttgctcatcttctccttacctcctcaccttttaaacccaggaattaatggaaagaaggagacattcatttaaggagagaacctatgcgttggcttgatgaatgatgactgtgtgaaagttagggacttggagtcaaatatatgcccacactgttaaagacagtatcatttacttaacacataactagtcttcatctaggtgaatttgagcaaatctcttaacacctcctggcatcaattttcttacctgaacaagagttagggtagatcaggaaccatcaatcagcgcatcaaaatcttcaacagtagatattgaaaacgtacatgctggatctcatttaaataaattccccttggggatttacttttattccccatctctgcagagattaaaaagtaaaggaaaattgcttctcctgatagaaaaaaaagtcgtagtttttagtcaaggtgatttctaagatgccatctagttctacaattacagagctatgagtctatcacgtgagtaaaataaaattgaggggaaaaaagttaagacaacataccagtgtatttacttgatatgtctgtttgcgtggaaagacgtcttttttgtttgtaagaactcattaatagatgtatatttttggataggtgatatatcagcaaactgttgttagcatctctatattatatcttaaatatttccacttgccttcagccccactacaaccacccaggtctaagccactctccattacctcttgcctggacctctacagttgcctcctgcttggtttctagcagccagaatattttttaaataaaagctgaatctcagttctctcttgcgcagaacctctcctggcctactagaccctgaataacttggccttcgcctttcgttccagtctcatcttgttctgccttttcctctgcccttgggccttctcctgttttggaacgtgccacagtctccctccccggtggtattacacagtcagttccctcttccagaagactctgcccctgtcaactggtatggcttctctttctttgtctttagatctcagcttaatatagctccacagaaaaaccttccctcactgccctatttaggtagcccacctgttttactctgtttctctgtcctgtttgcatcttttcataggaattacagttgaccgttgaacaattagggggctagaggtgctaccccatctacacagtcaaaattcctcatgtaacatttgactcctccaaaacttaaccatgaatagcctactattgaccagaagccttaccgatcaacagtcgattaacacatatttggcatgttgtatgtattttttactgtattcttacaataaaggaaactagagaagggacaatgttattaagacaatcataaggaagagaaaatattcttactgttcattaagtggaagtgggtcatcacaaaggtcttcatccttgtcatcttcacgctgagcaggctaacaaggagagggaacaggaagggttggtcgtgctgtcccagaggtggcacaggaggaaggaaatctgcatgtaagtgcgcctgcacagttcaaacccctgttgttgaaggaccagctgtattattactttgttatttgtttccttttaatttttctttctagaaaaattgacagcaggggccatgtctgtttggtttaatgctgtaacattccaagcacacagcaagtaagtgctctacaaatatttgttgaatccttgactcaattagacatttaccatttttttttgttgtttgttttttttagagtcagggacttgctttatccagactggagtttgtggcacaattatggctcactgaagcctcaacctcatgggctcgagcaatccttctgccttggcctcccaaagtgctgggagtacaggcatgagccactgtgcctggctgacatttatctttttatctgtattttacttcagttaattaaaataagttttattctctgaaaaccgacaatcttttattctccaagcaactgaaaatagtctggaaatgtgcaaagaaatagggaatcctaccagagatttaatctgtccacagataatcctgaaaatggacaagttgcttatggataatcaaaagtgtgtccaagagttaatctgttttttgaaaaggttctatatatgccttgctgtagttagcagaggtcgcttcaaaagctgttcatattggaatctgtgtatacctgagtgtgtatgatgaaaagtctttaattgtaggtttgcaacatgtttgtagaatctgatcagtatgttaactgctggattaatcctgttttctaaatcttcaatatgcatatttttacaaaagaaatatctcctcttccatttctagatgtacctcacgtgattaattctcatgagtaagcagagatcttgacctgtagcttcttacatctgcctatttgtttagcagaacagagaattacggtaaaacagaggcatggtacaagcgtttgtgtttgctttacaaacacgtctcccaacttagtacaaaaaaacactgcaaactcttaattttagatcttcttaggtttgttgtaaatagaaagtagagtataatgttttatagatttatttctaaactatattatggttacttttctcgtgcttttcagatatttgagaaattgtttatgtgctgtcatgaatatgaattcattattattaaatgttaatgaataattttgcttcaaaataaaatagtgagcctgtatactttcacttgtatagtgtcctagcccatattttaattttttagtttttccctttgttttctttcatgtcagcttcttcatctggtccatcagttattgaacatattacgtcacctccgccccatcccatcttcatgacaatcagaggaggttgctaagtgctagtttcatccaggccattttgtggccaaacgctaagcacactaccagttctatccaatgctcactcactggtgcagtttccatttgagtccagccctatagaaagaagatgacagctttcggttttcatagtttgactaaactatctttttgtgtcatgtaaggaaccaaaatcatattttaaacttgctccttgatagctccttatttaaaattttctgggaatgttttatcactacagatattaaggcatggagaagaaataaatgctttattgtagccacagaaattgttttctttttctaacccaatcatttgccatctctctgaaaaaaaattccaaggccaggcacgatggctcgtgcctcgagtcccagcactttgggaggtcaaggtgggaggatcagttaagcccggtagtttgagaccagcctggacaacaaagtgagaccccatctctacaaaaataaaatataaaaaaattagccacgcatggtagtgtacacctgtagtcccagctacttgggaggctcaggtggaaaagatcctgtgagcccaggaggtggagggtgcagtgatctatgatcataccactgtgctccagcctgggcaacacagtgagaccctgtctcagaaaataaaatattcccttctcatctctgatcagaatagaaaaagaccgcccgtgactcatgtttagaatttttgcaatccaaacccagcttttccacattttatgaaaatatgagctgccttgagttgcacaatgttcacagtaaacacacggttttaggaacttgaagaacgtccatacatagaacccagactcttaactccaacacagatcactaaagctttggactgaaaagcaaggagtgcacaggccgaggcaactctacctgggggaggaacacttccatgaccccaaggccgggtgagcctgttggttctggcattcattggttagtcacctgatgtagatgttctactccagaggtggcaagcgtgtgggacatttgttaacactcccacctccaatacttacaacagacatcaataatggatcaccacttctcagccttttggctaagatcaagtgtagtgtctgttcttaccggtttaataatggatcattgcagtgtttcctactgagtgcaaagacagtcttgggatctgtcttaacacagcagtcactttcaattgccaaccttgttttaaaaaagaagcatcagcactccctgaaatccctctccgtttttcttactctattcttatgctatgcatcccctcttcccacccttccccatcccctaccatggcaactagactcttatttttatgattgctttatgatattttctacagaacctgtcatttacttttaccaaatggaaaacagagatgatgtggtttttttctctcttacttggcagcccagcaataacttaactaagtgagcagtagcctttttaaggtaagatagaattttaaagtcggctccagatataattctaatgtgtccggtgacactgcagaaaatgtaaatttccctggaaccatgtattattctgggatgtgtgcatgtgtgcatgcttgtgtgcatgctggtagatgttacggtcaagtaaaatgtcagcacagtaattatagaccaaaaaagttcacttcaaagaattaatactgttcaaaggaaaattcacgatttggaaactcacaaatgtaaaactaaagcattttcttttcgttcctttccattaaaagttgagaggagtagttaccactctaggatgaagtctataatagcataaaaatccctctggataggaaagagtgtgttgtttgagttttccagcccatctgatcggatttcagaactctttaagcgcttagcttttggtgtttttgggattaggaatgtgtgttcttgtagagagttggaaagcaaatgttaggcttgtcagcatctgaggaccgcagaagcagtccacccattgttcgagtcacgcttccagggcccagcacttttcactgaggagcctgcttttgaagtgttttctttgcttaattttctccacctttgagatcctttcagaagtattttctttcaaaatatcatgcattcttctttagaagaattggcctttctaataatacaaagaaacataggatacttgtaatctgtcaagtagggctaaaaacattagggcattaaggacagatagaataagggttgtggaagaagttttgcagtcgcattataaattgacttttttccctttttaatttagtctgactatagagaactatatctaggcaagaaaataagaaatgttgggttcatttagaaattgcaattggttttttcatacgtaatgggaaatcaaaatggaaatgctttggcattacaattatgtattggagtcttacttgtgtatgaaaataattgaaggtctaataaaaattccgctcaaaaccagtgtctgttattttatggagttacattttaaacattaaccaagatgaccataaaattatgtggaaagtttacgtttaaaaaaagtcagcataaaatgttaacatgggtttgagaacagaaaatagcaattcctaaaatagctcttgtagtcatatgtatgtatgtatgtacgttgatttacaaatttaaatacagaatttaagaattagaatatactttgattcacaaaataaatgaaaagtagctattcttacagacctatttgttgagatgtaatccacagaataattacatatattggttcactgtatatctctctgtttactaagacttaacactagggtcacagatcctgaagtcactcctgttgtttttctcaactgctctaataaatctgtgacctttctctcaggtggtagcatcctttgcagatgttaatttcaacatctggtggactcattcttaattttgttctgtgaaaccttattctgactttaattcttagcctctgaagcttgcttaaaatatttctttttgggttttctgggtgttcatcactagagacaagttattaatgcttctaacaccagggatttgtggaggatcttctatcactgtaaatctgtgctcccttaaagtgaactatatgaggttaaaatagaagatgtctatttttttttaacctcaatacttaatatagtgcttaacacagagcagttactaaatgtttgttgaatgaaaacatatcctgaggcgttgggattgggaaggaaagatgttattttcaacttctaccaaaggggctaagcagtgctttagggagtaaaccagttgggagatgatttagtttctgtcacaaaaaaaatccttggctgggagcagtggctcacgcctgtaatcccagcactttgggaggccaagatgggtggatcacttaaggtcaggagtttgagaccagcctggtcaacacagtgaaacactgtctctactaaaaaatacaaaaattagctgggcatggtggtgcctgcctgtaatcctagctactcaggagactgaggcaggaggatcgcttgaacccgggaggtggaggttgcagtgagctgagatcactccactgactccagcctgggcgacagagtgagactccatctaaaaaaaaaaaaaaaaaaaaaccttatatgtataattgtcccttcatttgtccataataacacgaagatgatgaaattgtccctttttcccagagctctcagctaaaattttctgactttgatttttaggtccatacctaatgttagtccatgttaataaacagttttcaaagaaatataacagcagcggtggtaggataactatgtaaactatgtgaagaaataaatacatggtcaattacgtgaatttgcatgaagaaataacttttcaaactgtgatgattagaaaaggactgaataaagtgcaatgaatctattataaattgtacaaaagagagagataataatataggaataaaattaaaattataaatataatttcataagaggcaaccaagccatcattactatttcatctgacttaatatgaccccctgttcattatgcagaccagtggaatttgataattgtgtagtggtattctaaagttgcatcttttactgtatttaaagttaaatgggccatgcacagtagctcacacctgtaatccctgcacttcaggaggccaggctgggaagatcgcttgaggccaggagtttgagaccacccttggcagcatagtgagacccccatccctacaaaaaataactagccaggcgtggtagtgcatgcctgtaagtcctagctactcaggaggctgaggcaggaggattgcttgagcctgggaggttgaggctgcagtgagctgtgattgcatcatgacaccactgcactccagccggggtgacagagcaagaccctgtctcaaaaaaaaaaaaaaaaagttaaatgatatgtaacatttgggagtgacaagactgttcatcagcttggggcctggcagcaacttttctagagttagcttttttctcctttcttgttccatgacttaaaaataataacttgctgggcatggtgcctcattcttgtaatcccagcactttgggaggctgaggcacttgtggccaggagttcaagactagcctgggcaacgtagtagatgccctccccgccaccatctctacaaaagaaaaaaagttaactcttgatttgctttctagtagtgggtgaatttggagttccaatgattgtcaacccattaattcttcatttactgaacatctccttatgtttcagatgctgcaaagatgtacaagactttgtttcctaccctccaggatatttcagtcttactctgtgatacttaaactattttattttgcattagttgaacctttatctgaattcagttttgctgtaccattctgaaacttgaagagtgttctgagagctaccaagctaattaaaggattagaaaatgagactcatgaaaagaactcaagaagaattgaattatttaacagaaaggagagaaagctaaagggagatacattaatcatttttgaagatgtaatggatgatgaccatctagttctagcattggccaaagatgggaaaggaagaagtggattaaattatagaatgagatagtaaggttagacttgagagtctaagaacacaggagttattttaatatgagtcctcttaatgaatgtagtcctgacatttttaaagggtatttttaagttacataaagtattttttgttttcccaagttaaactgtgactgaatttagggattaacagaaaaagagtgttcaagtttttgtatcatctttcagaaaattatagagcttgactagggagcgagccaacacttggttccgggacatgcatgatactgaatcagtaaaaagcaaatggtcacagcaagggcagccctctcgtaaatatatcgtaatttgcttttgtaatctttaaatagtttttttgttctacttttttagacagggtctcactgtgttgcccaggccgtggtgcaagggctattcacaggtgtgatcgtgcacactgcagcctcgagcatctgggctgaaggcttcctcttgcctcagcctgcagagtagctgggactacaggcaagagccaccacgcccagcagtgcttctatagtcttcataaatcgtttagaaaattgaaatgttctcactcataggtgggaattgaacaatgagaacacatggacacaggaagggggacatcacacactggagcctgtcgtggggtggggggagggggagggatagcattaggagatatacctaatgctacatgacgagttaatgggtgcagcacaccaacatggcacatgtatacatatgtaacaaatctgcacgttgtgcacatgtaccctagaacttaaagtataataataataaaatttaaaaaaaaaaagaaaattgaaactcatttactagagataaacttaagagcataatgaaagtttatttttaaagagtttcctattcctttgctcggttgcatattgctagggacgatgtctactaagagttaatgcctcctctcatttagatttgaaaggcattcttgccgttagcgtttacagcactttttcagaccacaacagcttgataactcgggttactatctaaaccttcaaagaaaatggagagttagagtccatctgcgttgtgatttaacttttcaaagcctctgatttttaagccctttcacttcaggtgccaaattttctcaaagcacaagaccccttaactcaatcttttctctctgccaaatgaacaattttatgtctcttcccttactctacagccactgaaatctagtattcagtaatatacttaggaaggtatctcagtttttttcttcatgaaaaccttctgtgctgtattacttgtggccaatctcagacgcaagtgtaagtacgtacatagaacctgacaaaaatttattccttagctaaaaagggataataattgcttctcctcatgcttagaaacattttaaatataacaaaggctttctgatgaccagctgagttttatctcttcttcatccttcatctgattaatcttttctttcgtgtttttatttctcagttgcaatgccaaagctctatttgtactgttcttctaatagaggaaaaatgcatgcttgcccagtttaaatattccaacttttgccgagtgataattaactgacctcatcccatctgaccactgacttgcgaaaatcaagttttatagtgtgattgaacaattagttgaactacattatccttgtaattcatattttaccaagaattacagttttctacatgatagtaatgtaaatgcatcaggaaaagagggaaatgaaactaacttttattgggtgcctactttgagcaagcctgtgtgccaggcaatttgtgtgtgtgtgtgcacgtatgtgtgtgtgtgtgatatttaatttaatgttcatagtcttgaggctttcttatcattaaccttgttttacagatgaaaaatatgtagcatggagaggttaaataatttgcccaagattttaggtttattaagtggcagttcaaatgctcatttacttaaaagtcatagagaaaaaaaataatcaaaagaattctgaaacaaagcccatgtcaccagaatcaagagtacttggaagagaggggtcagtgtctaatttgtcttttcgcagctttaattttctatttctacttctgtccgtttccttttaagctttttttttttttcctttcacatgatgtacgtttctctaaagccagagtagtgagcagcttgaaaggttaaggaaaagaggaggtagggaggcggaactattgtggtctctttatttgtcatgcctcaagcatacgatgtagtaatattccttgtcttccaaaaaaagaaatcagtgaacgtggttccttacttagctcgcattaatggccatgtgagtgcatgctgaaaatgtatatttaggaaagtaaggacataattaacataaaaaccattctaatagaattagtctatgactgaaggaggcaagcgagtccaaatcattctgtattgttcagtacatttttttttaatatcaggcataaatttaactgtgtgttgccaccagtgacaactatcatagaggtttgggttttttaaaatcaagaaatatagtttgaatcttgctcctccatgaactgtaatactatgtaagtcttacttaaaatattatgcttatatggtagacattatgttagtataattgtgaaaaaaaatagttgcctagaagtagcagtggatgctttaaaattttttttcaatatatttaaacaaaaagattatttgtatggtttggggcttaaacattgatttgggacctaaagtacatttaaaactacagcattggtgatgaaattttggcctggttcaagtaggtgctcagtaagtgagcactgaatgaatgtgctattaactaaacagccttacaaataaataccatgtcaagaaagactcagtacatcaagaaaaccaagtgcacatattaacttaaatgcatttatatgggttttaaattgttgcccttcaaaatgcaataatgtatttattgatcttgattttatgatttgtaaaatatgcttttttaaatttcctgaaaattaaaaacttaagtcattaatccactactctctggaattactttttttttttctacgaacacttaagagtttctctaaaagaataacttcccaggtcctgaggcctctggaattactttttttattctacaaacactgaagagtttctctaaaagaataacttcccaggtcctaatgcttaatgcaggaagtaatattagtactttttttgttgtttagtctctttctctgaccaaatatgccaccaacttgagtctcattgtccctagcccattaggaacaatagaagttttaccccacttcccagcccttttcttaggaatgtaggaatctggctagaaggcacaacaacctcccaccttcctagtagaccaaggattcctgttgtcagatgcagtgggcatgaaagcagcaattttacagcacaaaaactccaataacatttacttcggttggctgagattgcaatgcacacaggcactgctcattcttggttgcttaagcaccagctagcttcccttggctttttgccactttgtgcatttcagagacaagtcctttcaggagaaagcattttgcttgtaacttgcagtggagtaaacagaccattcaggcatagtttattgcattacaaactcaactatgcgaactatcccaaaattgaatacaacaaagtaattagtgaaatcatttggtcatgagaattcataaagaggaattgtcctatttaaaaaataaaatttttcttttctaaagaattatttaaaactttatatttagagaatggtagcttatctcttataagttttacttacatagtgaagcttaaagtgaccaatttacaagtgtcttccccttcccactcccctgtagccagcactttgttgaattcatttgggaaatcttaagagggcacccacgttgcattataaagcaaacactgaaatgacgatgacccactcctacgtagactgaagtgctggcatatcaaccccatgttactatataaagaataggcagagaaaagcatacaaaaacatctcaatagcctgactcaggctgaactaggtaaaatgtgcatacacattgtggattccctagaagacaggcaagggaaggcaagagggatgtgcattaggttaccctagaggcagtattcatctaatcaagagttcattcattcctgcagccagtttttaaaatcatacatctaatgtgtactgaaaaccagttgctaaatatggttaccagacattttcttcttctacaagattgtcctaggttctgtatttgtttttttgtggagcttttttcggagaactttaaaacaaaattataaaatctcatgtaaaatcaaaattaaatgactttttctattcaacattgtatctaattattacctgtttataaaccaatcctgttcatagggtcagagcaaactgcggctttcaaaaggatattaatggttagtgcatttgttaactgggaccctatttattgttcctgtccaactcagatcactcgtgtgtgtgaactaagtactctgagcttcattagaatcgtaattgtctgtaagtaaactgtgatgtacttgaatttctacaattgtgcttatttttcacattttgttcaaataaaccagggctcagctcttaacattttcaaatacttgtttcattttaaaaaaggacaggggccttatttgagctaacagatgagccctcatttctacggaaccctaagcaagatcctatcaatccatgtgctaatggtcttttttattgatgaatttggcccttgctctgttgattgaatctacatatagtctctagccagtgatgcttaaatagaagccacagggtacaacattttggagttgaagttcagaccacacagtctccctttctgcatcccacagattctcatctgtgctctctcccccagcctccagctgctgcactgtcaccagcccagctgagattcagaatcacttctggtgtggttctgtccctcaggtaccctttatgtgcctcagaaacacttttacctagatgtctctctaccattcatacatgtttacagtgatttccttctgagtaaatatatagaactatcaaaatgtctaacctgcccgttactcagttgcagtcctagtttacttcccgcttgatctgattgattccgtttctttggagtattagaaagagagagaacttgcccgataccttctgctttcatctacggctacgatccgatttccttcccttgaatgcatgaaggaagggtttaaatggcatctgaggtaatcgtgagtttctgggttactttgcagtggtttgccctcgatggagtgcacaagaggaaagaatgggaatagccctgccctgccagtgcgtgcctgtagcgaaaacgcttggaaaacaagtgatgcactcctaatgaattgtgcttttggttctttgaatgtgcacagcatctccatcaggtttttacagctggactctagctgtaattgctactgggatgagatgcacaacatggggtgttgaagctaagaatttgtagtgttttagtggccaaaaatacatggcatggtaggagcatcaggcctcatgaaattcacacttgtatatcttcatgttcctcacccgtttctgacatgccgctgatttgccaacaggctactctagatgaaggggataaaaatggcaaagctgaaagatgttgtttcttaaaagatactgtgtatcagtggagtaagaggaagtagattggggatataaatgcataaaaaggcctctgtagtcattcttcagtgaagacaattggtattaatctcatcaatgcaacaaaacaaaaaagataacaattttaatcttattatagcacaaaatggcatgcattaaagtatttctcctaatgtaaacaataattctatatttctgtagcatcagctctcagatcccttgtcctgatttgtcattagatataaatcagtttttatgcttcttccagagaagctttaaagcctaatgtttccttattggagatgttataattccaaagagggtaaaattgatagtttcacagagaaaagtatcctatccaaaattatgatgtaaaagaataatccaaatgcccatgctgatccacccttatggttatttaaggtataatcagtgaggcttggaatttaatgcaattccattggcatcataattttccagggtgtcagctgtgaccactgagttcccaacccagttaaattattctttcacattattctttgcattttctgttttcttctttctttcttttctctttattcctcgggattttttttttttttttttttttttgaaaatcaatccctgttgtgtccatccaaccaaaatattttatagcgcttacgttaactgacattttaaaagcagtttatgttgtagatattaattaatcctgagaacagtacaatgctcaggagagaattatttgaattaaatttgtcaaaagtggtataatgcaaagattgccctaacactgctgaaaggagtaattttcgttgtttccatagaaatgaggagttccttattctttggtccttactcagatcatactacttttgtttaattacaatgaaatagtaaccactaatcaaaagattctttgttctatttagaattcaaacttttgttctcctgaacatatttacctgcctttctaggattactttctaatggcaaaaccagaaaatggcaacatgagagctgaattgagaagaaaaatgcttaccttatgcaagcaccctgtaataaactttgagattttctattgatttttttaatgcccagcgtttgttgtattctttttataacattttttcattccacggtcattttaagctttatttcattcacagtttctttacacctcttgcttttattgaaatttaatttgagaaatggataattaagaatccttctacattctatagagagtaactagccccatggttaatgggtacaaataaatagaatgaataagatctagtatttgattgcataacagagtgactgtagtcaataataatttaattgtacattttaaaataattgaatataattggattgtttataacacaaagaataaatgcttcagatgatggataacccatttaccctgatgtgatttattacacattgtatccctgtatcaaaatatcttctcatgtaccccacaaatatatagacctattatgtacctataaaaattaaaaattaaaaaaaggtttttttttttttttaaaaaaagagtaactatccccacaacagtacatcacaatcacacacacacaccctgaatcctggcagcattgcagtacacaggaatacgttacttgaattgaaactgcaaaagtagtttaatgcaaacacacacccccacataaatacacttttatttattaaaagacaaggaaactaaaaaactgaagtatgaaggccaattggaataataatgtgtgttttacaattttttctcaaatttcctctttaacattaactcgagagtagattccattcccaaggtgattcagccattcaatatttcaaaactttcgttattccctcgagctcagtgccccctctactgcttctcctacaaacagtgatttcccagtaatgccagcagaagcaacagtgaagctaatgcagtcactctgctagggaagagaagttttcaagagaggcaaaggcacagtttccctttttctttcctaccagttaatgccctcagtgggtggtcatgcctgctctgttcttgaacaaaggacttccttctcaggagcagcaggaataaaaccgacaagtatcacatctgtttcatgctgcttctccagttcccatgggatagcaccacgtctatagcagcagttctgatggtgccacagggaaacaaggcagtaggacatcataaatgaacagatcctgcttgaatgaaagagaaggggaaaagaaaatactaaataacaatataatgaacagtggagaagtaaaagggcaaagatacaactcctcagagaagacaaatgttttagagatagtctctatttggtgtaaggtctgagtgttgacatatgtacgtattttagaagtagtgtaggatagagtacatccattcctctccgttcatggccagagaactggtcctgcgtgaagaatgcacggtttaatttgaggaacatttccaacgggtcttaaattctggcctttgctgttactgtctacaaatgggaagaaaagtggtaggcaaatttaaaaaccaaagaggatttaataattataattaataattgaaaaaaagacaaactaagactcaaaacattgatgggaatttataaaattggattggatgatgtttgtagagctctgtaaatttattaaaaattgtatttatgaattcaaaatttaaaattataaatatataaatatgtaaataaaaatgattttaaaaattaactgataatagctctttacaatttttaaaatccctccgaatatagaatagcataggaaaatgctcatgttagtgatacaaggaagatagcaaagcagaactatgcagtacaatcttgattttgatgatatttgtatattaaaaaaaaaaggaaagaaacaaaccaaattttccctgggtaatggattatggatagttttagtttttctcttttcccagtgttttttagatttctgtagttttgttttttctaaatgtttgcactgaaagtgtaatattttatgatgaaaacatacaaaaattttaatgggaagactttttgtcagtacctgccagaattgtttatatggataaacaatttcagtttttcatttctctgaatggatcctgtagaattctatagaatagttatgtaagggattatttaagtattacatggatattaaaaacaacctaaatgcccatcaaaagggaattcatgctgtgtcataatactattcagttgttataaaagaatgaaccttcacaagtatatattatgttggtgaaaaagtaattgctgtttttgccattaaaaataatagcaaaactgcaattacttttgcaccaacctatataagacatattgtgcatatatgtatataaacaatactgtgtatatccagatagatagatagacagatagatagatagatagatagatagatagatagatagatagatagatacacaccctaacttgaaaaaaatacctatgttctattgtggagtagataaagcaatttgtcaaacttaatataaagatagattgcattttcacaaaatgtatgtgagagtaagattgtctaggcaaccttaggctgtataagaaacataaacatctattcttttaagtgaactaagttttaattttgagccactattccaaccagtggtagaaactcattaagtagacacagtcaaatcagagtttcttattaacttatcccatcctaggaatgagattatgaaagtgtcacgggatggtgagtgccatatgctgaattgtgtcctctcaaatttatatgttgaagtcctacccacaattattttttaggacttctatcctccacaactgtgagaaatagttctgttgttccagccgctgttgcctcatgtgtccacactcatcacaagaccctttctgaactctgttcttctcttagtcatttccgtgccatttttcactcaagaaaatgtatggctgccctaccgtgacaccctgggcatagtgggggttggggttggagcaggctgccactttgaggctgtctcagtttcatctgactgaacaccctgcacagccacctttactcctatcctatgctactttaccctcctggaaaaggggcaagatcttgccataccctgattcatcttttgtttctgttattatatccaactttgtggggggtgcaacatggagcgcaacttctcaacacaacaacaccgtgcctaattctcttctgctccagtcatgcaatcacagtcaggtactgtgggggtcaaggggccaggtgctggaaaagtgaactctgagtactcagaaattctttgccagcctcattgtttctagcataagtccaaacttttgaaatttaaagatcaatactttatttattctttacttctgctttaacaactttttttttcctaaggcaccatgtactcacagaatatggagaaaggtacaggagaagatacagtggtggtgatggtaggaaaccttgatgaatatttcaaaatgttactctggtacactgggttatcttgaaagttaggcttagagctgggcatggtggctcacacccgtaatcccaacacttagggaggttgaggcgggtggatcacctgaggtcaggagttcaagaccagcctggccaacatgtcgtgcatatgtagagacaaaatgccgtctctacaaaaatacaaaaattagccaggtatgatggtgtatgcctgtaatcccagctacttgggatgctgaggaggcaggagaatcgctagaaacctggaaggtggaggttgcagtgagctgagatcatgccacggcactccagcctgggtgacagagcaagactccatctcaaaaaaaaagaatttaggcttagagaggggaaggggaaactttcacttttacttgatataattcacttgatataattcactttcacttttacttgatataattctatattattaaataattatccctttaaataaaaagttaatcatttttataagcttcatatcaattgatccttataacaatactatgatgtagcaggggcagttactattaacttgtattttaacagatgaataaatgaagtcattcctacacattaaaagtatcttttgatctggaacaagtaagataaaatgagaggcaaacatataatgagtgctttcagtgagtaaggaatacactaggaaaaaagctgttacaaatatcctaataatgcctaacatttctctaaacccttattgattagaaaccattttcaaagttatagtttttattgattattcttttgaaatagtttgtgtccattcttttcttcctaaaggtatctcttccatgcaggtcttcatggttcatgtttcaactaccaccagatccttcgctcctgccaatcattcctgccccagtatgttcttcacctcacttgattttactaaaacattgcttggatcacgtcatcataaagaccttaggttggaaagagcctcaaatgcagcctctcgcctggctcaggaatcttttcaagaggatccctggcataagattttcctgcctttttgaaccattggatagggattcactgctttctgaggcagcttgttctatttttagcttaaagtatcagaaagttccttcttttggctctactgaatgcttctctttaacttccacacaaaatgaatccaatctttcttttatgtgaaaacctttctttaaaaaaaaaaaaaagaaattgtataaaaaatagagacgaggtctcactatgttgcccacgctggtcttgaactcctgggctcaaacagtcctcccgccttggcctcccaaagtgctgggattacaggctgtcaccaccatgcctgggcagtgacaacctttcaacaaatatgagactataagtcttttcacctcaattattctcttcaccacaccgaacattcccaattcctttcttggtgttttcgtttgtttttttgtttttgtttttgttttgttttttttttttttggtccaatatccctgagaccaccacagttcttgacacacggtaaatattgaaggcatatttgtttcctgagttaatgaatggctaaagtgccctattgttacagcattgctttggttccagttttataatctgtaaagaaaggcatcaatacgtgtcctccatctggtagttgatctgcagtaactcctgcaatgatctaacatctgtttctctcttcttttagcttcacagaaatgtcaaatatttctatggcagtgtaatttttaaatatacaagtttattccccctcttagcttttatgtctgttgtttctgaacagctcattacaacatgacagtataaatatcttaaatgaatatgtgccgtcttacttatctcctgttgttgaaacagttcccatttggtttttacccagtgtgtgaaaagttctgtttttcattagtatccatacattatttggccatcaccagaatgaggcaatacagctttattaatatgttcagtcatatagttagtaaagacactatgttgcacagtttataaagtacacgtcttaatggaacagggttgaattatcagagctattcctggtgaatcatagtcttggttaccacccatttttgcttatttatcctgcctcctagacttagtttaacactcaagataatagaaccgaagaactgagaaggtaataaatcagttcattcttctctgataataggtgtgttggctataaagattgaagatacaattaaattatatgtgaattttagtcatatctacacccatttactacaaataagcaagaattttttattgtcaagtttcttataattatggttcagaagcagctatctcaagtcctcccgaaggatatagtgtagtgttgccactatgttgattattcaaccatagaatttttaaaagtataaagccaagtacctccaggaatgaccttaattattgaaattagcatccctcataccaatgatcatttaccagtatgttttcaaactttctatcttaaatcacagtactataaatttttatagtacccttttaagtatccagatttctctttattaagtgaaatacacagaaaacacatttcttgcttgctatatgtagcaggattagacatctacagcattatgctttcaagaaaatttttcttgacattgtttaagaaggagagagaacagtgagatttccacatctgttaaataatcattagcatgtaggattgaattctgtcttctttttcaacctaagaccagctgttgaagtaaactagaagggccccttaattattgcatatttcaatagcttgctgaggattcagttacctagatccaccactctgatcaaaggggactgatttactttgtcaccattgttattgaaagcattccttatttgattgttttgcttctaaaatgttctataaaaggtcagacagggtgtctttctctgattccatcaggcctctgggaagaacctctgctaccaattatgtgctacttggacgggtgctaagacattgcacggcttctttcccttggccttcatacaggtttgcttttgtcaccaatattgctgagtcaaaggtgtcttaatgtccatatggcatttggcatcagtgaaaagcaaattcagaaaaatgaacttatttcctcttgtttgtgacgcgatttggtaccattgccgaggagacatttgccatgagttgtacatctgtatcaaaggctttaatttattttaagggtctccttattaccattggcttcatgattgtttttgtaaacatggaataaagtcttaacctggcataacccacagcctagggactaaacaaaactaaactaatgcctgcaactttggccctccacaggaaacaccgtaagaatgattgaatatgaaaatcaaattttgactgcttccaaatagatcacaatactgaattatgccagtgttgtgtttattgtttctctcttccagcctttcacgcactgtgtcaacttggccaacagcagctatccatgagctcttgtatgtggcaggatgggtgttctgtctttatattgaggccaccaatggaatgtcattatgcatttacaaagatgcacacctgtttggaatatgccctcatgcctccacaattaacaagtttttaatctaaagctgttttcacaagtagtagatgtcagaatttctttgaaatctcttcatagcagacgcacaggtgtgtttgccaggccactgttcttttctatagtatttcactattttcaagatgaaatttattggtatgtatagtgacatatatacaaatttattggtatataaaggaggccatattctttactataatgaagctttttctcctaaagataattaaagtaatgaagcatgtgttaactacatactgcaaaggatatgtgaaatgggaaatggaaaaaaagaaaaacttctaaatagagaggtaaataaaagagacataatctatgccctggaaatcaaaacgtaggtcgtagagcgcaaaagggagtttgctttttaagatttgtttaccttttttgtgatgggataacatagaagatttttagtccattgtctctattgtcaaagtatgttcagaattcaacaatttcctgtcctctttattgccagcacactagccttagtcaccattgtctctcacctggatttctgcagaggcttcctgtcgggtctttctgctgtcacccttgacaccttccctcccgtcccatgcccaccacgtctgttctcaacataggccagagcaaatctttaaaagtgtttcagtgtgtcactgggtcctcagaactttgcagtagctccccatctctcagagtgaaaggtagtctttaaaatggccttccagattctacatgacctggctcctgttacctctgaacctcctctcctacttcctcctgtttctggaatatatctggcatggtcttaactaggcctttgtactgtcccttatcaggaatactcttcgggcagacttcttcctgcttaactctctcatctcttccattcagtctttgctcaatgttcctgcttaaaattgcagctcatccctgctacacacaatcaggagacttcccaccctactctattttttttttatataaaacagttactgtgtatcaagttaccatataatttactttgtaattatattattaattgtctccccccaatagaatgtaatccaaaaaaaaaaaaaaaaacagaaataggctctgttttgttcatagaggtaactcatgcctagaacagtgcctggcacatgcatagtaagtgcttcaaaagtatttcttcatagaatgaattgaatcaaaactggtaaagttggaaagttggtgttaaggggaagatatgagttcagtattgtccttttgaattttagaagtaagcgatagagctttggaaagagaataataggactatagatgaagttatgggaatcatgtgcacctaattcatcagcaaatcctgccagttctacctccaacctaccttcaagctgtactgcgtttcacctttaccacagtcatgtaagccagtattgtctatcacctggcttattacagcattctgcaactagtcaccttggatctgcactgaaccctcaacacattttgagctcaacacagtgagttggaaggcaaggatccagggaagatgaacaccaaaacctgcagaagagagggaataattagtaaagaggtatctgaaagaaggttggagaaacagaatgagaaggggcaaggctgccttttcttttgaattaacgggaagtggctttagaaggtcaagaaggtatgagtaagtttaccccgttagaatggctaaaatcacagagactaacaacctaaaatatcaggcaggatgtagagtaattggagctttcatactttgctgataaggatttggtatggtacaaactctttggataattgtttggcagttgtctataaagttaaacacttacttgtgagccagtaattgtactcttcaatatttatcaaaatatgtaaaaacacaggtgaaaaactgtttatagcacccttattcagaattacctaaaacaggaaacaactctgatgtccatcagtaggagaagggattgtgatatattcattcaatggaataatattaaacaataaaaaagaacaaagcacggctatacatagaaaaatgaatgcacctcaaaaacactaggttaagcaaaagtggccaggcacaaacgagtacatactgtatgattccagttacttgaatacataaaatccaagaacacacagaaaacatttatatggtgacagatgtcagagagtggttgcctggagtagtggggaggaggaagggaattgtctggaaatgggtagaagagaactttctgggtgaagacagtgtgtgctatcttgttttggatggccgttagccaggcacacacagttgtcaaatttgtcaaactgaactcttgagatcggtgtactgtactgtatgttaattacacctcagttaaaacatgtaatcaaaatctatgggcctatgttgggaaattctgagataaacaagaaggaaaatgtgataccttaaatgcagtggctcaagtcttcttagaaaagtagggtacaggccaggcgcagtggctcacgcctgtaatcccagcactttgggaagccgaggcaggcagatcacttgaggtgaggagttcgacaccagcctggccaacgtggtaaaccctgtctctactaaaaatacaaaaataagccgggcgtggtgacatgtgcctgtaatcccagctactcgggaggctgaggcaggagaatggcttgaacctgggaggcggaggttgcagcaagccaatattgcgccactgcactccagcctgggcaacagagcaagactgtgtctcaaaaaaagaaaaaaaaaaaaagaaagaaaggaaagtagggtaccaaattatgtcttgagcttgatacatgagtgattagactggaagagtagaaaaagctgagaccagctactttacgaaatgtgacaggacgtcaacaagagaaaactaaagtattaatgggcagaagtgaagacccaggcaaggcagccagtgatgactatgccacagtggaaccaggcaacatgattttgtggtttacgggtgagtaaatttgataactgctagttaggaagccagacaattggagtctagggcattcatgtctttctggaagcctcggaaaaggtgaggtttgaactgtgccttgaagaataaggtgaattttactaggtagagaatgtgcaggtaggatatattagggtaaataaaatgtatcactaaaattaactccacctgcttcttttgattttagtttggctactagaaaattttaaattatgtatatggctcaagaacatatttcttttggacagttctagccttgaggcatagagataagctattgccgtaatcgaggcaaaagatgatgaatgcctggactcagacaatggcagcagggatcgaggaacagtaaaattcaagagatatttctaaggactgaattgactgatggaggttagtgattacatttgatggggaaagggtgatggagcaggacaaatcaaagattgctccaagttttctaacttggataatattgattgggaggggaagccatatatcacattagagaaaatacaggaaaaaaacgaagtagatttgcaaggggaataggaagaaagaataccacatattgactcccaggcacaagtcacatattaaatcatgttcatgcctgcaaagatgtaagaaattatgacccagagagaatatttagctctgtggaaaatcagtcagctagaaagtggaagaactaggattcaaacccacaccagtggcggtagtaaatgcctttaaaacttggaaagggccggccgggcgtggtggctcacgcctgtaatcccaacactttgggaggccaaggcaggcggatcacgaggtcaggagatcaagaccatcctggctcatctctactaaaaatacaaaaaattagccaggcgtcatggcaggcgcctgtagtccagctacttgggaggctgaggcaggagaacgttaacctgggaggcggagcttgcagtgagtggagatcgcaccactgcaatccagcctgggtgacagtgcgagactctgtgtcaaaaaaaaaaacaaaacaaacaaacttagaaagagccaatgagcaaactatggtttgggttctgtaggtcgatgcgtgtgtttatcctgggtcacactgtgagaaggctgtgtgctgtaattagagtttgctctaagaactgacagactaacctggcacacagtaatcagaaatggcaagattcatattcgggggatgatttttaactaaatgctagattacagaatctgtgtcattaaaatcaaacagctgcaaacaaatatgggtaaagtgcagtcctatggcaaacacaacaaataactattgtgcttactgtcttagacgtgtaaaggcccaggctatgaagatgaggctgtattatcatgaggacatgccctgttcatgttgtaaaactttttttaaaactataccttaggccaggcacgatggctcccgcctgtaatcccagcactttgggaggccaaggcagacagatcacttgagcccaggagtttgagaccagcctgggcaacatggcaaaaccctgtcttttcaaaaaaaacaaaaattagctgggcatggtgacatgtgcctgtagtcccagctcctcaggaggctgaggtgggaggatggcttgagcccaggaagcagaggtttcagtgagccaagatggcaccactctattcccacctgggtgagaaagcaagaccctgccccacacatgcacaccctgcccccacaacacacacgcacaaattataccttgttttctttgtattttcttcccttttaaaatgtgaaagatataaaatatttcagttaacttagaattctagttaattggattagattttcctgataatacattttggtattatgatctatgtttcagaaaatgtaaatttccacagaaaaataattatataagaaaccattggtatgagcactttaagaatgtagatttttccaagtgtatataattaacatagaagactgaaagtttcaaacaacgtgacataattataaattgttgtgaaacaaaaaccaaagaccactgtggcacacagcaattaggaatgataaaactgtttattgttgttgttgttgttttgagacagagtctcgctctgtcacccaggctggagtgcagtggcgcgatcctggctcactgcaacctctgcctcctgggttcaagcaattctcctgcctcagcctcccgagtagctgggactacaggcgcctgccaccacgcccggctcatttttgtatttttagtaaaaacggggtttcaccgtgttggccaggctggtctggaactcctgacctcaggtgatctgcccacctctgcctcccaaagtgctgggattacaggcgtgagccactgcgcccggccaatattactgtttttaaaacagagactttgtactgattcttgagtagcagaattgcacacaacagcatattctttttaaacagccacaaatcagagattagtcttaaaatgagaacatttttgtaaagacagttacttatctatcatattggtcttttcatccacacttaagtagccatcagtctggaggaacatacttaaatgccagccacagcagtataatattttagtttactgagtcacttacttcagtaccgtcatggtaaactcaggcacaagtctacatttaattaatagtacattaagaaatgcagtagccttgaagaattccacagcggagttgatcttaatgccatagtcagtgttgagaaacctactcattcacagatgggtgtacctctttccagtgactcttcccaaattctagcaaactgatatatcagtcacttctatttagagctaagtagaaaaaaacaaaattgaaggcaatcaggttaaagaaacttcctgtagtggttttaaaagagagtagaaatagttgctcacagatttgataaaaaggcttgaattcacgtaccaactcatattcattgtgatacctgcctgattcagggatttcagtaatttttaggatcttgtgggggtcagaagtgccataaagattaatgatacctgttaaggtcacagactcaggctggcagtggcagttggggagtaggagaggaaataaagagagcttcatatagttcatctaggttctagggcttggctttgctgctttagcttagatcaaatagtaatttttaaaactcttgtttattgatcatctaccatcaatacggattgtgccagatattatttcaatgatttgcattctccttaaacctccagaggtagtattcatagctgttaatccacattttctacattagaaaagtgagactcggggatttaaaattgagtcagccagactccagaggcgtcacttaggttttgtatctcagcattgtcaggatttgagtaggacttaccgaataataacgctttctggaatagagccaaagtttgtgtgtatatacgcttatgaaccaaatatatatttttatattgacaacataaatgtatcaaatcaattaaaaatattaatttggaataaatctccatagggtgtttttataagttttcaagtatattcctcagaacaaacattaaagtaagctttttgacacaggaatcaaatccctcacatcatatttttcagagagcatcacactattatagtgatgaaattttgtgtgacaccatcagaaacaactgttcataaaagaagcaggggtattattacaaggaaatgttgaaaattcagtatatttgtattttagcctagtttcccagattgaacgaatgccacaaatatttattactttagagcaacatgtcggttaaaatttctgaacagtttctgaaggatttgaaggtgggtactagagagacagagaaaagggaatactgaagctttatatcagaattgaattgtgcgatttcatattaaaaagaaaggagaactatagttctcttccagttattcccaaatgttatgttttatttattaataaggaaaaatattgagattcatatttcacacatcactgaaatgactgtgcttaagcagaaatttttttcacacttgtcattatttactactttttagagcagaaaatgtatattttgttgttcaggaataaaaataggttacaataaaatatgaaaaactaaaattaattcttcttaaaggcatttagctaaaagtattttgtatttcatttcaaacacaggaaagtactttaattcaaaaaagacttagtttttaaatatactgccttctccattcatgactcaaaatgctttctcataatttatcccaactctcataattttttattacaacaaacttggaaatttcgtttggttatgttatttgtattctttcatatgcctcttttcaatcttttaaaatgacttgtcatgtcaaattgaataccgtagcgtgtggatttctactcttatcagaactgcaatttaccatggctttattatttattatttatttattcactaatttattctcctctttattccagaaaggatactcataggaagggcttacttatggattgctgtcatttggtatgcattacttcatgcatttatttattgccatctctactaaattgtatttatgaaacttttcctttattagtttcttgctttagaaatgaagcaaatgaattctcctgagccactatatacttatttaaaatgtaagagcatttcattgagccatttataggttttatgtattatgtattttaactaaaacacattaaaatgtattattttggcctttctgacagtcatttcaagtgacagagctttcattttaaatggcaaatcaccttctaatacacctaaaactggttatatttttgatcctttttctcttctcctaccctactattgtctcaaactctccctccctgcaagatttggtagtaagaacgtaagcttctcaatgagctatttcaaaaaaatttttttacaatgcaattgcggatggtttgttctgcttgcagaatggtattttattctactcccagacatatagccatatgtttcctgtcacctcggtgacacagataagccttacatctggctgtctttacctaggttatctccccaacttttgctaaacttgaagctaatatcaactttataaatttttggctttataaccgatttttgccttctaaacaaaggattaagaaaagccccttattactgaggaagcactgaagattttgttgagaactggttggcataaacatgtggtaaaatcgtacagaagaaatacacacacacacaccaggaatacaagtaaaactggagaaatctgaatagaatcaatggattttatcaatgtgattatcctggtattttacaagatgttaccattgggagaaactaggtaaaagtatacacaatctctttggattacttcttgaaacttcatgcgagtttacaattgtctcaatgagatttttcattgagaaaagaaaaacgggttggtaaactttttcttaaagggccagatagtaaatattttaggcttttcaagagccatgaggtggaaacttctcaaatcctttgttttatagcacaaaagcagtcagtacatgaacgagtggcggctgtgttcccatgaaactgtgttacggaagtagatggcagcagacgatagtttgcagacttctggtttaaaaagagacacaggcttttaatattccatctgctgctcccttgaaggaaaaaatgtggtaacaaaagctaattatatatttatggtgttgtgatttgcagcttattttctgtcctcatgattttcttaacttgtatatttatacataaagaataacatttttgtttattttaaatattctaaaaagcaccactttggtatcatgcttctctatttggggaaatcaaaacatttaaagttacgtgtcttagaaaagtaagaaattctttttagatataatactgtattaaaggaacaaataacactgaatttctgtccttaaggttttcatccctaaacatgaataataataagtcagagagtaaagttctaggttgaaatagcaatttctgcacatttcctcatttttattcatccggttacagagttgaacatcctctggaagaatttaggttgtattcagttattctcattttcagggtgggattaagcatgaccttatgcagaattccactttaaacaagaatgccctcaagcttactttagacaatgttaagaaaatccactcgatgagattttgatatttattcggtagatttttttaactttttctttctcttcatcctgtcacatcatgagcagtttgaagacatcaggttcagttccctagcaaaaccaagtttcttcctcctagtatgtttctttttccttctgctttgagtggcttctgtggaaaaacatcttatatgtgggataaaaacgaaaacaatttgtgtgagagacacacatgcggtaggtctgtactcaatgctgtggactgttaaaaacaaagaaaggttttgctatttaaaaggagaggtaatgcaaatactgcaatgcactcataagaaaaaaataaattttccagtaactataatttaacagcaatataagccagtcctgtgtagagttctaaaatgatgagagtggttagagccaaatagggttcatatgatgagatcttgtgatgtgaagtaattttaaaagatgaaagatacttcttaaatactttggaaattatatggttgaccctcttttttacccaatgcttcatttagtgtgttgctaaagctaatcaatttattctgcctcttaattatctcttgaatctggccctgcatgtttatctgcattgccagggctttcgtttatacactcaatacaatactataaatctctactaactctcatcacccagcacctaccaaaggcaacacacacccacatacacacagcctccacactgctgttagggtagtcgtcataaaatgtgtctctgaccttatcatgtatttgcttaaaaccattccacagctctctttggctaataggataatatgcaaatgccgaagcggaacaaggcaaggcccatgaaaatctttattccacctgtcttccaggcttcctttcctgcctcttgcgagttctcctaccctgtcccagccccacccacaccctctgtgttctagccagtctgaaccacggcagcttcgtgctccctctcactgtcatgccttagcctctttcggtcgtcctgaaggcttctctgtttggaatatgcattcttcacagcaactaaagcattagcttatcggaaaaaccttctgagaagctttcggaacccagcatatttcatctcttagattatttaccagataatacttcatctctctgtatatctgtatgctcaaaagcgaggaggcaataaatatagtgtagtagggaggaaagctttaaaaaagcaggaaagtatctgtttgactcatactggaattcctaggactttgaaagtacctgaagtacagtaggtattctatgtaggtgtgttgtataaattaatgagggaaacagtgaatgaataaatgaaggcaagaattgtgtcttactccttggaatcagattggatatcagcccacgaggcatttctaaaggtattaagagtttaaatgaggactctgccatctgcagtattgctatattgaagaaatgaatgtctaaaggaaattcctaatcatcaagtaagaaaccgttacacaggagactgcagtggttatttcagaaatagcagtggagtcattcacagttaaatgcacgcgctctattaacaacctaggaatccagggaatctggaagaaaaataaatttggggaatctatttttattagcgtgaatatctatggttttcatgcacataggtaatagtacttatttatccagtattaactatctttatgattcctcaagtactcagaaacttaggagatggtacacataaatatcctaacatgtaaacatttctaaaccattatcacctctgaaatctaatttattgccttccctcctgaggaggattcccatttttatttttaagtttttgcttaaatgtcatattttcagtaaatgctattctgatgacccaatttaatttttttttttttgagttggagtcttgctgtgttgcccaggctggagtgcaatggcgcaatctccactcactgcaagctccacctcccaggttcaagcaattctcctgcatcagcctcccaagtagctgggattgcaggcacccaccaccacgcccagctaatttttgtatttttagtagagacggggtttcaccatattggccaggctggtctcaaacttctgacctcgtgatccgcgcacttaggcctcccaaagtgctgggattacaggcgtgagccaccaccccagccccaatttaaaattttgattccttctccagcagttctaatcgcctaccctgccttgtattctgtcaatatcaccttccctttcatttactaatttattatgtttcctgcatattgttctccccttcttcccctccacttgctacaatgtaagctctacaagggcagaggtttttatgtttgtttttagctgtgataggtgcttgataggtgctgtgataggtgcttgagtgaatatctgtggaatgaatgaatcaaccaatactacatgagtctctcagctcacattcttaagaaaatagtcatcacttcacagcctgattgctgtcacatggcccttaagaaaatagtcatcacttcacagcctgattgctgtcacatggcccttgtactctggaagagcactcaggttaatctccctctgacttcttttctcataataaatttcttcccaggaacctctgtgtggcctaccaaatcaggtacagattcttccacttggaggtgaaagtggttggttggccccactttatctatccagaactctctcttaagttgctttccaaaccagtgttgtttggaaatctccagtcttcctgctttgactttgctaactgtgcttctcttcaaggtttagctaaatgttagtctacactttaagccttcgaaaccaaccccggcacaaagcaaatgtttccttgttcaccttcttcatgtagtttattattttgcacctgcctgagatttgtgttctcgctgtctcaggaatggaagtcccatctcctcaattagggaataagcccctttaggccaatacacctgccttcttctgtatctccacggtacttaacattatggataaatacagttaggacttgtggcttcgcagcggtgaaccattgttggttctagacaaaaaacaaagttttgaaaatgccatgttggttttaaacagaatatattggagtagagaaagtcagtaggcagagagagcagcattctatttcctcagagcacatatctagtcagcagagagtgatttatttaataaatgagaggtagggaagggtctaggtaggataatgcaatgggaaaacagaggaaagaacataaccaaataacattttgaataagctaacaagaaaattgttgatttggatcaaagaatcaaagagcaagagtcaaaatgtcaccaaacttttgagtagaaaatggggatttcagtggaaaggtgaaatagttgagaaagaggaggagatcttggattgggcagagagtataaaacgaggatgatacatttagtttgggacagatggacagtgcacatagggaagagagaaatatgttttcctttaagattttttagtagaagagtaatgacattacattggctgtaatggatttttgaaattatttccacaaatttgaaaacttctctttttttccgccaatatggattaattttcagggatcatattttgcagtgaacctttaaaatctcatcagcttattttaaagcaaagttgttacaggactctggtataaggaaagttacattaattgaaacattcatactagtataattgtgctataattctcatttgaagtttaaatgaggtttagtgctggctacagagggagggacacactggaaactaatttatctgtgagaaggcagaggagcagagtatgacattttggtccttttgagaaaatttgcaggatgttgaggtccgttgctgctgctgctgctgtttctgttgttttaaatagtatataactaagggtgaggaccattagaggacagaaatcacatcttaatcagctttgatttttttatgtttaaaaaagagattgagattcactttgtagtctagggagtttaattaaagtaagtggagacaaaagtactcttttgagagctgtcatttctcttagtgtgacgctattaataatgtagtgtaatgctattttggaagtttggttctttccttttcttttgtcttcctctgactcttttctgtattctaaatgaaaggggaataatgcacttagaggggggcactctcctaaattcactgtctcatgtacgacattatctccgacttcggctctcatgttttgaaaaaatacctcttcatcgctctatttttatttttcttcttcttttattgtgaatctcttttaccaaaaacatttgtagggttcttcacaaagattttttttttcaatcaggatgaaaactagatcatgatgtgaccatttcactgtgagtgtaacttccctttttgacagctccattagatctgccaggttataaatcttcatatttctgacttgccttgaaatcagaaagtgttttcattatgctagtctctgtgagcaacaagcatgaaggaaggcatggcaggtatcatagcccctttgatgaacttacctgtttcaactcagtgccagggcagaacatttactgctaaccctgatgggtcaactttgattgcaaattatgtgtggtacattttgaatttaaagaatgtttctgagattattctacgatcacttgtcatttttatgtgtgcagtaatgtgttgtgtataacttggatttcaacaatatccattgtttgaaagttagaaaatattctaagaatactaattatcttgctcaaataatcatttaagtacaactgtcacttgattatggtgaatatttttaagtaaaattatatatttaaggtgtgctacctctaattttattgtcatacaaaaagcagattattgaacatgttaatgtaaattgtacttttaattttttccagtactctagaacatgtgtaaggttaaaagaatttaaattacccaggtttttctttttacataataaataagaagaaatcacaaaggaagcagatattatattgtttttaatataacatgaaattgtttgactttattttgatgacctcacaaaagtataaacatggcagtggtgtgtatgatcaaagtaagaaattaaagagttaccggttctttataaaccagaagtccattgacttttaataatgctgtctcaaatatttgatagtaaattgtggaaataatcaaagctgagcctatgggactgtactttgtagtactgtttaatttaataactctaataatcccttaagaatattaggaaaaataggccgggtgcagtgactcacgcctgtaatcccagcactttgggaggccgaggagggcggatcacctgaggtcaggagttcaagaccatcctggccaacatggtgaaaacccatccctacaaaaacacaataattaggcaggcatgatggtgagtgcctataatcccagctattcaggaggctgaggcgggagaatctcttgaacccaggaggcggaggttgcagtgagccaagattgcgccattacactccagcctgggcgacagagcgagactccctctcaaaaagaaaaataaaaaagaaaaaagaatattaggaaaaatatcttaatgcaaaatatattaattagtaatctgccaacactgagatgtactataaggccaagaagaaaaggaatgatatctagagtcttgtcattttttaagtcattgcttttagagatttttttaacctcacatatatttttgtttcttagcataagagggaggaaaatcaaaagctcaaatagagaatttaaaaatgagacaaaagaccgcccacatactaaaaagtgttaattataaaactggaaactaacattcaaattattttttcatctctgttcccctatttaatatgcagtgtagtttccctgtaacggaagaatgcttctgctatcacggctggactggggtctccacactggcctttgctggatagcactctgacctccagctcaaagtaaagcaagcattcttccatttaaaattgaatttctacggtactgccttaatacgaatacttcctcttcatttccttcttgacaacatgcctggaacaaaaatgacaaaaataattattcctgtataaattagtatggagagctttggggtcatactctgtgaccattgccagatttcttgatttctctgtacattttttcccacttgtgaaacaggaatacgtacctacagcttaaggtagctatgagattaaacaggatagtgcatgttaagcctattgcgtaatcagcttaataagctttcatgagtataaatttctgttgtgtattccaccggcctatgtgtgtagaatccatatagttacgttgaacctagatttttagtaagtcttttttgaagttactaagtaattaaattacttataaccaacaaaacaaaaaaaaacatataaaatagaggagaactatataagtcctttttttaaaaaagtagcaaacagtattttttagtgtcagggattaaaggaattgttttagactcgatatggacgtgttagaatgctttaaaaatcgattctagctaatggagagaatgtttttaaaatgaactattgccattccttcagtgaaccacatacaacaagaaaaaattcacataaacattgaaggaaaggcaagctcttccttacagaagtaatgagaatcgcagcgatttgccttggggaattagaatgtggagactcttttccctgtgcagtatcccctaatgtctaggagcagataagtagcctctaattttaaatgtgcagttatccaaacaagatgaatgtgcagggcaaagctggataagaatgtcgatcttaatgttaatatttttattctccttcgtaatcgacatatagttggcaaaagccaaatgtctgtgagatccctaaagaccacagctaactcaggagagctgtagccagctttatcttacatcagctgtggagatctggcccgagggagacacatcccagaataagccccttgccattgtcctttacaatgttttaaatcagttattttatcttgtctagatttatattttgtaaaatgcaaactgataaagcatgacagcattcaagacatagagttagcaactgaagcttaaacctctgtgtgtgtgtgtgtgtgtgtgtgtgtgtgtgtgtgtgtgtgtgtattttaggtaaaatattatatagagagatttagggaattcttttaaaaactggaaagaaagacattagaaatcataatctactcccctaatattacagatgaaaggaaccaagactagaagagtaaaatatgttagtgataaagccagtacctaaatatgttagtttgtgttcaaagtaaaaatatcaaatataagaatcgtcttcttttcatttatatctccctaatttttatataagtaagattctatttttaattctagatctttgatatatgaaaatgacttgtatttgaagtgtttaatttttgaagtttttaaaattaatgtcagaacactagattcctcttaaaagtaaattagtaattatattttaaaaataaaatatacattttggcaatacaaacccagttatcatttaattgttagcatgtgttttctacagatatattttccttactaggcagataatgtacatgcttgctaatgaaagctttgtgagctatgtgtctttggcacttattttgcataaattataatactgtgttttactaaaatatgggttaaagcaaatatattcaagacagtgtgcaaatgtgaatgcaacagattccaaatagatgattttttattgataaatagtaatataagttttactgcagttttaagaatcatcaagattttcaacagaagggcttatttgttttaaaccctaagccgcctttctgaaacctgaaaaagatttgtgaaaacagcctgcaataaaaatcacacacacttcataaaacagtacttgatagatatcacttgcaccattaagagctaaacgacaaaggatgtaatttcagttctggcatgcaatattaatcgaaagcctttaaaacatcttgctgatgggaactatgacaacatgacattgaagaattatgagctaaagacatctatcttaatcagatttttgaagtaaatgccataaaacataaagttgttttcttcatctttacatttttacatgtttttggtgggagcatgattttctagtgtgttgctttaaatgcagagactgcaaaatcagtatttaaaagtatgagttcagtacacagagttgaagcaaattttagtcaatacactctgcatacacagggaattatttctgtaataatgtacatttttccatcttttatgccagcgatttgtcttaagcaaatactttaaataaatgatattaatagatattttggaaacataattaggtgtttctttgcctttttttctttttttgagacggagtattattctgtcgcccaggctggagtgcagtggtgccatctcggctcactgcaacctccacttccctggttcaagtgactctcctgcctcagcctcccaagcacctgggattacaggcgcctgccaccatgcctggctaatttttttgtatttttagtagagacagggtttcttcatgctgttcaggccggtctcgatctcctgacctcaggcaatccacccacctcggcctcccaaagtgcagggattacaggcgtgagccaccgtgcccagctgtatatttgcctttataaatttagaaatgaaaacagaatgcttgtaaagacctccccatagaaagaaattatcttatggatatactaacatgtaaacatctttttttcctaaaagaaatacggcaaaaacatttattactttgtttgaataattaagaaaagcctggaaattaactccttccactaaaataacacttcacagtttataaaaatactttaatatacattatctcctttaattctcacaacatttccttttaagattgattattaccccattttacaggtgaggaattggagtatttacaataggaaattgatgatatagttactaagtttgggacagggagcttaaactgtcccatttgggacaggaaaccagatgttatgggctaaatgtttgtgtcccccaaaattcaaatgttgacgctgtaatcccctatgtgactattggagctagggcctctaaggaagtaattaaggttaaacgaggtcatcagggtgtagccctgatcctgccgcattagcatccttataagaagagacaccagagggctttgctctcctgcattgctcccctgctgtctgcctcgcctcagcaagaaaacagccatctgcaagccaggaagagaactgtcaccagaaaccaaccgaccctgccagaccttgatctgtgacttctggtctctagaactgtgagaaaatcatgtctattatttaagccacccagtctatggcattttgttacggaagcttgagcagaccagtacgtcacatctctattctcttcatgatatatccagtgcttattcatctcttctatggacaattttaacaaactggcaccaaactatgtgtagactcatgaaatgaaagctcataagatccatgaaagactatcttagttactgcttctttttgaacctttatgttgagaggaaggttcctagtggcagtgagcatcttgaagaaagatgcaggcttccaatctcaatatatcatgtttactactattttaaaaggcacaaccggctgggcacagtggctcacgcctgtaatcccagtgctttgggaggccaaggtgggaggatcacttgagaccacaaatgtgggaccatgtggggcaatatagcaagacccccacctctacaaagcattttaacaaattagctgaggatggtgctgcatgcctgtagtacccgctactcaggatggtgaggtgggaggattccttgagcccaagagttcgaggttgcagtgagctatgatcacagtactgtactccagcctgggcaacacagcaagaccctctctcttagaggcacaaaaaagccttagaaaatacagattattaatttcccaaacaattataggaccttacatttatagtacttgccattcacggggcattgtcatatacgtgatcttacttcgatgttggccctcatgtctcccatattcagtattcttttcagtgtaccatcctgcctttcataggtgctcagtcaaagcagcataaaagcatatattgggaagaggcttttagtgttgtatacacacaaaaaacatacccccaaattgttaatgacagagaagggaattcagcaaatacacgtctatggtagcttcatctatgattctattttccttttaatcaagaatgatcattacatggtttccacttaacagatcactctcattgcacgtgccaagaatagaaaggatacgctgggttccattgaagttcattgcatctacatatttcatgttcatgataatacatatctctgcctagatgtcatactatgactggaaggacacttaaatgaatatttgatttgactttgatgtaaaacattaaaagacagtagggactcaataaactacaggtaagaaataacatatcaaataatatgctagaaaaaaataactgcaaaattaatatatttttgagaagcaagatcagtagcgtcattgggaactttatctgtgtgctcttcaattatttgtttttcctatagttgctgaaatatttaagaaagaagaatcagaaaaaaagctcaaagcagactgaatctttttgctaaaaataatttttaaaatgtattataattgtcttcataacttttataaaacagatcagttttcttttaaaatttttttttaagagacacagtctcactctgttgcccaggctgaagcacagtggcatgatcatggctcaccgtagcctcaacctcctaggctcaagtgatcctcccatctcagcctcccaagtattaatagttggaactacaggcacataccaccatggccccattaattttcacatttttttgtagatggccaggtgcagtggctgacacctgtaatcccagcactttgggaggctgaggcaggcggatcacctgaggtcaggagttcaagaccaacatggtgaaaccccatctctactaaaaatacaaaaattggctgggctaaaaatacaaaaatttttgtactaaaaatacaaaaatagttccagctactggggaggctgaggcaagagaattgcttgaacccgggagacagaggtcgcagtgagccaagatcgcaccactgcacttcagcctggcaacagagtgagacttcgcctcaaaaaaatgttctttgtagagatggattttgtcatgttgcccaggctggtcttgaaatcgtggtctcaagtgatctgcccacctcggcctgccaaagttctgggattactgatacgggccactacacctggcctggttttcttttaagcttgaaagatgcatcctagccttttacatagttatttttacaatttgtttaaaaattttttacattaaaatctgaaataaatttaagttggatataaagtgattttcattatatgtaccttaagatgttaatagttataatacaagataatatggatgagtttatttttaaaataaaggtattatttttaatgtctttaatataagatagtatggtagggtattttatgacttgagttaatacagtgaagttttcataatacttgaagtaaaattttttgtactatcaatcccttaaatgttttatatgtataacttaagatggtatgatatggtttttaattactttaaatttcaaatacccataacataagctaatatattttaagattttataatgtattacctaaaataaagggaattttaaaattgaaaaacttcagacttcattgcatgactccaatcctgctctcccctcagaagttaattgatttatatagttaggtttagttagagtaagtgctcagtcctgtgtctcctgtttccttttgtagtactcttctataccagacattttatttgtgatatgttatctgaaaagcatagcaaattctgcattgtttgaactatgtgatttgctttccttactctttataagccacactttataagtcacaataatgtagctttatttgccttccaccctgtccttatctatattacaaatgtgttttatttatatcatatcatatatactccatttaaagtcaataaaatttaatttcactaaaacgaaatgctcataataaggtaataaggggagagaaaagcgttgattgatttatgtcagttctttattgtcaagattgggacagcttcttccttttttgcttactctctcaggtaaaatattttaaaatgggtagaagaatatcctgaaacatacactgagacattttaaaggtatttttatccagttttttatgcatgtataaaagatatgtttatgtatgtttctgttagaaatgattatgcaaaactaagaatttcataggaaaaatgtgtctgaggcattatggttgacaagataaactactttaactatcaaaagatagccatgtacacttgttttcacccactgaaatagttcagagtgcttgacatttagattaactgcacactttggagcagcaaccattgaagccagaacaatatctttgaagagaagttactgccactcaagataagttgctttttaaatagaagataaccagaaattctgctatccagtaacaagaagagaatagcagagaccattcatactaaatgagaaagacatgaataaatatatattctgtttaatttcacaatcataagcatggtattaggagctttggagaaagctgttttaggagctctaaagaaagctctattcttgccttctagaactcctactggatgtatattgagcttttctatttttttttctttgaagtactcgtatatatgtaagcactctttatctttctggtactatctgaatgattttctcagatctgttttccagtttaatggtactctctataattgtgtctactataccatttaaacaatccaatgagattttaatttcaatgactacatttttcctatgtacagacattctacttttgtcaaaatcgcctcttattttttcatagtgtctaattcttaggtttttaatttttttttttttttttttggtccttaatcattctgaacatgcttacaattttatctgacagatacacttaccccaagtttggggaagacaaattgctgctttttgttttgtctgtagactgtagctgaaggtagattgtttcctcttaaattttgtagtttgtgaactcactgaaagcaaggttcggtcttagaaatcctttgtgacttggtttgagagtatattcttttaaaaacggtttgcggccgggcgcagtggctcacgcctgtaatcccagcactttgggaggccgaggtgggcagatcacttgaggtcaggaatttgagaccagcctggccaacatggtgaaaccccatctctactaaaaatacaaaaaattagctgggcttggtggtgtgcgcctgtaatcacagctacttgggaggctgaggcaggagaatcgcttgtacccgggaggcagaaggaggtttcagtgagccgagatcgcaccgctgcacgccagcctgggcaaccaagcaagactctgtctcaaacaaaaacaaaaacaaaaaacgtttgatttgcttctgccgggtgcctcaggcagaagcattgctgacccaagaccacttttaatattaatttcttggcttggggttccagaaccataatgatagtttaagtttcaatctaatattccaatcccagggaggcccaggctagtgggtaaaattttcctatcaggaaaaaacaagttgtttaagacaacataggagatttcttattgttccctttgcagtgagaaaatttttaaagtttcctctttgaatgagggcgtgacacttcaagggtccaggcgttatctaggagtctcagtaacagttgagacctacctagtcttctccttgttcattaaaaaggttacagagggctgggcatgttgattcacgcctgtaaccccagcacttttggaggctgaggtgggaggaacacttgagcccgggagttctagatcagcctgggcaacatagtgaaaacctgtgtctacaaacaatacaaaaattatccaggtttggtggcacatgcccagcaatagagcgagaccctgtctcaaaaaaaaaaaaaaaaaaaaaaagaaaaagaaaaaggtgggccaagtgcaatggctcacgcctataatcccaacactttggggggctgaggcaggtggatcacgagatgaagagatcaagaccatcctggccaacatggtgaaaccccatctctaaaaatacaaaacttagctgggcgtggtggtgcacacttgtattcccaactactcggggggcaggagaatcacttgaacctcagaggcggaggttgcagtcagctgagattgcaccactgcactccagcctggagacagagcgagactccgtctcaaaagaaaaaaaaaaacaaaaaaccagaaaaaagaaaaagattacagaaactggcagacctcctcaggaaagctatgccagcttacctgcactttacgttttttctcttccctctgcttttggcttattctttctttccaattcagtcaattaacccaaagtgtaagttccacaggcaggctgagattgttggctttttgttcatggatataacttcagtgcctagaacagagcctggcataaagtaaacactcaagagatgctaaatgaattcatccaaaaggtagtatatttaacccaacaattctaggtgttttatatagcaaggaagttggcagttaggtaatctaggttgccgcattgtctgaaatagaaagtacagtagaatctaaaaaaagagagagaaagagagagagaacgtgaagatttagattcagactttgattatttcttctaatcctcaaagcatgaccctaaagatactaaaccaaattctcactaacccagtaagtacagtgaatcacttcatctgtgttcatctgagtaataccttctaggcagtttaagtctttcttttgtatccttttatttatcaccagggcatttcatactcagtgtctttttataaatagttttacaatcaattgatgatgaaggtcttaagaacaatagtgtttacttatattgcatcataacaatgttcaaaacacattttgaaatttcatttgatttacaggcaactatctgacagatatttacggtggtgaaaatttttacacagtactgtattttaaccaagggcttacagaggtatttaaatggaaaactcactttgaaacactgggcttgtgtgagaattctagaaaaaataatgaactacaggaactggtttatgtgaaagtgattttctgagtaaaatgaggtctttcttttccaatttttattatgccattttaggtggttatattattaatagaatatttgaggggctggattggaaaacgaaaggaaaagaaaacccctgaatatctgtttttgttttccgatgagcttcacagactttgtgatatgagtataagcacctatttccttaactcaaattttctccatttataagaaaaattattgccacctaatttttttccttcagagggaaataatgactactaaatgtctgcaatgtgtgtgagattttctggacaaaagaggcattttaatggtaatttactgttttcagtgtcataaaaatgttgaatttataataccacctttcttttcttctttttttttttttttttacatctgcaacagatttatttttaaaggaatggattataataccacctttctaatagctcctgaaatgtaaccagatcagggaagtgttgttacctgaagttacctaactttagaaaatcaaggagaagcagtttctggaaagccacagagttagtcgataatgaaataagagattaagctacaccaaggattagattggtattttcaaaatcaaaaaccaactctcgttttgtccttgtacacttggaagatccacctgaggctctggccactgtagttaaaattcacatgatggagccgggcatggtggcccacacctgtaatcctagcgctttgggaggccaaggtgggtggatcacctgaggtgaggagttcaagaccaaccaggccagcatggtgaaaccccgtttctactaaaaatataaaaaattcactgggcgtgttggcgcacgcctgtaatctcaactacttgggaggctgaggcaggagaatcacttgacggaggttgcagtgagctgagattgtgccactgcactccagcctgggccacagagcaagactgtgtcaaaaaaaaaatcatatgatagtaaaatatacaaaaacaaaaagttttatacaatttgttttgatgacttgtttttaagaaagaggtcaattttgaagaagacttaagttttgtttgagacgagagaaagtaaagatatagccaggaagtgaggtgaaaacgaattttaggacacagaaatgaagactttaattccatcctttgcaaatcatccataaatatgtttggcttcttttaaatgttcgtcaagttcaacaattgaaaaggaactgacagaatttggtttagtatctttagggtcatcctttgagcattagaagaaataatcaaagactgaatctaaatcttcacattctctttttgtctttgagagtccagtgtactttctgttttaggcaatgtggcaacctagattacctgacaactcccttgctatataaaacaatatgtgtatcatattgcaagctcttaagagggctaaggccagagggttttcatttattccacttgctatcattattattcaggagtaaggaagccacatgctgatgaatgaatacccaggaggtgttttgtgtaacggtgcttctcagattctctcacagttttgtgaaattaaaactgtttctgtctctctgtctgtctgtctgtctccctccacctccacccagtttctgcctgtccctctctgtcctttcttcttccgtccctccatcttcctttctccatcccttcctgactccatttgtcttttgatgactgactttactcaaactactcgtattctgaagcagcacagctgtccgcccttagcttctatctcccttccagattagggtatttgttccctggggacgtgtgtagccaggccacatggagatccagggaaggaggggaaggagaacagggtgaaggaagtgggtgggacagagcagttggagtcgctgcagtgacacctttccaactgtgcacacctgctgaaagcgaatgccagcccactctcctcctttcctctcatctcacactcaccttttacttcctcccacatgaaccgagcacacacatacaaatgcagacatatactcacaccaagatattttcatctcacagcaggtattattttcttccccagttttcctgtctcaaagtccatttccactctgctccctgaagaccacagcccaaggctgtaaaccagggaggagctggagctgagttgcacatggcagcctgggagctgccagcagtagcttttagtcttaaaaaaaaaaaaaagaagccagcaaataagcccagatatgcattgttttgttttgtttcttcttggcatgatcctgtggccatactagctaggaaaaggtgactaggccgaacttcatgactatgagatcaaattccttcctgtgtgagaactggcaagaggttagtttgttttctgttcttatgacatttcctttttgcatatttttgatttttattttttttagaggcagggtcttgctgtgttgctcaatctggtctggactcacacaatcttcctgcctcaacctccccaagtgataggattacaggcgtgaaccactgagcctggccctatgacatttctgatcgtaatttttctacctgttaaagcaaacacttttttgtctctacaaaaaatttaaaaattagctgggcatggtggcacacatctgtcccaggtactcaggaagctgaggcaggaggaccagttgagcccagaagtctgaagctgtggtgagctctgatcacaccactgcacttcagcctgggcaacacagcaagacctgtctctaaataaatcaataaagtgaacacatttcctctccaggcgtatttgcttgtgtgttctcacttctggtgatggtgctattagttgctgacaaggcttttctgttactttgtttttcctcatgatgttctgccctttatttcttccctgttttttgttttggtgtgtgtgtgtgtgtgtgtgtgtgtgtgtgtgtgtgtgtgtgtgtgttttcccgagatggagtcttgctctgttacccagactggagtgcagtggcgtgatctcagctcactgcaacctccgcctcctgggttcatgcaattctcctgcctcagcctcccaagtagctaggattacaggcacgtgccaccgcgcccagctaatttttgtattcagtagaggtggggtttcaccatgttggccaggctggtctcgaactcctgacctcatgatctgcccacctcagcctcccaaagtgttgggattacaggtgtaagccagtgcacccagtctcttccctgttcttggcacttaacttttatgtcaggcactgtgtgtttttagctcctttaaacaagcactatcaaataagtgaggctcagagagattaagtaatttatgcaagaaaatatcccacggaaagtaaatatgccatattcattgtcatgtgtctcaatggcgcctctcaccatgctgattcataataacagagttgctatctagggaaagtcaccagcagtttttcttcttctccatgcagagttccatgaataggccttacatttgcttggaactgggggccggtaagctgcttacactgtaatctaccctgtatccaatagctcgtagcattttcctggtataatagtcaacatactttattcagtgtacaccatgatccaggttcttaacccatgccagcaggtctaacatgggaacagaatgccttaagtgacgctgttgaagagctaagggaggagcagggtgaccgcagtctttattatctaatctctatgattaatgtgagttttaaaaaacatctgatattaatttcattcaacatagtgaataaaaacatgcaactgttaggctttcattgaagttatatgagcagtgggaccttgataaaggaaaggcacgtggaaagaaagagtaaatttaataaagacgctgtttgggtatgatgcataatttctcataaccatggtaccgagaatttaattttcagaaagatagagaggaatattttgaaaaaataattgataccttttctaaaatatctaagagcattgctaatcataagctttaaaatattaataaaaggaaaacatactgtgtttggtaaaatataatttataataatttttaaatattattttatagctttcattttatatattatatattttatatgatctttatattattcacatatctttaaaggtagattttaaatatcagaacattttcaaagaaatattcctaaactccagtctttggggtgagtggcatggttccttgcttgaatgagatgaccccacaaggtgctattatataaatgtcatcaatcaatcagcacatttttgggagtccttgaagtacgtgcttagtgaaagtaccagaagatccaaaaaaatttgagttagaatccttgcctttcaggatctaagagttaagttggggaaatacaacatatttgcaaattaccttatagttaaaggcagtatggacaagctcaactttttactacttccacactctctcattgaattcttcacaaatagtcattcattcaacaagtatttattgagtgtctgcccttgtgaggtccatagagctcaaaggtgaatcgcatgtgaatcctgcccgtagggagctgagcaggggacatgagccctacaaccttaactctagcacagaggggaatgcgaatagagccatgaaaaagggacagatacaataaggtgactccgaagaaagatcaatgatttttacctggagaaaacagaggtggcatcaccttttttagatcttaaagtaatttggatttggagatagaaagatggaggaaaatgtctttccagagagaagcaactctgcctaagtagaaaggtgtaaggcatggagtggctacagcaagcgtggctagagcaaggaatatgcgaagaggacacacgagggagagcttgcaaaaatatattttggggtatctgtgaccaaatataacattcacctttagagttcatttcaagtttgataggcactagaaagccatttggagttttctaggagtaaatcgacatgttcagaggtatgttgcagtaacattaaacctggtgactatgtgaggtctgattgtcccatctgtaactcactcaaagtcattatatccagaacttttttatcaatctgtgtatcagtgaatttgtctaaagtgaaaggctgcagtggctgttctggttgttcttgtgcggatctgcccagctgtgttagatccttaaacacttttatagtctccaagtctagaccctgtcctttttccttgtgtccattttgaaccttggtcacaaagatttccctgggtattcaattgttctttatgcaaagacttaaaaagagccaggtacagatcctcacacctgcagtctcagtactttgggaggcctccgcgggaggatcgcttgagcccaggagttcaagactggcctgggcaacatagggaaaccccatctcgacaaaattatattttaaaaaaattagccgggcgtggtggcacatgcctgtagtttcagctacttgagaggctgaggcaggaggatcacttgagcatgggaggtagacgctgcagtgagctgtagtcataccactgcactccagcccagagaacagagcaagaccttgtctcagaggaagaaaaaaacaaacttaaaaagaaatgttatctctattttcagtaacagaaataaaatgaaaaatagtaatgtttttcataagcaacctttcgatcttaaaaatactctaaatcatgcaactgattatgtttccctctttgtgctggcaagtagattatttaaagccagatttgtgttcctctttaaaaatgtatagtactatacagtaggtattttgtccactaaccttaaatctggctttatcttatgtttcacacttttatttttcttgtattctatctttatttttggcagtgttgtactttatcttgttacactttatatactgattctatcttgagtaaattggtacggataaatacatgctccagccacttctcatgttttgtaagcccaaatctgtagagctagcattgaccctaactgaatccccggattttgctcctgtttgtggtctggtgcagaatttaaatttctgtccaggccaggcacagtggctcatgcctgtaatcccagcaccttcagaggccaaggctggaggctcacttgagctctggagttcgagaccagtctgggcaacatagtgagaccttgtctctacaaaaaatttaaaaattagccagtgaggtggctcatgcctgtgatcccagctactcaggaggctgaggtgggattgattttcttgagtccgggaggtcaaggctgcagtgagctgtgattgtgccactgcaccccagcctgggcaacagagcgagaccctgtctcaaaaaacaattaaaaaaattttttttaaatttccggccatccaccctatatcattcagactttgcatgtattctgttccaccaaattttagattgaacctagctttcatcagctggatttgttttattggtaggcctcctgattgtgttgtcaattcaagaggttccagtaaacagcacactgctgcactagcctgggcagaccattggcaagagcatggatcctcgtgtggtgtcttgtacgctgtaagttctcagcagacacttacaaaatgaagacgtgtacctaaggaaagcagcagctgcttatttttgaaaccttaatggaagttttcccaatggttacgtttttatttaggaataagaattctaaattcaacatattgaaacatgatgataatggatcttaaaatcatttctctttcagtaacagtgttcttgtccataatgctttattttaccatttacacagagctttcatccgtgactgacgtagcagattcctggaatatcaagtctagaaaatgtacttgggatgaatggctaagtgtgtgatgaataaatgaatgagtgggtgcatttcactgaatccttacaattgcactaagacctggatggggcaatagtatttctcacattacaggtgagaaaactgaggcttactatcatgatgtctgacagaatcaggacttaaatttgttactatgacttgtaatattctgctcttcacatagtataatatctaacataatttcttctctataatataatattctttcatggcatcatggagtcatctgacccataccactgcttctttttaggcaaagtcttgttactttttccttggaaacatttctccctgttctctctttgtttctattctgttgacaccaacctagtctaggccctcataactatagcttgtttagtcatgctatcagcaatttcttgaaatgtaccttaaagacatccatagagattctagtcacatacactgatgctctaataaattatatgaaacctgaataataaatctttcatgaattttaaactgttagtttctctttttctaacacaatgacaactgtatgtgccatttcctcaaaagcgtatttcagtctgagatttagacaatcataatttttcatgaacaccaaagcaataaaccaagaaggattcctgcagtttctggtatgggaaatttcaagaagacagagtttctatttttgaagttcccccatatcagaaactgcaaggaagtagcgatattttcatatatttaggtattatctctatccctcattacaagagtgagaaattattcattgttaaattatatgatatggaatattagggatcattagaaacatgtaatattactgatgttatatgctatgagaggagttatttttatcattgtaccctgtaaagaggtttgataatatatattaaaacaattacatattatgtattcatttcatgcaaactgaattacaatgttaaactgtgctatttggcttaacaatcactgctggagttcacatcgtagatggaagctagtacttgtgtttcctattctttgttaatatgtgcatttatattaatagcatgatttaatacatcactttaaaattatactgcattttgaactgcatttagtccaaaattgacatcttatgtgtgtggaaccatatcagtttagcattaaattaaagagtcatctatctgtttggtaaaatgtagtcttcgtaaattctagcacatccaaagctaggtaatgagatggaaagtaggtctcagatgttacattaatttgtgaattttaacttatgacgtattagctttacggaattttctagcagttacaacacagcattcaaaacacagtatttatgttttgaagttgtcagactctttatgattctggtttaaaacaaaaatatttgtatcactgacatagtggcatgagcctatctggtcacctatgacttacttcagaatgtagttacactgcttactgtgaaattggaaaatctgttctgtgtgtgttctaatggatgtgacggtcattaagtatatgagtcttctgacgttgtaatcagatgtgattcagtctgttaagtacccatgaaacaacatctgcttcacagagtgaccttctgctaaagaatacttagcatctattagtagatcatagtgcagatctgccttatttgaaatgcactaaacaagagtagtctactgctgtttagcaactagcttgtaataatttattgcagttaaataaagcttaaaaaaactccattaaataattatagggattatatgcattttgaaaacctttgtgttctactgaaattacccatttaatttcagggttggtttgttaaaaaaagctgaaatctgaaggcacattagaggagctgtcagatgctgttttctgtaggtgttaataaaaccagatgaaaaaaaaatctgaaacaaattaaaaccaaaagcaattttgccatctgttgtgtattaattagaactttgtgtatcaagggtaaacttgctcttagagaatgtcactgaacacccacttaatagaataatatgcaaatttattaggttatggatttatatgcagtttttaattctaattcatctgcagtggatccccaagaaattggtagtgtgtatatacatatatatatatataatgagttctctttctttttttttttttttttttttttcagagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggtaacatctaaaatttcaaaataagctagcccaacccttttctcaccaggagcaatttactatacttacatattctggtgtggtgttttggggttttgttgttgttgtgttttcttttttcttctctaagaagcagttccagattgttgtgatttttttagttgctgggtcagtgaatgtgcctattcttttcacacagtttgttgcctacaagagatgagaataaattacttcagtgaaactttcccttaccactgtttgtttttttcttatctacaaattatcaggcatgtggagaaaaggacagagatgtaaaatgttattctcagttgcatgtagtttgattcagtggacatgtctggcatcttcttggttctagacctctgtactttctcagactatattttgttcattacatcatatattcatagtggagccccactatgaatataacacttaagcacaaatcagatgacagtttgttaaggatattgtagtttcttgcagtatgagggagataggacctactctctaaagttccttgcaggattatttcctaagacaatccattcatcctgacacagttctattaggaagtttttccctacaatgaactgaaatctccatccctgaaacttccatcctctgactgtaaccgtacaactagtagtctgcaactatacaaaacaattttgccctgattcatacatgatggcccatgagcttctcagtcttctagaggcttcagcagtttaatggtccttctctgtacacatagcatagtgtttcattaaggttcaaagttaggacttctcgcaaaggctggctgacaagtggtaaactgctcatacaaaagtatgatcagcgaaagctgttttgagctaatccatttcattattcaggatctcctggcatataaaatttcgccttctttctttggacaggagcgtaacagtcactgtctccttgtaattatgtattgcacaaccaacagtggtgtcttaccttattggtcttctgttggcagctttgcggggaggttcccccaacattcctcttattctttatttcttctctgccccagggtttccgttaggcttggagaaaaagagttatcaccatagaaaagccagaaaatagagagctcttgacgccttgagagactgtcccccaaaatgtcctgccctagagcttccggttaacattaggatttaaattagcttctgggtgaacaaagtgtctcacaatgaatacattgctatttctcaccattaggtatatggtctcaacccattctgccttgaggatgagctagcaggaggtccccacagttagttgtcaacaatgaaagtctttctgtgttttcttttactcttgacctaagaacaaggttctaaagaactcttatctttttatccatatcagccacgagtagttgagttttattgtttattttgtattattgaacattcttctgggagaaattaggaagagaaagaacaggaaaaataggcaaacagcagatttctcttcacttaagacacagtcatgtatacggatttttttttcctgaggttattagcacagacgtaaatttacccagtgtaattaattagcacacactgaacagctaatcaacaccgattcactattgtcatttggaaaaaatttattaggaaaaaagtaattttccagttgagtcatcagattgaatatggatattacattgtagttgacaataattgttttgacaaatatttatgaaatatgtcaaattaaatcctcagaaacgtgtttaattttagtgatgttataaaacacaaaagcctcaaaaactgtcagtaggagagttagcattccgtgaaaccatgtcttccagtgaatttggaataattttgagaagagtaagatgcgttcttgttattcgtcttattgcactggaaattttgattgatgagactttaaagaaagaaagtagttggttagaagaaaatccactgtagccatatgtgaaattgtagctggtttctctatattcagaccatataagaaatcactcccatggtgagtagttactgagattttcttccatttcaaagtaatgccattaatgaatcatcaatggaattaatattatacagttttatgagtttcagggaggaaatcaaccgctgatatgatctcactaataaatatacagaataattaatctaaaaatttgttgttacactaacaaattttaatctgcagtatagttttgttgttttctcgttatccaaagttcacatcttacagtgtcgctaatcaaaagaaatgatatttcaacttgcagtactcagtgagtgaagctaagcagtgatgtgaaaatctcacactgtaccgacacagtactactgtggtttctttaatagtctcacttggttggaactctggaggtgaagaaccagtcttatttatcattgatttttccttcttttagttaaggttccctattgagtatgattctcagactcagtttcagctatattaacaactttatccagacttgtgtctgcctttaactattttttaatctagtgtattgtttcatctttggcaattatttatatatatatatatatatacacacacacaccgattttgctaattctcactttttctgaaactgccacttaaaggttataagctatgaagtttaaaattcagttacgaataaataagaatctctatatttttctcttagttcctcccccttttctcttttcagcacaaattgatagtaattggttacaaaatggcatgtaataacccttgaaaatctcagtgatttgtagacttacagtttatgtgaattgctggaaaaggcataaaaggattttctactttgtcctatatgtttcagtatagctatcattttgatttattcaaaagcattctttttcaccaggcagtttcttgcttccataaaaatgtttatttcctttctctaatgaatttaacatttgctcctgctggagacaatcaatgtgactgtgtactgtacattcccactcagtgaatagaatacttctggtctataatctccagtgactttcagatctcctagagtcacactgagatccaaaaatgcctttgcagttcataagcatctccttattatgtcatcatttcctattaacaatcggtccctatgtataataccaagtgcttgcttacaattttcctgaaaattccttttctttgagctcactatttgttatactttggattattcacttttagggcattggagagcctatagcttgccctttgtttattttatacttcagctgcttcagtatgtaataatagctgctacaagaatacagagcagctgagcaaacgcttagaattggcccagtacagcagcagcacttaaaggtatggtacagtaactctcattgagaagccttgtccttcagcaactgtaaagttaattgcctgcaagttcctcatttatatacgtgaattaaacagcttagtagttacctattagatgttaacaaaacggttcatttgtagccatttaataaaagatttattaaagtcttgttttattatgaagcctactttggcatggatagttcattagttatgttcccatagctttttaccttctagttcagtaatgctttgctaattattaatgtatgaaattgcatattaaattgcctctttattagtgcattttttatttcaatattgagatgtcttgagccgcattaatgtgagatcaattgttaacgtcgttaaaaaaacagaatacctaaacagagatattgtttactaaactaagatatgatacttttttctctttttatcttctttaaaatggttgtagggaaggtaaaaacagtcatacacacaccgggtctgagtcagccttgctgacgtgtgtctgcatcctatatggggtagctttcctgccccagaggaaacctttcccagctgaagaattaacctccacccacttactgataactaataaactaccattagtgaggtagtaagtagtggaatcctccgtaattaaagatacaacttcaagtaaaatatgcctgggaaggtagctcgatgactaaggttgactgactgatgctgatgccatatgcttttgttaaagacagcttggggagacacagggtacctgtggggaaaaggaatattactgaatatggaaaagaggtccaaaaatgaagaacctaaggttacttaacaaaaatttcaaaattggacctgggccaatggtaggaaattcttaaagtttcaccatcatcatttatttaaaaaaaaaaaaaaaagggaaagtcaacttaaattatatactaatgaatagtaaaaaatcacttggattctaagtctcttaaaatatggcaccttttataacttagtatttcttaagaggactaggaagggatattgtttatttgtgagaatgggaagaaacatgaagagggagatataaagttcaagaatttgctgtgtgctgttaatatttaaggcctatttcaagccctggctaaaaaaacctttgtctcagagagaggaggataattgaggaagctattgtaagcttaattcagtgcctaagctctgtggtgaccatatagttcattactaaagccaggacacttgcagagtgagaaggggccatatcaacagttaccctggaattgcagcataaactgatagctgtaccaggcaaagagggacgtgtgattaccacactaagttttatttccaagagtaaagttaattttaagtccaaattttcttatgccttagataaataagaataagaaatcaaacgagaaaggcaggttgaatgcaggtaaggctccagacttgaacatttctaatagtttctattgctaacttagagcaaatatttaaacttttattgacccccttcgcagaaaaagcttctattggcctccaaaatatgtagctcctaaaataatacttaaaatatttgtcttaattttcttctcagagtttcaagagaacacttatcacaatatcaagagaacaagaggtagcaggccgggcgtggtggctcacgcctgtaatcccagcactttgggaggccgaggcgggtggatcacctgaggtcaggagtttgagaccagcctggccaacatggtgaaaccccgtctctacgaaaaatacaaaaattagccaggcggggtggtgggcacctgtaatctcagctacttggcaggctgaggtgagagaatctcttgaacccgggaggcagtggttgcagtgagccaagatctcaccactgcactccagcctgggcgacagagggagactctgtctcaaaaaaaaaaaaaaaaaaaaaaaaaggtagcgtatataaaatatggtcctgaatttactcaaagaataaacatctctgtgtctccagcagcattacagtttgggtttccaaaaccattctctcaggctgaagtagaggcttcattctaggaaagtttgagataaagtttcaaagatggttattaagataagtgagagtaaaagccctattttttaatgtgagattattattaaccacttgtaatgctgtagcctcaacttgattgtttagtgggcgtcacgccaataattaaaatgtgaaagaaggttctagaccaatagcagctctcaaatgaaggtcattctcaggagtcagtattgatatatattctaattaaaacctggtggatatagtagggatacaaatcacagtttagcgtcatgagaaaagcatatgctttagagacctggtttgtaatcctgcatccaccattttcactaactatttaaatgtgaggtcacatatttaaatgtgaagtcagtttccaatgcaataataatacctactcaaaatgatttataagtgtgaaatgaaataaagtaagtggagcacgtggcacatgctaggtgttccgtaaatgtttttaaaataattaccaaatggtaatagcagccattgtgaagggcacctcattggttaatacctttcatcataaagtagctctcatctctccaaacaataagaaaagcatttgtcttaactgagatatttttgtctaatttatctttatgtgttaggtaggctaaacatgaaattaaaccatggttaattttactagattaaaatctcttagttttctcactcttcccgtcgcttaacaaaaagtaggtggatttttgtaggtaggaacgcccagactgttaattttgttcttgagaagaaaaaaaatcttcaaataataatgaaaggcaactattcatatccttgaaacatttaattaactaaagtaataaatgtttggaatgaatcaataaaagccttcatagatgcattgtcttcacatcactcagaagtgagaccccagttttatttaaggtattgaacgctttagagtcttttgtgcatgataaaagtactgtacaatagagtgggagtgttattttgtttaattggagtgaaccagtttctttttaatagcaattaagacaccaagaaagtatgcattaatcatttgctatagtccttaagtgatattgaaagcgtaatttcaataaattgcagatactgtatattctgataatgtttggctttggataaccgtaatctatataaaatgttcacacatgatcatcttaattttcatggtacctgtagaaatgaattgttaattacttctaacacattttgaatcacacttttttgaacgtgaacagtgtaaaaggtaatctgtgcctttactctggtcctagtcagtgattgcgattaagccattatcttcatctgaaaatgacctgtcattctcaagcacttctcttcctctcgagcaactgttttgtgaggctttttaaaaataccattcactagtattgtctgtaaaagtatgtctcagtcctctttacttgtgtatgtgtatgtatttgtacataagtatgcatacatattttatgtctacttgacatccttgctacctggtgattttattttttcctggaatcaaggtgtattcagtttttttaaagattgattgattgattgattgatatttttttgagacggggccttgctctgtcactcatgctagagtgcattggcacaatcacggctcccagcagtcttgacctcccatctctggttcaagcaatccttctgcctcagcctcctgagtagcatggactacaggtgtggcatggtgcccagataatttcttaatatttaattattagcatttatttatttgtctaccggctgcttggcgtttattttccacgaggtgcaaggtgaaaagttacaggtgtcaggagagctcacgtgcgctgggacagtgaggagggctgtctcctttttggtgttagctgtgttgatgtaaaagagcgccctgctcgtccgcttgctgcagccgcccggtctgcagggtccgcggcggcggggagggattctggcgtcctagcgcttctgcaggcccgggtttgggggtggccgctcaggtcagggctaggacccagcactggctttgctggacaggccatcggactgcctcctgggaggtccccaagccaggccacaggcggtcctgctgcaggggtcctaggaggccccgggtgctctgcggaccataaaaataccatggccatgaaaggagctcgcccgccagtgacctgggtcagccaggggctcaggggcggcttccctatggcactcggtgccgccgcaggagctgctgttggaagtggaacctactgtaggtagtagtcgtgggtggccccaagcaagaggctggagggactggagggtatggcccatgctcttgcttgcaggctggtgggacctcagtggcaactcttggggatgggactggggacgctaggccaggaaccatttgcggaggagcctgctgggaggctactccatgatggaaacgtgcacagattaattttttagttttttaaatttttgtagagactgggtctgctatgcagtctacccacctgggcctcccaaagtgctggtattacaggcgtgagccaccacacccagccttaattttaaaactgtgtttttctctggaatttcattctctggtttcatcaccaattaatatacaccctgtcaaagataattgcatatctttttctgcattcctttattttttcctggacaggcttttgcctactttcttctccactaatttcaaacctgaggtaaagtctgttttctattacaccagtctgagaactctttcttcttataccataagattaaattcttggacatgcaattaaccaactaaacttaatcaattctatttgataacccctctgattctgctgtaaccttctttgtgctttcgtagcatctcacttcatattctgaaccacttgaaatactgctaccagaaattgttccagttacatctcacagtaatataatattgctaccgtctggtcatggtgtgtggaaagaagcattggtttggggataggaggatctggattaaaatctcaacatcctactagctgtgtaaccttggtcagggtaattacacattcttatcttgtgtttccataaaatgggattgtaatacttcacaacgactttataagggttccttaagatgtcatgtgaagtacctaatgcttcagtttctttgctttttattcttttcttaggctatgtgtttaaaggaaaaataattcatttaataactacaaaggtaaattgacatctaccaaggaaataaagatgtgataaaatgcagtgacagctaccaagaacttacatgttaattaatttttgtgacaattaggtagctttttacctttgcagattttttgacagtaagaataatcactaaatcctcaacttaattgacttcctaacagagataaactatgaagtaaatatttaaaaagagaatttgttttagaaaaaacaaataactgtgataatatgtaacagtgataatatgggaaagaaattctctgagatagtggtgtcttagagataattcataaaatgaagcctgaatgcattcattcatttatgcaggaaatattggttagtcttacagtgtaccagtatgaaaaactcaagaaaggacctgcagatgttttgcctgcttttgagaaagatagattctattccagagcaaatttaaaatcataaagattatctaatctggccaagtgtggtggctcatgcctgtaatcccagcactttgggaggctgaggcaggtggatcacttaaggccaggagttcaaggtcaccctgggcagcatggtgagaccccacctctgacaaaaaaataaaaaccttaaccaggtttggtagcatgtgcctatagccctagctattcgggaagctgaagcaggaggatcacttgagctcaggagctccaggctgcaatgagctatgatcgcaccactgtcctccagcctgggcaacaaagtgagaccctctctctatttttttctcccaaagagctgggattataggtgtgtgccaccatgcccaactaaagttactttttttttttttttttgaggtagggtcttactctgtttctcaggctggaatgcagtggtatgatcacagctcactacaaccttgacctcctgggctcaagcaatcctcccgcctcagcctcccgagtagctgagaccataggagcatgtcaccatgcccagctaatttttttttttttttggagagacagggtgtctcattatgttgaacaggctggtctcaaactcctaggctcatgtgatgctctcacctcagcctcccaaattgttgtgattataggcatgagccatcacatctggccttatcttctttttaaggcccattgagatttagtaattggcctgaggtcacatgactagttagtggcaatactcagctagatgacaggtctccaaatataagttcattaccttttcttctagtaatgatctccaaaaaattttttattacatttgacaggaaaaaaacaaaacctcaacccccaaatatgtgtatttattaaattttaaattaggcacatgcagcaatttactaagcttgtgcctgttatcatacacagattaagaattgaaaggatgaactaaaacaattttacagaattttattttatttctacttattcatctaatgatgtatttaattattaaatatatatttataatagttaaatataagtgaactttatgtattaaatactaatcataccatatttttcaattctaacatttatataaacatttgtgttgaaatttggttaatttctctgatgtctactctgatcatctggcaagctaatcagtagctattacatttttacattttaagtaaataagaacaaaacccactaaaatatgagttagcagacctttaagcagtttagaaaataaaaaattgctatagatgacatacatttattttgcagcaaagtcatatattgatgggactatttccaaatgtaaattttcaaaatattctctcagaactaataatttctttagagaagctatactgtctttatcattcttgaacacttcctctacttggagggacagattattaattttttcaaaaatatattcttgataagatacctttgacagccacttgtcaccattgaacaggtcagcaaaattgaactcttctcctttttgtatatttaattcatctttaaggttaaactctttgggtattttgctgtgagataccttgttaacctttatgtggttaaaaaagattttcaggccaggtgtggtggctcatgcctgaattcccagcattttgggaggtcaaggtgggcagatcacctgaagtcaggagtttgagaccagcctggccaacacggtgaaaccccgtctctactaaaaatacaaaaaaaaattagccgggcgtggtggcggatgcctgtaatctgagctacaggggaggctgaggcaggggaatcacttgaacctgggaggcggaggttgcaatgagccaagattgcaccactgcgctccagcctacgcaacagagcgagactcggtctcaaaaaaaaaaaaaaaaaaattcaagactacaccacaactcatcgcgaaacattgtgcagaatattgtatttacttaaacacacacagagtttcagcagaaagtaaaaggtgacagcatcactgtcaactcctcttctccttttctcaggatcctcaggcattagagaaccttccaacagaaagactgagtataggttccacgatcacccatgcgtaaaatattataaaagcttaatatctttctgatttttagacaggagaaaaatacaagtttgatatgtaattaaatagagtttgaataccttcttatctcactggtttgttttgcatatgagttaaaatgcgtacctgatatagagactgcgtaaatttggaggccagaaagacctggctttgcctgctccttctaacctttgacaagttcagtaagtctcagtttcctcttctttaaaagcagattttataatacacacagacacacacacacacacacacacagtgggaattttgtaaagttaaagtttgataatattttcttggcacatggcaaatagttgttcagtaagcttcactgaagcccttttcactctttgaactgattgttttctgccttgttttgttttgtcatccatttcttgttcactgtcacatacacatcagattagtgacttactagaatgccatgaacaactctcaactcttaccgccggaaattcttttattcttcataaactacttacaaccacccctgaaattcttctcttgatctagcttatacttcctttcttgtgtttatagaaagaactttagtgaacaattctaagcatagatggccatcaataattaaatgaattaataattaaatagatgaagtcttgtccagatagcacataggaattttaacatggtctttttcatttccatttaaattttaatatatttagtgtataataactgccaacaataggtgtaattgatatatgaaaacatgtaagaatataatacaagtttgtacacttgatgacatggattcttcattaaagtaaccaaaatgtgaaacaaagactgtaaagcgattttagtcttcataatggctaaaaatatttttttgtatatttagtcctgttgttcagttcttaacattcccaaacaatacttataatgggatttagtacttggttgtagacctgtctaagttaaagtaagtcgtaatagaaacactttgcttcatattgtagtcctatactttttacatagctgtggttatgcttaaattttatataattctcccgtttacttaagactatgagaagtaagtgtgaaagatagtacagaactcacaaaaatatatttcccccaatcttcttaacactctctagaattttagctcccaattttcagagcttggttaacacacataatgctatacttactatgaacatgttatcatattcattgtaattataaatggatacaaaggcaaatgccaaaatgtataattactaatatattgatattgcacatttttatgtaaaatagtaaaaccagtttttgtctgaaagcatattttgtgcaattactaataggtcatattaattcaggtagcagcagtgaagtgtatcttgtttataagctttgcatttaagacacctttcttgcaggaatcacctcctagtgtgaaagttttccaaagataatagcacatcaattcaaaagtgtaatagatttgagaccacaacatgctatcagcatgaagaagtagtttatcagtctcactaactcacggtgtcacagctagaatcattacatatttgttcttttgttttcccatcaaagtacatagtttacattgtaatgttggttgcttattttcttatttaaagtgtttatttttaaaatgcataccagaattaatttttggtaataatagaagaggcactttagtgggaatctaaaatattttctttttataattgcatagtatacatagtatattacttcctataaaacatttatcattaaatgcatagtattaatacctttatattagaaagaatcaatccattttgaacaaaatggccaatttttagaaaattcacatacatagacatttacttatctgcctttcctagaatcatcctttttaaaagttagcagaaatccagtgattaaaattcaaggaaaaataatgaattttagtttattactgacttactatgagtatgttttattacttattacttcttagctgtgtctttttaatcaagccttgagacaagcctttttattttttaaatcccatttgctcatttttatttttagttatagcttttttgtcaagtataaatctactgccagtggtcgctgaaaaagttaattaaaaaactagtcctcctagtactttttcctttcctcataccacttaattactctttaagttctcctgcacacactctcgaaagcatgttttaaaattatttctaaaggttgaaagaaaacactttctctttaactctaacaatgagaattcaatgtggagtattttttcaattacactggtttttttgctgcctccaacctcagtaagaattcagtttcttcacgttgtttcatagatccgaagctaccattgctgcagcctttttgagagtatggcagggcgtccactgcagccagcactgggagcatcatcttaattgtcactactttgtcctcagcagtttcgaagaagagttagggaaaaggcatgtttctcagaaaaaaaaaaaaaaatacatatatatatatatatatatgtattttttttttcttctccaaatagcagatacgtaaagtgaaaagagattagagattatatttgtgtgtgtgtgtgcttacacgttacatttaaatatttagaattgagtttttcagaagaatctctggtagtaggtaaagagaatgattagaagtagctctttttttaatagaaattttcatacaggtaataagttgaaacaaggcttttagaggaaaaaagaatatataaaaactaccccagccagaaaggttgagagtggagaactagtactctctctgcgaagaaattaatgaagcattttgggaagttgtaaatgcccaaggtaaagtatcaactagatttacacgtggctcagaaatccaagtatagagtcccaagagaaaaggaaagagaaccccttagccaaggtacttgtgaaataaggtgagtgctgatgagtggttttaaagcaaatggaaatgtagatattatgaaacataaagaagacccaaaaggaaatagatgctggtatctcatttggagatgaagtaaaagccagtacacacggtagatacttaaaagtagcaatgacattagcgtaagggaactgattagggaaaacttaactaataggtgaagttgaaagggaagagttaaaaaaagggggatgttgaaaagtgaaaaaaaaaaaagagtgagatgacataaagcaatgaaaaatgtttaagccctttgactctgagatccaatggattgagcgttgtataactcatttgttctaaattgactactcgaagtaagctaccagcagtgactttctaagcaggagtcttgaattgattttctgatttgttatacagtcttgaagggagacttgaagttaaacttaagctaagaaactgatatcctaataccttactgcagtgattctcagagtgtggttcctggagcagccccgtcagttgctggggtttcaccccagacctactgttgtaacaagcccgccaggttactctgatgtaagctaaagtttgaaacctaccgctttaatgtatggaatggtctctcagttgcatttctgctcatgttggtgttctgaccctttaccacagcagttcacaagccctaccaaaaccggcgcttccttatcagtcttgttgaactgttttcgtgtaaaagataggtaactgcgtccatgtgatctcattgttcaattaccacctatgagtgagaatatgcggtgtttggttttttgttcttgcgatagtttactgagaatgatggtcataggaaggggaatatcacactctggggactgtggtggggtggggggagtggggagggatagcattgggagatatacctaatgctagatgacgagttagtgggtgcagcgcaccagcatggcacatgtgtacatatgtaactaacctgcacaatgtgcacatgtaccctaaaacttaaagtataataaaaaaaaaaaaaaaaaggtcaggagatcaagaccatcctggctaacacagtgaaaaaaaaaaaaaaaaagataggtaactgcagaacaccttttgcaagtttctgcagatgctcgtgtgggtgggcttctcccggaagattcccagcagcctctgcagtctttcagttcaggaatcttacagagcttctgagggccagcatcctcggctgatggagaattatttccaaatagctaggcatttgagcagagtgaataattatgctagatatctctggatgtctattgagaatcagttgccagaaggtaaggaaaataaacaggaacccagccttgagtaagaacgggtaattttctatgggggctttttctttagttttctgtttaatagctgccagaaatttcctattcctttcatcattctctaaagcacattatttaaataaactattttttcagcttttaattagtttgaacacattgctaaatatacatttcacagataatccagttggctttggaacttaaaattcagaatttggtagtgaaaatcctaaagattatgataaaaacagattttaagcattcacaatgcgtgggtaatagttaatatcatctttcagataccttatttgtttcaaatacatactgacaaatattttgggctgattctgtgatatttaatgaatgcccaattagagaccacaaggaattaaatgagtaataataggcgttatggaaggtaacacacactaacaattcagtgttatatattttaacagtacttttaaaaatcatcttatcttaaaatgaactctaggcaaaccgtccattgtcttgatatcatcaagtgactaaaactatcttgaactcagtagttaattttagccttcatgtatttccaggtacatttaatccacaagtgtgggattcatttgctttagatctgaaaatgtcattttggaaaagtcgtttgatgttgaggaaatcttgtgagacctttaataagcctcttaaatccagaaagttatattttgctggaaggaagaagaacctataccttaaaatttcctcagctcttaagtgagaacttttggatattgaaaaggttgtaaatttggccaaacatagccagtctttcttattgacacattgtctttgaaatcaaaacatctaatttgaagaaagcaatctatattctagattactttttatcgatttacctacatgtgtcagtagaaagcaggacatcaagggattttatttaatcaggtcacttttagtttaatgtaaatgattctctttgtccaagaaagaatataagaggaggaaagcatcaacatttcctatgcagtagtgcctttgtccctatacgatataatagatgttactacacaagataagtatttttccaggtgtctgtatgtcactaataaaagtttcaacagtgcctcagggacagaagctgagcactaactactacactctctttatcctaattatttgctttgtttgttaatctctaaaaatgtttttaacactatataaaacattgaaggaaacaaactattttctatgaagataactgcttatgaagttaatctaattagaatttatttcattcagtagttacacactttctttttgatttttattttctatgctaatctcccattgaggaaatgactcaaaccacttggaataatgctataacacattttccagggatgcttttcaattgggtccctataatttctaatttattaaactgtattcttgatattaaagataaaatgattatattaatcccctgaacaaaagaccagtattaagacatttttcctagtgactcctataagctttcaatttaattatgtattatgacttatttaattttgttagcatcttctaaaatgaactttgatatattaatattacatatgatatagaaaagtacatttaaatttccttgataatctgattatcttgccactaaaaatcttatgatggtaagttttatgcttattactttgaaagacaaaatcaatcaaaagtgaacagctactaaggaacaaagcatgcctgctaagacatggggtttaaaaaaaaaaaaagcaaaacaaattataagaagcaattgtaagtggcctaagataggagacagaagttttgactgaacaaatagaggtgattcggtatactgtgcgggtccaaaatttaaaacatgatgtttcatttgagggtaaaaaaaaatttgaaatgaaatgttatttttgcctcttctttgcatctgctaagcaggttaaaagaagttgaggtataagaacacagaacttctctgctcagcaataaaagaaaaagaagagaaagaaatgctataaaggaaagactgcaggatcccccaacaggttgactactcgggggtgggggttgggagcaggaaagaagagtaattaaaaattacccaaagtctggcagttagagagacttaaaagacagagttactcaacagtgacctagaaggcagggatggggacagcaaaaaagatgaggaaattcagtcaatttgcaacgtgacccatagaggtatacatcatggaatgggttaaaaataggagctagaaggccaggtgtggtggctcacacctgtaatcgcaacactttgggaggccgaggcaagcggatcacgaggtcaggagatcaagaccatcctggccaacatggtgaaaccctgtctctactaaaaataattaaaaaaaattagctgggcatggtggcacatacctgtagtcccagctacttgggaggctgaggcaggaaaatcgcttgaacctgggaggcagtggttgcggtgagccgagatcacgctactgcactccagcctggcaacagagcaagtctccatctcaaaaaaaaaaacaatagaagctagattagaggtagaagctaacatcaaaaggttactctaaagccagatcaacaaagaaacaaacctttcaacttaagaagacataagagcaactattaattgtgcttaacgtagagtcatccttcctatatatgttttagtttctacatagcattacaagttaatgacgcaatgcagttccaccgttcttgtcttgttgttgttaaatagaatccccctcaagattccagagccacaaagcaactgttagtgttcggtgaccttctgcaccagctgtcttttgggctttgaaattgattttcctcatctcagtctctgatagtctctcttcaagtgtgtctctctagctcatcaccagagtgaaaacagtggcacaaatagctgaggaactggaggcaggctccgtgcagggcatcattggaaacatcagaacaaaaggtgtgctctgtgttaaaaagaagccgccgcggctgctgctttattgctgaatacaatggggaatattctcacaggttcactttttttcattcccaaatatggtctgagaagtaaagaaaatttctgcctttattctacaaacctcatgtggatgccaggtcaaaagcatatgtttttgatagcaatttttgcagaattttttacgtgtgagaagcatattcccagagctgtatgactcggcagagtcacaggatgggaagagactaatgacacacaaaaatgtgtgctttatagagaattaggtgatgataatttccttgtgcggaaactcactgtctactctccatatagccgaatttcagtattccattccttcgttaaatatttgtagagtcctaaacataaagtaaccattgtgttggaccttgagaacgggtaaaaagaagtccttgggcttaaagacacattaatcacaatatgcactttggcagtgtttgatatagtgcaatgaaagagccattgttgcctttggaaagagggtatcctttctgaaccccaaaactaacagagtcctgcgaaatctgagaccaaatattctctgctatagaaaatatactgacatagatcatagtaatgtctaagagatttttacatgtatattttcacatatctattttgaggcctaattttacctgaaggaatccgtctacacaaaatgacaccatttgtttgtaagtagtttcaaaatacatcagtttaaacaatctttactaattctttctttacttacatactagaaagtgatctgaaaatatcaaagactggtgattttattttttgattgattgactgatttttgagacagggtcttgctctgttgcccaggctgcagtacagtggtgcaatcacagctcactgcagcctcaaacttctgggcttaagcattcctcctgcctcaccctcctgagtagctggggctacaggtgcatggcaccatgctaggctaatttttaaaaaagtttttatcacgcctgtaatcccagcactttgggaggccaaggcgggtggatcccctgaggtcaggagatcgagaccatcctggctaacaaagtgaaacctcgtctctactgaaaacacaaaaaattagcaggacatggtggcgggcgcctgtagtcccagccactcgggaggctgaggcaggagaatggcgtgaactcaggaggcagagcttgcagtgaaccgaggtcgcaccactgcactccagcctggacaacagagcgagactccgtctaaaaaaaaaaagatttagtagagatgaggtcccactgtattgcccaggctggtcttgaattcctgggctcaagcaatcctcctgcctcattgttttaaaatatagtgcacaggtgatttggcttctcttcccatgttttatagcatttctgtatttattatgcacgtacatcaccaaggccccagtctgatatacacaatcggattgaaatctcaaaagtacctcttctctgtgactaatctgagtacagtacaggtcccaatctgaggaggggtacttctgagatttaaagtcagtggctggccaggcatggtggctcatgcctgtaatcccagcactttgggaggccaaggcaggaagactgcttaagggtaggagattgaggtcagcctgaacaacatagggagacccccatctgtacaaaaatatatataaatatatatataaaatatataatatataatacatattataatatataatatgtattatatatataaaatatataatatatattatatataaaatatataatatatattatatataaaatatataatatataatatattataatatataataattatatattatatataattatatatataatatataatatatatattatatatatatatattagccagatgtggtggtgcacatgctgtagtccaagctactcaggaggctgaggaagcaggattacttggggctgggaggtcaaggctccagtgagctgtcttcacaccactgtgcaccagcctgagcagctggagtaatgttagaacaaataacaaaatatacaatcacaaagatgtgattttagaatattacatctttgttttgagcaatatctcaaaattacattttcttctaagaaaaataataattgcggcagggcatggtggcccacgcctgtaatcccagcactttgggaggccaaggcgggcagatcacctaggtcaggagttcgagaccagcctggccaacatgatgaaacctcgtctctactaaaaatacagaaattacctggcatggtggcacatgcctttcatcccagctactcaggaggctgaggctcctcccaggaggcggaggttgcagtgagccgagatcacaccacttcactccagcctagatgacaagagcaaaactctatcgcaaaaaaaaagaaaaagaataatttcatagcaactcaagcccttgccaagattggtgatctcatgatctactgatgtctcaagttttggaaatttaaacagaggtgtctgatttgaagtcagcctctatcaaacttactgtctctcacgtagtagatattcacgtttttagtgttgaggctaagttcataatcttgagagtcccataggctcagattcaaatcctatctcccgtggagaaacagcatactttgaataaagctaaaacacacatcccaggcttgctttttggtttttataatttccagccttatttattgctattttatatattatatgatttcattcctttattagctgtggcttcttggccaaggtacttaactttttgaggctcacttttcctcgtctacataatagtcaccattttatttattttacacatatttattgaacacctacaacatgccaagaactttttaagccctgttaatacagaggtgaataggacttcatagagtttacattctaatgggagaagacaaaccatagatgatttgtggagtgaatatatcattcatagtccatcagtatagtacgttagaaatgcaacttttaaaaatatttgtttatgttttttatttttatttttttagacagagtctctttttttttttttctttgagactgagtctcgctccattgcccaggctggagtgcagtggtgtgatctctgctcactgcaagctctgccttccaggttcacgccattctcctgcctcagcctcccgagtagctgggactacaggcgcccaccaccacgcccggctaaattttttttgtatttttagtagagacggggtttcactgtattagccaagatggtctcgatttcctgaccttgtgatccacctgtccccgcctccctaagtgctgggattacaggtgtgagccaccacgtctgaccctatttcttgagacagagtcttactctgtcaccaggctggaatgcagtggtgtagtctcagctcactgcaacctccatctcctgggttcaagcaattctcctgccccagcctccctagcagctgggattacaggcccccgccatcacatctggctaattttttgtattttgtttgtttgtttgtttgtttgtttgtttttactggagacagggtttcagtgtgttggccgggctggtctcgactcctgagcttgtgatccacccgctgcggccttccaaagtgctgggattacaggtgtgagccaccgcacccggcctgttttattttaagcctcattcctagaatcttctcttcaggcagtttgggtccctccctcccttaccccagctcttccatgatgctctgagcacagcagggagcttctggtgttacactcttctccactaagacatctagttttcatgctctctgtcttttcctaatcctcctgatattgcgggggtcgccttcgttcctatccgcgagacccctgcttgtccagtggcacactctgccatctctttgcttctcttgcagccatagaagtaattccgcttcttagaaattatgctcaggcacaggaatctctgcgaggctccctgactgcatcgcctggatgcttcatgcgtttatttctctttgagatcctgttatcacctccgttctctgtctgagatgtaaggcacaggtttcctctgctctcaggccccttggatatacgccgtggtctctgcttctccaggaatcacgcggggaggccaggagcagggccttcatccctgggacatggtatatcttcagccattcttctctttctctcttcctagcccttaataaaatgaaatattttttctagtctaaggggaatctttgttttctaaatatggtttctttctgacattttgggtatatcccaaagcctctctccatttccactttcccccagagggttttcatgggaccaaagactaaggtaagggactacgtcgttggccatgggcctgcaaacctgtcgctacctgagttttgcgtgtttctctacacgcagctttgccaggtagctctctctgctacttctgtcccttcgagcatggcatggaagcagtagaaagagcctcagccttccttggagtcttgccacttccccagaatgccactcacgaagcagaaggcaggcttctctccctgggccctgttgctcctctgctgttaccagctcccctcaggttctccacctgctcccagcgtggacatgttcccctttctggagggaagccctttctcccctcacaccatttttctccccagtccactctatttcactcagcagtctgggctttagaaaaccggtaagagactcaagctatttcttccttcatcttatttcatttctcctggaggcaatgaaataaaactagaatgagaggattgaggcagaggaaacacagaaagggaaaaaagtcaggaggaaaaaacatgctttcaatagtacttcagaaacttgatttaccgcacaaataaataacaagatcactgattgtaataagcactttgaagaaaatgataatacgtggtaatactatggagagtagagggaacagggctttggattgggtggtcaagtagtaacgtctgagctgagatttggaggatgaaggctgaaaatacaaataggcattttattcttcaccgcattatggtgaaaattgtaatgaaacaacaatacagtgcttagtaggtactcaggaaatggcagttatcattattgttgttaatgaagccgacagaatggacacctagctcaggtccatcggtgataccaggaggggtcatccaagactgagctgatgccaaagcccacacttgtagcacgggtccccgaccactgggctgtggaccagtacagatctgcggcctgttaggaactgggccacacagcaggaggtgagtggcagtcgggggagggagcgttactgcctgagctccgcctcctgtcagatcagagatagcattagattctcacaggagcacaaacgctgttgtgaactgcgcatgtgagggatcgaggttgtgcgagaatctaatgcttgatgatctgaggtggaaaagtttcaccccgaaaccatcctccccacccccctattcctggtccagggaaaaattgtcttccacgaaaccggtccctggtgccaaaaacgttggggaccgctgcagtaaagtaagcgaattgtcccacagtcataggaaatgtcagtccttttcctatacttggcaaagatgatcatttggccctgtgaaattcatacaccagtgtttgccaggactttttagggtggaacttccagaagataataataggatgtctgtccaattacatggatctgtccaagcttcacaagaggcatgctttgcaccctttaggctgccttttaaatcctctccagtggcgttgagggaataggctgtttctacgggctgctgagcctcctgctcactcttcatgtataatcctgaaaagagcgagaatctaggtccgggccaacatgattcacaggccagatctagccctgttccttactttttggtactgcttgtgagcagagaatggttttcacatctttaaataattgacagcatgaaaagaaaagatttcatgacatgggaaaattctataaagttaaaatttcaatgtctacaaaaaagtgttattggaacagagccagagttaaacatgtatgcattgtctatggcggctttcacgatagaacagcagagttcagtgatatcgctggaaaagcctaaaatatttactctgtggtcccttacagcaaaagtttgctgatgcctgatctaaatgacatagtccatcttcttatccagactacatgccagtgtgaaatcgccagtatcaaatttgtaaaccagggaattaattttgtacacattcgttttgatgatgttacattttgaattggcatttaaaatcttcaaattatacttttttggtcctttgaatagagactgtgatatgtgattttgagcaaaataataaataactaatgcttattgagcacttaccttgtgctagatactaatgtaaacactttatatatgcattacttcatttaatccttggaaaatgcctgtaaactgtaggtactgttattatgccctttttacagatgataaaaccaagacacaaaacttgagtaacttacccaccatcttgcagctatttataggtgaagtctggctttgaactcagacagtgttgtttcagagcgcttaataaccaggctgaatatggtaggaggtactgatgctgcctccaacatatcacttaattcaggctataaacttttaaattagctttttaaagtagttcagtggggggagatgggctcataatacagtcgctagtataatttgtacaagtggcaactcatcatttgcatctgttctaattttgtgtttgacaaagcattttttagagacattagctctagtctctaaaagctctagttttgcaaccctgttaaaataagtaagtcattagtgccattttttttacaggtcaagaaaaaaaactgaggttccctaggaccacattactaggaaatgatagaccagggactgattttcaatccagaattctttccactctaccgacctgtattaggccaactttcatgacttttaccgtatctgtagaccagcttcactatttttcacgtaatagttttctggagattgattctttgtaacttttaaatacctattcagccttttctaagcaataatatacataaaataaatgagtgtgatccttttttattaattggatacttacataacacttggtatattccaagcactttactttaaatattaactcatttaagtttcataataaccctgtgaggtagatactattaccatcctcattttatacattaagaaaccaaaactgactttcagtaactcgccagggacacatacctactaagtggttaggtggaatttgaaccttggcagtctggcttcccaattctgtcctattagccccttaatttgtttgatatattcagtatttctccaatatacaataagtatatgagtattaaaattagaagtatttagctatgtcttatctaaaatgaccttgcataaagactgtaccatatcagattggaagatctctgtatcttctgaatgtgaaagagagcacagtctgttgacttcattgaatgtattaggaacatcgtaataagtgtcacttactgaatatactgtatattcagtggatactcactgaatatactgtaagtaaccagcataatattaaaagtaaaccatgaaacaaatggtgcttttttaaaatttggagacttctgttgttaataggaatattaaaattagttacctttcctgaagaattccttttacagtgctcttgtcatgtgaccacacaatttctgcttaaacattgtcaaggaagacagcatacaacttttagagacagtttgctctctgttgtatggctcggtggttagggaatgtttccgtatttgatccagaatctgcttcactgaccccttcatttatttaggtttggtgttagaagatgttccatgattccttccctgtccctacccccagcaggttcacactcctgattatgtttgacataagctaacaataaaatagtttgcatcgtttgagaactgagcagctgcctgtaaccgaacttgtttttatagtacttattagcagagaagcaggccaagaggacagtgtttccatggacatccagaaaataaatcagtctgcagaagatccgcgtgatcatgcatactcgtgtttatatgagcgcatagtctcatgagtagtaaatggccatgtagctgggtttcttttgctaactgtgaaaatgctcttagggtaattcatcaagggacattccaaaatggttttgttcaggaaacagtatgattagaaaatctttatagtctctcaagatgtctacttgaagggacagtgatcatttatgatcatttatatgtataaatcctgctatctacattagaaatcagtctctttcattagagtcattattgtgagttagattctttggttaaaacatttccttaatttttaatgttttaggttatataggataaattcttttaaaaaagagagagagagcaaaagagacaggagagctaaatgcatcgctgtctcttgtctcttgtatcgtaacatatttgtatcttataatgatattctccttttccacaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttataggtaagaacaagttcttagaattactttgtctgtaaatcagggtgttacattgttttattacttgtatttattcatttggtctagaaatatattgtgagattatatttggtgggggtgagtttggtaataatgtatcataaatcacagagtattttcagtaattttcagcaaatttagatacatagaaaagcaggttttgtgggtagtgaggtaatattcttggacaaaagctatagggtacatttgtgtttgacttatcccttgtgaaacatggatagctctgtggcatttcatgtacacaaaataattcatgcgcttgcagtaatgaaccctgtgcaggatttccttcaatgcgtactcaatagggagctctccactgcttgtgatattgtaagtctctcagctcactcagccatctaaatgtaaaactcatcactcagggccatcatcttgcactcaggaacactctccagagaactgggcgtccataaagcaatgaatggattatatactcattcatatatgtggatttttcttctcttctgatgtagtattgatcatgtttttcatttgatagtaacccaaataatggaagctactaatagaagttgtaaatattgcttttatttaaccatttcataacatatctgagcattcacactactggaaatcgctttttaaaatgccagaaatgaccacattgtgttttgatcttcttctaagtataggaaaaggcctaccacattgaaatgctaatggtgtccactgagataaatcacaggctttgtggtttatccaccaagaacaatagccagtgatgcatcctcaggtttacaaagcaatttgtgatgccccatgaaattctataactgaataagagtattgcagagctgtatgtagaatactatgatgtttctgcagtggaccagtatcttccactggctacaatactcctgtgatataattatgcactttggaaagtgaaataaccattttgtgtcagtgttcaatgggaaaacagaattgtagagcatgaaggaactttagagacaattgagtcaggaatggcaactacgtgacaagttatacagtattttttccaattttttgaccatggaagacatcattaatgattcacagcactttctctccttaacccgattacatgctgcttatcttcatcagagtgcttcatacagtacctctgacggcctctaccagtcagaggtaaaagcaagatgaaacctttctgttacctttctgtcatcttttaatctaagttaactttctccttataaagacggtcaaaccagatactgaaggggttgtctcttgactaggatcacaccctagtgaaacaatactgctgttgtttcataacagtgaaggtaaatgagtaatttcacaacaaaaatcaatattccagagacagatttctagtattcggttagaaaatgtatcagccatcaagagattctcttctagttagctgtgtatattatttgtacctgtcagaagtgtgctgctaaagaattttaaatggttctgaaagggaccagtcataaatgggatgtaataaattaagaatatgtatttgaactgaacaaggagaacacacgggcacagggaagggaacaagacacactgaggcctgtcatggggttggctgaggggagggagagcattaggtaaaaacagctaatgcatgctggacttaatacctaggtgatgagttgacaggtgcagcaaaaccaccatggcacacatttacctatgtaacaaacctgcacatcctgcacctgcaccctggaacttaaaaataaaaaagaatatgtgtttgttggggattttatttatttatttattttattttattattattattttttttttactaaatggggcacaccaggtagataaatattcagggctggaattcagtgtcaggttgactggtcaggcatcctttctgattgataagtgcctgtgtgcttccagttgttaaatattttgaatatcaattctaatgccatttaattttattttcatggtgtgactagcaggaaaaaatagcattttaatgtgagatcagtcactgttacctgtgagacttgtactctttttaaggacccattagtgaatataactctcagacttctaagtaaaaactcaaaattttcctttttttttcatattgcctagttttactttttagtaattaccaatctgctttattcctactagtaccatggtcataaaccttccctttgcttttatttttccccacatggcaacatgcaaattatctagttaatatactcatgtagggttttcagttcaacagatatttattgaacatttgttttgatctagttattgtgctaggaattaagaagatacaatcccagtgttatctagcaaaaaaattacttttatcttcaaagaattgtctcatacttttatcactttaattaagcacatgtgtgcttccaattttcattggtcttcctatatttaaagggctaacacactaacacaatgattttatttttaatcaggtaaaaaaatttcattcgctcatcagttcgcatggtaaatcttttttgattaaagacgttgcctttacccttgaagaaaagaacaggacacttctctcagggaaggctgtccttttctgttaagtgtgcatgtaaagcagagagggagaaaagaaacacttgcccgtccagccagatcagtctgataaaccccagtatcaatgaggaagaccaatgtcatcatgagattgaccttgcaacctttaacagaaatgcagccttcctgaagcttttttttccattcccttagaattcccttctcttatattgaccgttaatatacagtaaaagcctaagacattaaaaaagagcttgaggaattatttcttcgaatattttttcttaccttccagtaagataatgagaacttacgacaatgtagatttaacatgtctcttctctaaggtaagttgtctcaggatagacaaggtgaacagcttctgaaagagaggcaaggagggagggagggaggtggacaggctttgttgtttattttttctatttcttcaaaatttcagagagtaaagaaagaccttaaaaagtgaaaattaattgtaatcccacagtgcatgctgtcaactttttggtgtgtatccttccagatattgtcccatgtacatatacagctagaggtccatatttttaaatgcattttatactaggcttttctcacatatcattcattatacatcatctatataattttatttagtggctattcttagttaactagttccccaaaatacagtgacttattttcttgtacctgtgtccgtgcatgttggtgtgtgcgtatgtgttcatttgatccagttttttattggtatacattttttgaaggatgtttgctgtaccacagagtaggcatgttttaaattttgaaaaccatggcaactgtcagtttacataaccaccaacgctagtcattacatctatttatctgtctatattttattatgcatatttttaacttttgccaatctcttaggttaaaaggttgttattttgatttattactagtagcgctgactatcttctcatacatttattggccatttgtatttctctttttgtgtgtgaatagcctccacttttctattggggctattctcttttctttttgatttaaaaaggctattttcaattaaggatatgaattttttgtcacatgttatgtacttctccaatttattattaactttggtcagagtcatttttaccatatttcattcacaagttttaaagtcgtcaaatgtatttttccctttatatttctggctttcaagacatacctgtaaagtccttatttaatctaagtgttagtttttatttatttggtatatttttattttttggagacaggttctcactctgtttttttctttaaatttctagctttcatgccatacttatctaatctaagtattagtttttatttatcttttatatttttattttttcaaggcaagatctcactctgtctcacaggctggagtgcaacgacgcagtcacagctcactgcagcctctgcctcctgggctcaagtgatcctcccatctcagcctccctagtagctgggactacaggcacacaccaccatgcccagctaattgtttttatttttttgtagagacaagatctccctatgtttcctagattggtctcaaactcctaggatcaagctgtcctcttgcctcagcctcccaaagtgctgagatgacaggaatgagccaccactgtgcccagccgaggatttttaaaaatgttcttcaacttactctggtacttaatggtttttcagtaactatttttaagttaacattttcttggccactctgatagatgtcagaggtccaaattagctcttcattctagacgctcatagtcaagtgatgaggacgtgcataaaaacactcttaacaccatacatgctttcataccagcttgatgagcaaaaagagaagaaaggcgatacctacgttttgctgtagatttgggggaaagacttgatctggcacctgatgcatgaactggagctttgttcacctcacgccaatggctagtgagaaaatcaccttgagatgaggtcatctgaggaacagcaaggagaaatgcgaaatatctgccatggtgcatgtgcagtgcttactgtgccgggcgctgttctagaaactgtatgaattacctcatttaatttccacaacaaccttaggaggtttcttcttttaacaaatgtaatctgtggcttagagagatggctcgcctgaaggcacacacacaaggactcttacactatactgtctcccgtgaggttttttaagaagtaaaaatagagaagaaattgaagagatttaagcataggagtgaaaaggagtcacatttatgcttttgaaagattgtttcagtggccttccagaacatgcagtatgatgaaaggaggtccagagttgtgctttccaagcattcctgtgcctaggaatcgcctggggaccttgctaagatgcacgtcctgatttagcagatccgaagtgagaaccgagattggtttttccagcaggctctcaggtgatgctgccgtgcttctcagaccacaatatgagtagcacaggtctaggaaatgctgtcacgtgtcccgtttcatgatggaaatgttctgtttccacactgtccaatttagtagccactagacacatgtggctgttgagcacttgaaatgtagctagtaagttgtagaaaccaaagtttaaattgtgctgtttttcattaaactcaaacagcgacatggggctaggaactatcatttggatagtacaagtctagacaacctgttagaaaagtagccataactgggagatcatgaggccctattaggatagaggagcaagcagaattgagaaaccttagctgactcatgatagaataaatgtgatatgatttcacctatcccagtttttaaaaatcaaatgtacatatggtaaactttctttcattggagtcatcttaccattttctttggattactgagcctgcagctaaaatcctgctctaatccattaaccttttgagttgctgtgcctttacgcaacaaaaattctactgatttctaaccacaaatgttaggttcaatgattacagttagtgatacagacctacccaaagaaatacctgttgcacttctctgggccctgatgtactcattcttcttttttgactctgaaattaaaaaaaaaaaaaaaaaaaaaagatgagcagtaaccaccagttgttcaccaaagaatggcaaaaaggagaagagtccatgttctgcgtctgttcaccgttacacgatgggtaggagtcttgatactgttctttgctcacagaaagctcttttttctgggtagaagataacctgaaatgtcaatgttatacacatagaaaaatggccagaaatccctcatgaaggataaacattattgacgcattgctacatgcaaatcataataaatgcttgggatgacgccaattaaactgcaaataagccctcaaatcagacttcaaataacaccgttatagacctttaatttcgtgagcatctctgtgcactgctaggcagagtcagagaatttctccatgtacagtagcaccaaaggtatttgtacatgaactttttaaggaacactagagaaaaaaatattatcagactatattgtggtggtatattttctcaattatcttgcccttttggccaggtttttcctaaccagtaattcatttgacaacagagtgttttaaatcacagctttattgagacccagtgcacatactgtgtgatttatccatttaaatatacggtccaatggtgtttagtgttacatgtccacagaattttgcagctaccatacagaacatttctctcacctccaaaaagaatccctgcatcctttaacagtcactcgctgttacctcccaacacccagtcaatacccaatagtttttttatccccacaaaaatgtttccataaaaatctgaaatttttaagggactgttttgctaactcattgcccaatgaaaacaaataactcagctttgtttttcttatgagctcctgacaagtatagcaaaccggagaactactcaaatttttactattcctttcatttaaaaaatacatatgtagttatttatttcctttgaacagctgctaccaactgatttctaaaatacatgttgtcatatgcctgctaaaaaggctgtttaacaacataagcattccctagatctggcaaaacataacctgtcgaatccaggttcattgcagttatgattccttagcagttatctgtcctacttctgggcctatttgcattttatgaacacttttacctctctgtgtaccttgaaattgattatggtagtagctatatatgtgcaactcagggtcagaagggaaaatacgccagccctttatgcttcatgaaaaatcagccatttaactatatatggcaaaataaaatgtgtttgacattcttttttctttttggacatgtctttgtaataaaagtgctgttttataatgttctagaacacagccaagcaatgaattacataccattttccactacagcttcttcccttcactctgagttgcattatagtcagaaaatgcgtttttgtctgagatggtatggaagcattttaatactaacatgatttcatcacattgtaggaaaaaatgtgttgcctatattttagaggatggaaaattgtaagactaaaaatttagaatcagtttttcaatattttattttattctggaatccttaaggacatatttaagcctgattcaatggtgattaaagactcagaataaaagaatttaccagtatagaaagtaagctcctcctctccccacaaacataatgtattttactcttagtttgatatgaggtcagctaaagtaaataacatatgcaaataatacacttggccgggcacagtggctcacacctgtaatcccagcactttgggaggaggccaggagttcaagaccagcctggccagcacggtgaaaccccatctctactagaaacacaaaaagttagccaggcatggtggcacgcacctgtagtcccagctactcgggaggctgaggcaggagaatcacttgaacccaggaggcagaggttgcagcgagcagagatcgcgccaccgtactccagcctgggcaacagagtgagactctgtctcaaaaaaaaaaaaagaaagaaagaaaagaaaagaatacacttaaacagattgtgtttaccatttaaatatagggatctctctgacttgaaaaatattcaaagacagaacaataagaaatacctttaaagtcagcttacatccagtttatgctagatataaatatcttattcatgaaatatagtgaagttttctctgttttaaactatcatttttgcaaaacgtagcaacatctcctaatgacaagtggaaagcttaatgcaatatttaccactttactgctacgttgcataaatatttaattggtgttgcatatgtcatttgcttttacattagtggtactaacagcggcatattcagagagaaatgtctgcatagagaggagtgaaagaaaagtaaatggcataaataaggttaaaaaaacttgaattactaggaattttagaagtgaattcagcataaaacctttaagtttcatggaaactatatcaaacaaaggtttcatcctagaatatacaaataaagatacaaatatcaaaggtttcatcctagaatatacaaataaaatttaaatttgtatagagtttgttgttcccacatcatcttagaatgtctgcagactgctcacattgtcccttttccttaaaaataagattccaaagccagacgtggtggcaagcatctgtagtcacagctttctgggaggctgaggcagaaggatcaccacttgagcctcggagtttgaggctgtaatgcctgatgatcatgcctgtgaatagccactgcactccagcctgaacgacatagcaagagcatctctaaaaaataaaaaatagatttaaaaaaattccagtttcttctttagtgactttggtaatataacacctgtcagaaaaggaactgaccattcattcatccgtcattcattcaacatttatttatcaggtgactaccatgggtcagacactgtgacagagacagcagtgaaaatacagtccttgcctcttagagattatattcttttgtagaatgcaaacactgagtaattaattacagttatagtaactgtttgaaaaggagaaatgtaggaaactaagagagtgcataaaagacagaactttactgaatctgagcattcaagattttcctgctaaggcctaaataataactgagattatgtgttttgacaaatgctgacgtagggacagattctaagtgttaccacataaacctaaatgtgacccaaaaatatcaactgtcagggtattaaaactaatatattgtgatataatgaaaatttatccatgtgttaggggaaaaattttttttttttttagttttcattattgacttagtttacctagagcccagtgttccagttaacatctagaagtagaaatgtcactttggaaatttggggtaactagatctataattgccgcaagaatcccatagtctctttctgtttgttcctttctcttaatttcagataacgtacatgcatgctttaagaattttatttataaagaattttcaaaaaaatgtttttaaaaactggtaaaggaaaagatatctctgacttctttccattcatgagtactcaatctgttttgaagaaattaaaaacatacagatgtgtgtgtctgtatcctacatcgcaaaagctgtttggagataagcgtcatgttgccctgtgtttgataactaaggaggtcagcacgtctcattttcatgattgagttgggcctaaaggtgcaaagaatcttactctgaggcccccccattgtgcatcttcccattgtacagtctatacagtgactcgaagaacaagtatgtttttttagctagatccacctctgtataatactaagatattttctgagaaaagatttcatgttattaatgataagaacttccagtccttctgttacctgttacattttatcgtggtgacttatccgggagggaattaatgctcctcttctggtggctgtccatcagccagcctggcatgacattggctggctctgtcctgggattgtcttatcaccctaatactttagccactgcctgatcctttctgttttctcctccactggggaacccattctctttatgactttcagtaagcctccacctgcccctgaaggagaggaaacctgtcacatattatcctgcatttcccagaaagacagaaggatatccaaagctacctagaagattactgcatataatttgtagaatatggggctcttggttttgagagaaaattgtacaggtggttttgcagatttcagatttttgcttattttttcatgtatctccttttaattatttctaatatcaaagtcaatttcattaaacttagctgtttttgaataccttttctaaatactgaattcacaaagatgagtaagaagtaatatttatcacagtgatctcacactcttatatgacaagatataatttgaaatttgtataccatagtacaatttatttttaaaatactgttaataagtatagactctcaaagcagccagatttgtgtttgtatctcacctttgtcacttaataactatgtaatcttgaacagggtagttaaccttcgtaaacctgaatttcttcctcaatataaacaagtttcaaaatagtacagctatggggaaaattgaataatgtgcctggcaaaatgtaagtgctcagttaattttagctcttcttcttcttctttgtaacaacctagtaaattaagtactattatccacacttttttaaaagaaaaatcttaggcccagaaaatcagtgacttgtccagtcagcaagtcctttaaaaggaaccataatctaggtctccttattttaagtccagaacttttcccactatatcacagagcattgtttctcctaaggtttaagaatttatagatagaacatgaactgaagaataaataacaatgaaagacaaaatgagaaatgaattccattttgaattcttattttcttatgtcagattatgtcacgaggaaggtctcagcagatgttagccatctctgacacttgcctttaacatctcttttacaaataaagagtaatttggaccgggtgtggtggctcacacctgtaatcccagcattttgggagcctgaggcgggcagatcacgggttcaggagattgagaccatcctgaccaacatggtgaaaccccgtctctgctaaaatacaaaaaattagccgggcgtggtggcgcgcacctgtagtcccagctactcgggaggctgaggcaggagaattgcttgaacccaggaggcggaggttgcggtgagctgagatcgtgccactgcactctagcctggcaatagagcaagactctgtctcaaaaatacgtaaataagagtaattttgctgatttctattcatatcaagatacactgatttttcccttaaggtaatacagaatttcctttagaaataaatgtattaaaattttaagtcaatcacttaaaaaagaagtatataaatgtaaaatactgacttacaaaataatactatagaaggttcactattataaaggtgatcggcacatttttaccaatacaggaatcactgctgagggaactgaaaatgctgtggggcttttccactgggtttcccaattttattccagatccttaatctttttgttaactacatttctagttttaacaagctaattgcatgatatggttagtaagcctatatgagttacatagaatttgtttataaaacctaactatattgtttcagtcatttcaaataatcataaattttacattttccatttttagagtaatgatatttttagatgcctttttttacttcttcaaatacattcttcatgatcttggaaaagagtcacataaagagaagcattgcatgtttaaaataagaaagtgggccatttatttttaggaaaggagactgagaccaccaaatacagaagcaggctggcagtgtgggcaagtctcccagggatcagagactgcagcttcctctgtgttttgctttgaaatatatttccacaaatgctccataaatattcattaataatggttaagttaggagtaactaaggaaaactgctctccgagtgatcccagatgaagagggagcaaatggaacgcaggcttcataagaacgtttttctcctctgcctgaggagtaagatgagacactcatgggagactgatgtcctctgtccaaataacccttacctacaaggtgctgcaggcacccagaggccgtagtgggttccacagccctctgcttctcacagccagctgaacttgataaggcagtctcacagccagccgaacttgataaggcagatacccacttcatcttagttgactgagtgataaacaacaaatcacatgagctgctcgtgcctacattactgaaggatcattgattctgtttcaagtttcctcttgacatacacgtgcacctgtgcaaacacacacacgtatacacacactcacgaatcagtgtctgtctcaaatgtaacgccttggagaactggactattacataggagctgtttttcggattttgccatgttttaatatactgacattcttctaaggatctccatatttcaatagttggatctttcagtaatggtgattacaatgccttaaaatttcaaagaattgtaattttcagtttgtatattttaccattttttaaaaagccaaaacaagtgaagaaataattttatgcttaagtcagtagcatacataaacatttgttacataaaagtagtatgcagtttttttttgttgtttttttttttttgagacagagtcttgctctgtcacccaggctggagtgcagtggtaccatctcagctcactgcaacctccacctcataggttcaagtgaatctcctgcctcagcctcccgagtagctgggattacaagtgtgctccacacgcctggctaatttttgtgattgtagcagaggcggcgttttgccatgttggtcaagctggtctcaaactcctgacctcaagtgatccacctgcttcggcctcccaaagtgctgggattacaggcgcaagccaccgcgcctggcctatgtgtgcaattcttaaagctgttatgggagaaaggaacccaaatgaaaattgagtgagtactgcaagcctttgaataatgagatagatctattggatttcaatggcaaagctgcaggtaactcactaatgaatcatctattacatacatttcacaataacaacaaattcaatattttgggaagcagggaataacccacaaatcatgtaaatgatttcattctgtattttgaatgttattgaaataagtcctcttaccatactcttcaatattgacaagtattatctcaaaaattctctagcttataggtaatggctgacccctttgggcagctgatcgtgacggttaacactttgttctttccattacattggaggatgaatccttcttttattcagagaacagaccctttaagcaagagaaaactaatgaaacatcaggaaaacagtctgttttagaaattctaacttaattctctctgtgacagaagcaacagcttgattttcgttttgtcagcttcagcattggctgtcaaaggcagctctggaattagcatttcctgagccgcatccataggtgtcttactctgcatccacgtagttcagaaagaaaaaatgcaaggaaactttcaagtagaattgtttaatgttatcatttataaaagaatatgagtcaaatatcctggcagaaacaaaccttcaaagctaaatcactgtgtgttcccatcaaggcattttgatagccaatatgattcttttttcccattaattgcattatgccaagaaaggatggaaaggaaaaacagcatagaaatataaaatattggcagccattctgtatctccctccaaacctgttcgttcataaagcctatacttttagaatgttatcatgtaatacaaagaggaacttcctatatcaaatgttagttcttttgaatataaatatcctacagttgacagaataattttattttccttaatgacaactagagtgcatattaatatgaaagctttcaaaagaaatattgatttaaaataacaatatttgggtcagcatgctatagagtgttgaaataatattagccttaaaagttaataacaaataataatgaattagaatgccaaaatattgcccaacacattctgtcaacacgtatatgaacacagcaggaaatccaaaacaaaagctaatttatagagaactctgtgttcctaatgacagtttagaccagtaggggtccaagttacaaactgcagtcttcacatgcgatactttcattttacattgaaagcttggttgcactctggatacatgtagccaatcaaatgattgccctatatttaagagtatttttcttatttttttctgtgaaatctgattattagcacatgaaatacacatgtgcatcgtgtatatttatgtattcatgaaattgatacataaaatgaaacaattctgcattcaaagcccaagatatccaaggaatcgtatgtataacatgatagtttgactctatgcaatgtagttttaaaaattaaaatcaagaacaacatcggtattctaatgtgttgacatcttattgatgccagatatttttccctgtgctcaataatttagcctaaatatttgtattttaaaatatattaacatcatagaatataaatctggaagagaccttagaggtcatctagtgcaaacccttcagattttctttgtaaatgagagagccaagcctcagaaagatccagtaacttgccaaagttccacaattatttaaagccagaattcagacagggactccagtctcttttaatacaaacaaaaggccccacaagatgcaatagacaatctgtgttgaaaacaatgtacttacctatgtaatgtcagactctgattttattttctgcaacttaatatgttcctaatgaatctttctcagaaagattccttttggaagtgtaccacagtgaatgtgaagtgaattgcaagaaagggaaactctacatccttgcttgctttgatgaagttttgaggtttgggagactaaacaaaatggaatggcaggcattttcagcatggtatttttaaagtcagtttttcttatcagactctctttcccatattacctcatcctctttgtctttgtgagaatgttcacttgatcttgtaatattaaacagcgtttagccaaccctggcaggccctcccagcacgctactctgtgttgccaaaaccttagagcacactcctcagggttctggtggcacacaccaccttcaggtgactgatggctgggtgctcgggtctgtgttcccttcacaacatcccctgtaatttgctccaaggttctggcaattgctggactatgtcaccagctgtcatcacccttccttcccatccatttttggcaggatctggggactcaagcatgccagtagaaataatagtagctgtggtaacaacttcagtggcatggtccccagagacgagatcaaaatttggcacctttttctctcaacatggagctaaaaatggcactgaatttgttacttggtggtatataattttctttaattacacatttttggtttcaagtgttccacatgctggcttttaagtgtgacaccaacatatacgggttaaaaacaatggcatgccccctttttattttatggggaggaggtgaaataactataataccatggattccgttcgtctccagccttggaaaataaaaggaatgcatgctgtaatttctctcactttaatggtctttgtgtgtgaaaaaaaattccttcataaaattttactgataaatctttattaacatattgtctcaaaattatttcaattaataaggttttttcttaattattggaaaaatctacagaaacatactaagagtttgcagaataattttttaattacataagaaagatttaatttttaacatctgaaaatggttacagttcatgaataccacaagacaacctaaaaagatgcagtctagagtagcctatttggctgttagtaacagaggttttgaccacgatcaatgacttcatatccatgttagtcactcctgagttgatattactataatttttttttctcattgacttgggtgatagtataaaaagtatactcattaattttatagatgacaaatgtcagatgttacaacttattttaaagggatccctgtgctacttcaaactttactaaagacaaagcaaatggtttttatcttcataattgttttgttttctgggtttcttttttctgttcatgatatcagtgacttcactgcccaggctaaagtgatatcatgaacagaaaagagaaacccagaaagcaaaacaattatgaaggtaaagaccatttattttgtctttagtaaagtttgaagtaccacaggatttctaggtaggtctagtagaaaaatgtaaagtttgaagtatagcccagtcaggaaagaattcagtgttaagagatacatatttcaaagtcatccatccacatggaattggaagttgatattataaaagtggttaacatgaaaggaaggtcaaggaaggactttggcaaatgtctatattttggggaatacatggagggaggcattgtataagtcaggagtaggcaggttatgaagtggtaaaaacaaccctaaaaacctaaatggctgtatcagtttgtaattgcaactgggcccaacttagctgggtgcctctgcctcacagtctgtaaggttaagtttacagtcaaactacagactggggctgctgtttcatctgaaggctcagctggtgctgcaggatgtgcttccaagctcacacacaaggtttttggcagacttcagtctcttaccacatgggcctctttatgaggctgcctcataatatgacagctggttttccctatggaaagcagtccaaaagagagagagaacaaccaaaaaagaagctgaagtctttcgtaacctaagctcaaaagagacattgcattatttctgccatatgctttccattgtaagcaagtcactaaatcaagcctaaactcaaggggagtagatgatacaagggcgtgaataccagaagacagggcttatctggggccatctcagaggctacctactacagtggcttaacatgatggtttatttttgcttaagctacatgtgcagggtggttcttgtcaaggggtttctgctcactcaaggccctagacttaacagaaacagtactcagcacatttgcatgattactgcatgggaatgcaacacattacatattggttcttaaatcttcctcacagaggtaagacatactacttttgcccacatttctttatctgaagcaaagttataaggcttcagaagagcagggaagagtaactccaatatatgtccaggagaacttagttatttgtgaatagcctgtaagacttccacaaaatgatttaaggagaacaactgggaaccagcagagaactgggaagagaaccaggagaattatgaaaggaaaataaagtattgatgatgtgtggctaataatgcccagtactcttgagatgtaaacaggatgaatattggcacgaggctactggatgtggcaatttaagagataccagctggggatggcgactcactcctgtaatcccagcactttgggaggccgaggcgggtggattgcttgaggtcaggagttcaagaccagcctgaccaacatcatgaaaccccgtctctactaaaaatagaaaaattagctggatgtggtggcgggtgcctgtaaccccagctactcaggagactgaggcatgagaatagcttgaacccaggaggtggaggctgcagtgagccgggattgcgccactgcattccagcctgggtgacagagcaagacttcatctcaaacatacatacatacataaaaataaaaaaatttaaaaagagatacccataaccattgtgagaaagattttagtacagtaatgaggaacatcagttaaagtgaggagaaaagaagtgtgtgctgaggaagtatgtattgtggtctcttcttttgagatacctggtagtaaagggaaggagagaaattaagcaaaaatttgaaagatatcagaattaagaaacccttgaaaatcctgattctgtaagtaagcatgacatttataccccaaacattgctttttcatctcttctaaaccatttgtaaacatgcttaagttgaaggagcaaacacagagaccttcagtgtacagtcagatacagtaagatgctggtcacttcataccgtctgggttaagtttccgactttgtgtcacagtcccatttcttcatcttaacaacaacgattttctgcagggtgacaagttataatagtttttgtttttaattctggtaagaaacacacaacataaaatttatcgtcttacacatttttaagtgtatagctcagtaggattagcattgttgtgcaacagatttacaaaatgtttttatagtatgaaactaaaattctgtacctatcaaacaacaactctccatttctccatcctcccaaaccctggtcatcaccattctactttaagattctatgactttgactacttcagatagtccatgcaagtggaattatacggtatttgtatttttataactgactgacttcatttaacgtgaagtcctcaaggtttgcatgtcgcattctatagcatgtgacaatatttcctttttaaggcagaatactcttccattgtgtgtatataccacagtttctttatccattcatccattgatgggcatttgggttgcttccacctcttgactattgtgaatagtgctggtaagaacatgagtgtgtaagtatctcttcaagaccttaatttcagttctttcgggtatgtagcctgaagtgggattgctggatcatatggtatttctatatttaatttttttgtggaatcaccatattgttttccctagtgtttgcaacaaaatgttgcaatcctagccaacagcacacaagggtttccatttctttacatttgtgccaagacaaatcataatgtttttaaacaaaaatcaatttgggagggccatgagctgacagtcatcaccacaatacatgaatttgtttaatcgtattgctttcctccttaaagtttgcacttcctgagatttgcactgaggaaagtctttcctcactctttccttttcctcccacctggtggagtcatgtgcccttcttctgtactgtcttcactctgcatctgcatttatttgttacctcttcgggctggagcacagaccatcacagttgactcacctgcaacatcatgaaaggaaaggctgctagccttatggaggaaaccacttttagcgaagatttagggagggtaaaaaaatgtatgttatttttagctatgctgggtgttagatggattacttttaagttgtttttttttttttgaaacagagtctcattttgtcacccaggctggagtgcagtggcatgatcttggctcactgcaacctccgcctcccaggttcaagcgattctcctgcctcagcctcccaaataactgggattacaggcgcctgccactacacttgattaatttttgttttagtagagactgggttttgccatgttggtcaggctggtctcaaactcctgacctcaagtgatccgcccacctcagcctcacaaaatgctaggtaggattacagaggtgagccactgcgccctgcctaagtaatttttatttaagtataatatacatttagaaaagtatatggatcgcaataagtgaacacaccattggaaccacctcccagatagaatgtgagcagcactccagaaacctctagggactatgccagccactacctgttccttccttcctagaggtcatcaccatggtgactttcattcttctcagttgattttacctgcctttgaactttatatacatgaacttatacagtattcccttttttgtgtgtgactgctttcttttgcccaacattaggcttgtgagattcatctatattgttgtgtctgccagcagttcattccctaatgctgctgtgtagaagtccattgtatatctgcactataatttgtttttccattctactgctggcagatgtccagtttggggttgtttccagtttggggctattacaaataatgcttctgtgaatattgttgtttatgccttttgttactatgtggatacatatttctatggggtatacaaacagacttttgtagatgcactggggacttcaccaccatttctgagatttttaatatgagaaaatacatcccaattccagacaaccaacttaaaaattgtcttgcaaaatactcccatttatagttggtaaaaatcttgtatttactagttttaacatttggacaacttcttattatatttacctcatggggcaaatataatcattctttctacaaaaaaagaagataatggacttcaaggttttttaaattgtgaaaaacacactgataaatatatatctcagataggcagtattgctgtcatctacaaatttcattctgccttggataacattttggatatgaatccaggcactttcactattatattcacctagaaatacatggaagtgacataaaactaagaagcataatactagaaataaaaatttttcatgattaaatctacatgattatttctgtaaccttaaagttcacaactataatgcttacttttgtacttttgtaacttttaagttgttgttttttaagaatcttggagttaaacaaaatagcctgttcttaatttcattactatcatcatcatattactgtaaaactttagttttagacagaatagtgggaaagtgctgcgtagaatggtgcccaggacacacagatgtcacctagtgatatcctcggccccagcccccaagtactgccccagcctgcagtgtctttggatgtagtagagaagtgttatcgtagcctgtggcccccacacaagctgtgtttcacttccttctctatggattttcacatcccactaccctctggtagaatacagaggtatgtggtgatacatcttttgtcatcagaaggtcggggtttgaggttaacatccattgcaaactgcatgcaaactctcaaacaaccttaaactctcaactaatctccactttcttggatttaaaacgaaaaaaaataagtcataataaccattcaacagaacctttgtgaagattagagataataccaatgaagtactagtacagttcctgacacacagtgtttgttcaatgactggtttgaaatgcatattgcatcatgatgttctaccaccagcacaaggaccatgtctgtggccggggatgcctggtatcactcctggcttgtacgtcttcacctgagacccagggcagtgagggactcagaagagcacagcgcccccagcttcttcttgccactgtctgcacaccctacactgggacatgcctaaaccaaggatcctttgtgccatccatgaatagtggcagcaaatgcttttccatgagttcagttctgctttccaactcaggcattgaagaactggacttacccttctttattttcagatgtattttatttggcgaattttccctttttttctgccagataccccatttagttttattacaccactgctcagtaatttctgtagcattcttgactttcatgagtttgctgcctgcctctctcctttctctccttcttctcgtctctctctctcctctctctaactttggagagtcagccccactaccaccctgcattcgtatgaatatcttaaattatgcataatgagagtcaagggcatcactaaatacgaaacaccaacaatttcaaagtagataatatcctaagaccaaacaactcattggtttctgttttcaatgcagtattaaagagataatatttctggatatgagtctcattatatagcatcttcagtagaaccagcatctcactttattgagattttctgtaataaaaaaaaatatatatatatatatatatatatatatatatataaaacaaagctgttgcctatctggcaaaaaataaaatagctctcccaacataaacattacattactttctaacatatgacatctgcgcatgatcccatggattatgtctactcttcaaaatccattaaaaccgataatgtgagcaaatctatcaggcaagaagactttttatgttaaaagatcacaatgatgacaaattattttgtgtggaaactttgaccctcttggaatatttattgctgctatgccagagtgtgtctgtcaaacattttactctatgcaaaactaagctcccattattttgttcaaaactcgtgaagcatctgaaaccctgaaaaatgtatgatgtgataagtgtttagcaagtcaaacactatgcaatttaatgcagaatgacacatgaagttatacctttttacatgatgacaacttgtaaattgaagaatcctataacctatatcttaatccgtgaaaatcagagtttaggccgggcgcagtggctcaagcctgtaatcctagcactttgggaggccgaggcatgcggattgcctgagttcaggagttcgagaacagcctgggcagaacggtgaaaccccgtctgtaataaaaaaaaaatacaaaaaattagctgggcgtggcggcgtgcgcctgtagtcccagctactcgggaggctgaagcacgaaaattgcttgaacccgggagacagaggttgcagtgagccgagatcgtgccactgcactccatcctgggtgacagagcgagactccgtctcagaaaaaaaaaagaaaatcagagtttaagaggaattgctggccaaggacaactttagcagggagtgtgactatatacatttatttaaaatatacagggtagatgtcgctatctacctatttttggtatctttcttactatagcatgcttttatatcaggtattattaacaaaagaatgtggactgttaatagaatatcctaaaactaccaaatttttaaagtttagttaattacatatagtagtagtagactttcagtcaactgcttttcagacagcattatagtaaagcagtcattcatccgttactaacatgttctcctctcttagccttacgcatttgttttctatgtattaactttttctctaaattactatattttatccacacagtgttttcttagatttttaaaatctcagaaaatagaatattcctaactttaattcatttatttgacagatacttattgagacctactaggtatcaggcactgtatccttatacaaagttatatgtcttataaatgagatacgaaagtcaactaaaatagtcttaggaaaaacacttcacccagtcagggtatgagggatgcacaggtattttcctgtcagggagaagcattgcagacagaagggactgtttattgaggggtgccgtggtctagtcaggtgactccaaatagttcggtaacctggagtccagactaaataaaatacctcagcagtaagaactgtccagctttgtgccagctctccttcatatgccctgtctagaatcttctggcctacaccttctcacctgagcttaaattaaataaggtggttgtaacaaacctccttttaaaaataaacctaatttctaacaatatcacgtaatttatccaaggctaaattctagactgaagattgaaccaaagtctgactgcatccaaagcccctgctccatgtactgtagcaggtcagtgccgttactttatgtattggatctgaagggctttttgacagtggtagtcatcacactgccttcttattcttcctccattgcgctggtaaattccagtacatacagtaagtaaaataatgtctaaaaatatcaaaaaaaagttctctttcatgatatggtaatatgaccatcactgggtttccctaaaaatatttaaccttccttaggggttagttcctaaactatattctgtgcagcacaaatgaatgtttagtatattaggtgagtatgacagcgacacatttttctaaatagcattgataaattaagaaaaataatacacagggtattcacatttcaaattatgtctggaatttaaaacttatgtttatagttgtatagtcttctagttattttttaaattttttaaaataaagcaaattagtaaacataatcataaattttaataaatgtattaaatataaatttatgaaattattttacccacatcagaaactcacatgaaattacctgacacatgtacatgctttttaatctgtaccattattaaattgtttgtcgtcaattcaaaaattactcatcccaaatttagaatattcaaatttgattatattttgtacagctgaatttcatgtaccaacaaattcatctgtgagacaagtttttgggtttaccttaacgcaaaggtagaggatcatgtctcttaagaatctacaggtgttgcagcaaagtagcataaatttgcaagtgacctgtggtctagtaagtggcaaatgctgttatagggtgttctaccagttacttaaaagatggtgaaaaatggaactcaattagagcaaataatgattgattcctaagagtttcctggtaccaatgaagtgaatagtattaaatcactattgaagtgccaccatattgccctgcattgctatgtaaattatatttgtttgaggaactctttgttttataattttcattgcgcagttatccttggtatttcagaaaatggaaattgtaactttacatatgactcttgttttaaacatgcttagcaattgccgttgtagctgaaggcagcagatctttaaacaacttgtgttctttacccccagcaatgcatctctttggcctcaactggcagctacagcagactgaaaatgacacatttgagaatggaaaagtgaattctgataccatgccaacaaacactgtgtcattaccttctggagacaatggtaagcgaaagaattatgtatcctgtgtttctcttttaacatcccttttccataaatttatttttacccatgcttacatctagtttagatggaacagggaaaagtgttcgaaattacagatatcatctttttataagtttttttcaattaatttacttgaaaggttgaaaattcacatttttattacaggaataatatgattttctgccttctgatttgatggctaggcttttctgcctttcccttctgcagatgtatattgagttttatttttagtctgcaaatagattataattcagtgtatcatctcttgtattaccttgggtttattaggttttcttcattcaacttgcgtgtggagttggaacactgtattaattttattataaaagcatttaaatgcaaagcacattaaaggattatagtttattgaccttttctctggttgccctttctctaaacctttaagaatttgcactttgagctaacaaagattttgaaatcaattggctctgaattaaaaatggaatttaagtagttagagaattccattttttcaatataaacacttagaaaagcgtatacatacatatgtacacttacgttacaaatagttttatattatttctgtgtgtgtgtgtgtgtacatgtcttggccttggtatcctctgactttttgcaaaatatcataatactttatatctcagagcatcctgatgaagacgcctttttctgtcatctggttaataaattatttccctttaagcattcccctaactcgtcttcctctttgtttcttgtctagtatattggtgttcagctttggcattaatatgtctatcctcatgtggctggtttctttgcaagactggaaagaaattattctacatttaatgaacttattatatgttgctgtgtcacatgtacccatttactgggatgaatactttgtacacttttttattcttttttttcctaatgataatactttatgacattctctttctccttagggaggttgaggaattttacgacattcgatttttataataatagtgaatcccccgccatatggaacctttttatataaagttctgcatgttccagaagaactgtaagctggtgactgacatgtcacccacctaaagtagacagtggcagtcactgtagagggggttaaagagggttgaaactatagattgggaaattttaattacataaatttcaattaccttttttatacattaataacatatataaacaaaatgagtaactatacagaaattaagaatatttattttggtttgtattgactgaaatttagactgtctcttaaaatgcatggttcctgtgaagatgatcgaatggtacttattaaccatacatgtagggaacttttttacagactgaagaaattgtaattataccaaagagacaaacgcttattatggatattgtatttattttacaacatcttaaccttttattatgattaaaatgaaaatagagtttggctaattagtttcacagtcctgaaaagcatgatactgagaaagctgtggatttagagactcccacagcctgggtgctgggtgctggctgctggtattttgccagggaatacctctgctcacgtcagcactcctcagctcacagaagcctatattcaaatcctcgctctttcgcctgtttactttgtaactttgggcggcgtgcttggttattcagatttgcaagaaaattttagggcagctgtggaatgggctgcctaggatcctatcagtcgcagaggtttggaagaaaaaagaacatcacatgaatgtggccatattaatagaaatctccgtaaagctggagtccttgaaaacagtggcttttaagctattgaccatgacaatgcaataagaaatacatgttacatcaaagccaacatatacacacacatatacatatgtatctgaaatatgcttcccaaaataatatttatccttgccttgtaaaatgcatcctgggattttccattttattttattgtatttctcatttttaacaaacgccacttgcaacccactaaaataatttcatactttatgaaatattgtgctctgtaatttcagaaatactgctttggtagcctccttctctaagggggactgaagttcccccaagtgatcatagaattcagttttatacagttctgtgcacctttagagcacctgtatatacatataagcgaagtactttcttcctagatgtgtaaaagtctcctatatagggaatggttaacggaagccccagaatcagttaagtgcactagagaactgccaactggactaggggatttgtaggaatttccctgcatggaaaagctatctctctctgggctctgaccttgtccaaagagtgacctaactattagttacttgccttctttattattacttgaatcgcccccaaaaccctaaattgtaaggaattcttgtttctgattttccaaatacaagttcttaatatctcctaaatattgttcttaaagacctggggcacagggagtggacgggaactctatttacaaggagggaggtagctgcaaaccgctgcttttcggctttcgtgatgaacctcagtgtccatgcaccaccacccaccacccactacttaaattttatatgctatccaagaagcagatcacatcatctctttagaaattctaggagattacaacccttgagaaagctttagaattctgaacaaagctcactaggagaatgaactgtgaaaagcatagtgagaaaattatttcacagcttctaaatgtaatactcttacttgtgcagtcctattttactcttattttgtaaatataattctaaggaacaatcattgtgctaagggtgcagtaaactccctgcttgcatttaagttaacagtgagccaaagcttctaaatggtatttagtatctaaaagaaggatttctgttatatgccatcatcctttactgattattcctgagaccttctttgcctacagattttagagatgagttatcagaagcgtagggtcttagacaaaactgatggaaatggacaaagtgaataaagaggtaagaatgaagtttgtagctcaaacactggtctctttccagaaactaaaattattcccctggcccaaggaattcatttagcctaatgtactggaaagaatcacacagttctatactcaaatcctggctccttcatttatttactttgtaaccttcagcatgttacttcactgacctctttgagcttcaatttcttcacatgtaaagagggaataatagtacctatctcctgactttccaaattcaacagtcggcagccctagtatccctctcaaacttctccccaccatacttctcaacaactatttcagatcttcctgctatactcaaacccctctctcagcagatgaccctgcattctattaaaaaaaatagaaacttgcaaggggagctctcattttctgtaaacacatctttattcctccacatatgtggatctatgcttccaccttttctccccatattccaggttcatctttgcgggggtcctcttgatcccattctctcttcagaatgtcctcattctactgataccatccagtcaacatttgaacattccagtctctcacatcttggaaaacaataatctcttgactttgcctcctactgcctctctcttctaccagccttctttttatttatttattttatttgtttatttatttacttattttgagacagggtctcactctgtcgcccaggctggaatgcagtggcacagtcacagcttggctcactgcagccttgacctcctgggctcaagtgatcctcccacctcagcctcccgagtagctgggactacaggcacatgtcaccatgcctggctaatttttgtatattttgtagacagtgttccaccgtgttgcccaggctgccttgaactcctgagctcaagcaatcctcctgcctcagcctcccaaagtgctaggattattggcgtgagccacctcgcccggtgcttccagccttcttgaacatagtgtgcttagtcactttgatcacttctctgccttctgtttacccccttacagttgggctttcacagtacccctagctcatgacttgtcctcctctaccttcaccacacactcatacttcactgaaactgatgtctccagagttacccattgctttgtcagtagcaccagtgaaacctctttattctttatcatgtttgagtttttggaaccatttaatagttaacctatccctcctgttgcaatagtctttccttagcttctgtgataccacattcactttgactttctccctgactgttttggcaatgatgtctctgtttagttgactcacctcccgtctacctgatccctaaatactgctgtttctcaggactctgcgcttgacaatataatcactctggattctgtcacccactttcatggctccagttacattctctgtgcttcctaactctcaaatcagtaagtccagcctagatgtctctcttcagctccagatctcaactacatattttgtagacagtggtggtagtagtagactacataaaatctacccaattgtctttggaacatttccacttgggtgttttccatgcatcttaaactccacgtgtctaaaacagaacccatcaactactttggttatctattactacataacaaaccataacaaaactcagtggcttagaaagcaatgttatcatctcttgtggttcagtgaattggccaggtacttcttgcgttcttacttaggacactgcgattgctttcagatgttaaccaaggttaaccaaaggctccactgagctggaagtccagggtagctcactcacatggctggcagttaatgccatctgttgacctgagctcaactgtagtcaccagctggggcacctagacatggccttccatgtggcttgggcctcttagaacatagcagctggttctgaagaggaatatcccaagagggagcatgccaagagcctgacagaaactaccagctttgtataacctagcagtcgccattctaggctttcactgccatcacattctgctggtcaggaagtcagcaaggtcagccaagattcctggggaggggaattaaactcctcctcttgactagggacctgttatgccattgcacaagggcacgtgggatggaagatgctgttgtggccatctttggaaaatacaattgccaagccatctttctttccaaatttgcctctctttcagggatttctgtacagtaccttcccacatccccccctccacagttttgctttttgtggttttagttacctgtagtccactgtggtctgaaactattaagatactttgagagagagagagagacagaccacattcacttaactttcattgcagtatattgttataattgttctattagtatctttttcttgcctaatttataagctatcataggcatggatgtataggaaaaaatatagtatatatagggtttgatattatccacagttccaggcatccactggggatcttggaacacagaccctatggataagaagggattcctatattaggaaatggcaccgtcgttcacttcatcactggtccaggaggcccggtgactgcttctactctctcatctcccgtatttagtcagtctctaagttccttcaactctgaccccataatatcttttgaatcctgttttctctcagctggatatggtagccttctatctgcgctgtatgtctccagtcttgctcatccactcttcacacacaaatttgagatatcagttccttgcctaagccccttcagtgacctagattctagtcagaagcctttaaatgacttacaaggctctccacagcctggctgtacatcacaccatactgcaatataaaaacaatagcacacagagacaaggagtgtagagttacgagcctcaccacctgatgtggtgtcctagttctgatcattaacgcctgtgctacttgggacaggttatatagcttcattgtgcctaagtggtctcatcaattaaaagggactaatttacttcatagaatggtctttggtcttgaatattcaatgcaaatatacaaaggtgtaaacatacaatggtgtatagtacatagtaaatgcttgaaaaatgtttatggttgtcactattactatttaatgcatctcatctttactagactataaggcaaggatcctgtctgttctttcactgctgtataccaagctcttggcacagttctggcatgtagtaggtgctcacaaagtatcagttgaatgaatgagtgaaaataatacaactaaatgatatgatataaagtatacgaagggccatgcatcaagtatatgcaaagtactagtatagaatagtggctaagaactgaagctctgccactcactgggtgcctttaagcaaattaccactctcacctcctgtttctttatagggtaatataaaggtttacaatgaggtttgaatcaggtcatgcatgcagggtgccaagcaatgattggaacatgaaagctattcaatgcatatcagtgattgtttgctcttcattctgcaattcaagatgatgcacttgtaattcatagcaaaattttaagaagacacttctgcaaatcagcatcggtagtatcctctaaagcaataatggaaatccccatcattcgttatttatatttttagttatttgaattttatgaaagaaatattatcgtgtattttttaatgcatagaatttattcattttacatttgtctaatgagcacttatgatgtgccacgcactgagcaagattctgggaatatagctgtaaaagcaagatgatcacagctattgtttccagagcatgtgaattctaggctagatgggaatcgagcgagttattacagtgaattagaaaatctccgttagggaaaagcggagtgtaccctgacagaacatttcaacaccagcttgacttctaaaggggcagtaagacacatgcccaattttagcctaggataatttaggataataaagactgaaataaaaggctatatattacaggcaatgtaactatggcaagtgacttctccaatcaaaagaactctttttgtatggatacgagttgaaaaactacaaatatgtgtgtatgtgtatatatgcatatgatttatgctgcttaaacaaaacaattccaattgcttttaaattttaattttttttttttttttttttttttttgagacggagtctcgctctgtcacccaggatggagtgcagtggcgcgatcttggctcactgtaagctccaccacctgggttcatgccattctcctgcctcagcctcccgagtagctgggactaaattttacatttttgatcatcgtgtatcaactttctcaagtactagacaactctagagagttcagtctgacagcaggttgcagattccctgtgaattcgagaaatggagctgacagggctgcaagagcactgagttttgttcaatagtgttcatagtacttgtgttattacaatgtgtaatagctccttaattagatgctatattgattttgtccattaagctatgtttgcaaagtagttatgtcttatttcacttagcttgtgatgtaacactctgtatccacaatgctaaattatggcatgcggttgtttataaaaagatatgttctctcagagatctcaaagccagggtatgaatccaaggttaggtcatagaattggagggtgggctactgattgtctacaaatgcccaaccttgcttcctgacgtcttaattattagtgcctctgtgggatttaagatgatattatcatttaccttccgcaacaattgcagttagactttgacagtgaatttcttttctgcctttccgtttcactcattataggcttgtttactcacatcataggcaggtggcaaattcatgatatatatggcagaaaacttagcattttataattttcactgatttttctgatagcacaaaatagttttcaaacagataccaaacctcctaattaccaatatgactttaaatcttctgttttgtccttacagcatctcggttggtaaactattatttataaagtgtttttcagttcaaagtacttttgaaaaggcattatctgaaaagctgtcactccactgatgtgttttcatatgaactgggtatcacataagaaggagaggaataacaatagctttgcgtatgtggtctctctctgttttcacactctgacaactgtattttaagacattaagactgttgtgacacatacttactgatgaaagaaaaaaatcacagttagtaggtgaaaagactgctagtggctcccacattcaggcacaacaggacacgttgaaaaaaaccttcaagatgataccctattgtgtttgaagacgtggtacgtttcactcttactgtgaaggctttaattggtttgattcctaacccacaagctttgagtttagaataactacagggcactctgttgccctgtctctattttttcctccagttttcctccttttccttttagtaaaacctacagacaaccttagtgtttcctatgatcattcccaggttcaggctctagggctttatggaggtagtgatctcagtaagggaggatagagagccctagaactggcctttttttatttcttctgaagccaaagttttctggaattcgggacatgatgaaagacttctgtgtccaggcttttatctaagaggactgatgagcttcagaggaaaaagttgtgcaagtatttacaagtttatcaaactgtgtcaatggcccactgacttccaggtgtgtttaccatcaataaagagcatttgaaaatgctaacaggaatgaacacacttgacttgtccaaatgagagaatggctgtgacttgaaaagcagcagtgcagaatttaaagacaaagccccttcacgaaaccctagtcccctgtattcaaactagaggcttaaacaggaaggctgtactaatctaagctgccgtttcagtggatcttgcagagaaaaatcagtgatgtccttatatctctacatcactgattagaaagagaggtcagatctgcaagtaccttttagaaaagacacattctaagactgtaattcagaataaattcattctaactagtgtaataacttgaagcaaatagaagttgacaggcactttagagatgagattcatatttcatgggaaaagctagaatagatcagtgggcttcaaactattttgtttttgtgacccccttcaacaaaatagctatacaaatttaaatttatttattttttgagatcatacgttttaaaaaacctgttttcttctatattaaattatacttacaattattagttgtacacatttgactgaaaacaacctaattcttatataaatgtgttaaacatgttgataatttgaaacacaaaaagtgaaaatgtattgaaatataaatgtgttaaacattttgataatatgaaacataaaaagtgaaaatgtattgaaagtacctctctgaaatgaatgggaacttttttcaaatagtttgtatattcatagatgaatataccttataagaataaaacaaaattcagtttcatttctaatcctgttttcctttcttatgaatataaacaaaagaaatcttgctacaaaataagtaagtgacaatgggaggatttttttaagtgattctgttcagttatttgacattcttgttagtcatatgtcaaaaatcacattgtgatctatttctaaaaaatacgttgtctataagctgccagttctatcacatttctcataaaagcaaggaatcagcaactaactactttgaaaaagatttattacactgtttttagaaccaatccttttcccggtttctgtgtaggatgccaaaaaagactttaccaaggcttagcaaaatactgctaattttacctgttattcttctacttagtggtactttgtttatctggtatactcagaatgcggtgaaaaatggaactttggctcatattaattcacctttgatactataattttgtaatgctttcatcgtattacaggaagatcttattttattacgctttatcatgcctcccagataccgtgttttttacaaactgaatgtttgtggcagccctgcgtcaagcaagtctatcggcaccatttttccaacagcatgtgctcacatcatgtctctctgttgcattttggtaattctcaaaatatttcaaactttttcattattattagatctgttacagtgaccttcaatcagtgacctttgatgttgctcttataattgttttggggtgccagaaaccacacccacataagacagcgaacttaataaatgtgtgtgttctgactgctccgtgaccagcatccccaccatctttctcttcttggacctccctatttcctgagacaaaacagtattgaaattaggccaatcaataaccctacagtggcctctaagtattcaagtgaaaggaagaatcacacgtctctcagtttaagtcaaaagctagaaatgattaagcttagtggggaaggcatgtccaagatgagatcggctgaaagctaagcctcctgcaccaaatacttggccaggttgtgagtgcaaaggagaagtttttaaaggcaattgaaagcacgattccagtgagcacatgaatgataggaaagcaaaacagccttattactgataaggagaacatttgagtggcctggatagacgatcaaaccagatataacattcccttgagctaaagcctactccagagcaaggctgtctcttcaaatctatgaaggctgagagaggtgaggaagctgcagaataaaagtttgaagttagcaaaggttggttcatgaggtttgaggaacgaacccgtctctgcaacataaaaatgcaaggtgaagcagcaggttctgatgtataagctgcagcaagttatccagaagatctagctaagatcactgatgaatgtagctacactaaacagattttcaatgtagatgaaagagccttagactggaagaagatgccatctagggttttcatagctagagaggagaagtcaaggcctggcttcaaagcttccagggacaggctgactctgttagtgatgcagctggtgacttgaagttaaagccaatgcttattgaccattcctagaatcctagggcccttaagaattatgctaattctactctgcctgtgctctataaatggaacaacaaagcctggatgacagcacatctgtttacaacgtggctactaaatattttaagcccactgttgagacctactgctcagagaaaaagattgctttcaaaatattacttctcattgacaatgtacctagtcccccaagagctctgatggagatgtgcgaggaggttaatgttttcatgcctgcaaacacaacatccactctgcagcccatggatcaaggagtaatttcaagtcatatttaatttaatttcaactttcaagtcgtatttaagaagtacattttgtaaggctatcatagatagatagtgattttcctgtgatagatctgggcaaaatcaattaaaaacctcctggaggctgggcacggtggctcacacctgtaatcccagcacattgggaggctgaggcgggcggatcacgaggtcaggagatcgagaccatcctggttaacagggtgaaaccccgtctctacaaaaaatacaaaaaatttagccggacatggtggcgggcacctgtagtcccagctactcaggaggctgaggcaggagaatggcatgaacccgggaggcggaggttgcagtgagccaagatggcgccactgcactccagcctgggcgacagacagagactctgtctcaaaaaaaaataacaccttctggaaaggatttagcattctagatgctattaagaacatttatgattcatgggaagaggtcaaaagactaacattagcaagagtttggaacttaattccaacattcatagatgactttgagggttcacacttcaatggcggaagtaactgcagatctggtggaaatagcaagaaaactagaattagaagtagagcctgaagatgtgacaattgctgcaatctcatcatgaaactttaatggacgaggagttgttcttatggatgagcaaagaaagtgggtatttgagatggaatttactcctgatgaagaagctatgaacattgttgaaataacaacaaaggatttagactatcataaacttagtagataaagcagtggcaaggtttgagagggttgactccgattctgaaagatgttctactgtgggtaaaaagatatcaaatagcatcccatccttcagagaaacctttcatgaaaagagtcaatcaatgtggcaaacttaattattgtcttattttaagaaattgccacagacactccaaccttcagcaaccaccaccttgatcaatcagctgccgcctacactgaggtaagatcctccaccagcaaaaagatgatgacttgatcagatgatcggtagcattttttagcaataaaattttttaaattaagtttgtacgttggtttgtagaaacctattggctgggcacagtggctcatgcctgcaatcccagcactttgggtggccgaggctggtggatcgcttgagtccaagagttttagaccagcctagacgacatgttgaaaccctgtctctacaaaaaataccaaaaaattagccagactcggtggtgtgcacctgtagtcccaggcacttgggaagctgaggtaggaggatcacctgagcccagggagattgaggctgcagtgagccgagattgggccactgcactccagcctgggtgacagcttttgagaccctgtctcaaaaaaaaaaggaaataatgctattgcacacttagtagactgcagtatagtgtaaacataacttttatatgcactggtaaaccaaaaaatgtgtgtacctcactttattgtgatatctgctttattgtggtggtctggaacaaaatgtgcaataggtatgcctgtatatgctttaaatgtgtctatttcattagctcatttaatttatgggaaatagccaccatataatttaactgtcagagccagtactcattgaaatcaaagttaccatttttttgttttgttttgttttgttttgttttgttttgagatggagtcttgctctgttgcccaggctagagtgcagtggtgtgatctcggctcattgtaacctccacctcccaggttcaagtgattctcctgcctcagcctcccaagtagctgggattacaggcgcccgccaccacacccagctaatttttgtatttttagtagagacaggatttcaccatcttggccgggctggtctcgaactcctgaccttgtgatccacctgcctcagtctcccaaagtgctgggattacaggtgtgagccaccacacctggcccaaatttaccttttgtcagaaaaagtctgacttattttttcagttcgaataaattaatctacattttgttagaacctctcagttctgaatccctgctctaggtagagaggtagcaagataaagcacaaatccttgtcctaaccttgacaacgggaataaataaagcatcattacatttcatgtttcttaccttattgctgtgttcttggtagtcatgaaattcttctgcagttgaaaagcattctttgtagaacacttggacacaggaaggggaacatcacacaccggggtcacacaccggggcctatcatggggtggggggagtggggagggatagcattaggagatatacctaatgtaaatgatgagttaatgggtgcagcacaccaatatggcgcatgtatacatatgtaacaaacctgcacgttttgcacgtgtaccctagaacttaaagtataataaatacataaatacattaattaattaattaattaattaaaaagaaaagcattctttgacagtagttggggtgagtgataagttcattaaaaaggttatctctctttcttgatgtatttgacttcaaagcatgctagtagtcctaaataccccattgttaaccccacattttgcccttaatggaactatgttaagcagggaaagtcgctgaagccctaccttgggtttatggtgtcttcaataaaagaggcttcaccaccacaatacttttaattttgcctttttttggcatactggaagttttatgctccaagacaataagtcatagtaatatttgggtatgtgagaggtacgcctttcttttgtaaagaaagtcaacacatgaatgttattgagggtctattaatagaaattaatctcctaccccgttccttattgaaaagttttaatgtttcctagggatatggctacccttttttaaagacccctggactagatgacccccacgggtactagaactcgaagattctgtggtgttatgattaattaggtattttttcgttacgggaggaaaaaaatcatcacaattgctatcccattcaagcacactccaccaatcttggatcttttgttttacaaatgaagaaccctctttttctggaaaagaaccactggttaaattacctatatatgggactaacaggataaatagatatacttcgcgacacaacgatgtattcacatatcatttctgtgagaaagattttaacccctcaaaattaatttgtggagaaagaaacaaggcaagaatacctagcttattaaatgcctttgacatagtgaaaccggaaaccctagaaatcagaacttggttaccattaccacagctaatcctcttgggtaaacataatgttttggaaaaaaattctgaaattggcaccagtttatgaatttatgtttaccagttctcaaagcacaggtatgctattaaaactcagaaaaccattaatagcagcaatagggtcaacccaagagagtagattaaattacatatgcttcggatagtagatgaaacttgttaatgacaatcaagtatcatagccttagaaatgtatgaacttgatgaatgagtctacatataaactatgttcatattaaaatatgatatgtatactgacatcttagaggggaagagaacagctactctactcagtactttaaaattagtttcatgtagaagtcaaccaaaagacaaaaacttatgaggaacttatgaattataacataaagagtattatattataatatccatgtcacgttttttttgtttttgtttttgtgagatggagtctcactctgttgcccaggctggagtgcagtggcgcgatctcggctcactgcaagctccgcctcccaggttcacgccattctcctgcctcagcctcccgagtagctgggactacaggcgcccgccaccacaccgggctaatttttttgtattcttagtagagacggggtttcactgtgttatccaggatggtctcaatctcctgacctcgtgatccgccctcctcagcctcccaaattgctaggattacaggcgtgagccaccacacccggccttccatgtcagttttttaagttttatcaatataaaacttataaaaataagtataaactttatgtcctgacattgtaagtatattctctagggtggttcagtgacttaatatatctgattttatatgaaatagacaaatttaaaacttagtaatttaaaataatatttttgttttaataaaaagcaaagattttattgaggattatatacaacagatggttttggaattctgcagaccttgatttcagtcttgatgccatcactgactttggccacatcatttacttctctgagccttagtttcctcatctcaaaatgataccaacctcttgggtgaaactacctgtcatattgtaggttctcagtgaagattagttccatttctctctcccctgaatcttctcagtaaaagctccttcatgacaaatgtaggttcctttgcagaagcttcctaaatgaaaagtagaaattggtctcagataattaaaaatttctgagtaaagcaagacgtctgtttagctagaaagcaaaataatctctgggtggtagcattatacatattttttctctctttatttaactgtatgttctaattttgctgaaatgaacaagtattactattgtaaaataaatactttgaatcctatgaatgatctacagtttataatctaagagttgatgtgtggaaaaattatagtgattactataactcaatttggaaattttattccttagatccttttatattactgaattggttcaagaaaaatagacctgatagctaccatgattgtgaacactgggaaagaagagaggaagggagattataaataatgcctttttattgagttttctagtacaaccctcttctgcctcatacctgggttattgcagctgtgtcctcactcatctcttcatgtccaggcttcccacagttactgcacagtaatgctcttgaaacagtgatttcatttcacctctagcccgctcagaacctttaatgggtctccatttagttatagctgtccttcacaactgatggtacgtgtgtcatgtaggatgcagtagtccagatggaaagcaattctaacatttgctagtgatgtactctccctcaaacctcacatttatctgtaagtgtgaattttttgtgaattgcttcagatcctataggccataaactgggtctgtgattgcaggtcatgttccgtagtaatcttcaattctgtttctcttgattatatacacacaccccaccaccacacaagaataagtgtgtttgaggcatcgaaatgcaatttacccataatcagtcttcaagtatctgtttgaaaaacataccataaatgacatgcacagtaacagaatactagtaaatatatacatcttcagggaaaagggtgtaataacactcttgatagagtgaaaatacaagaaatcactagcataaagtataaagaccatattctttaacctggtattcaaggccctccacagacagatgccacgtcccttcccaaccttatcccgcatccctcccacgacaaacccattcagtacctcctgagagccagacgctgcagcttgcccttgatgcaccaaacctcatggaatccttgtaacggtgcaatcattatgttactctccccattttctaaatgaggtttagtatcttccttaaggtcacacagctaattgttggcagagccaggattcaaacccaggtttgtctgactccaaaacgggttttctttatcttgttttctggccagatggatttctctgctgagcctcaacctaacacctgtcaagttccacggccatgcttgtgatagcgatgtttatcccagctcagaaaccttatcctacctgttcctcaatgtttaccaccaaacttaactcctgtgaaatctctcaacctccagcctgcagtgatagtgcctttctctgacccctactcatatgttgctttagggtctcacttaatttatcagtttgtgggtgttgtctccccacccaggtaattactacttgatagcagaagctatggaagtctagataatctctaagattctactctttggtttatatttctttttttaagtcacctacagtgctgccgctagcagacactcagtaaaaatgaactcagagttaaactaataactcttcacagatagttagaagcctgtctcccttatcactgagatgagatagcttacagctcagacttaaaatcacttcctctgcgttttgaattaacagtttaatattttttttaaaaaagacaaagttggtagtaagtcaactttgttatcagtttttttttaagagacgaggtctcactgtgttgcccaggctggactttaactcctgcgctcaagtgatcctcactcctcaccctcttgttgttatcagtgtaaaagggctgaattgatagaagataatttgcccagttccattctgttcctcagccttctggacccgtctgcataagagacaatgtagttatatttccactcacggcaaattgcagaaattctaccatgacccccatcagaataactgagaaagaaccttggcaaagagggaaaagaggaacatcgtaccaaaaagaggagtcttggatctgttttctagaaggaggccatgcaggaagagaagagatggtgtctcttaacaggtggcagagatccagggagaaaagaggttttgttcctatgcatcaaagatcagtgtggtcagaagtaacacagtatgtccactaagactacaagtgagtttgaaatgaggctcaaaagaaagaggaaaagttataacagcctacacaaaagctatgtgagcacttaagcttacccctccttcctttcccctcacaatgccccaagtaccccttctctatctctctgccaacatctgatgtttttcattcatcctagtatatcatttagatagaaccacatgaatccgagccatcagttggttttattgtttgcttaaggattgatttagaaatctccataatccattctgccttaatttacactttgcagtgttatagtatgtttagaatgactgataagtaccagaccctaatctctcccaagaaataacaagactcataatttgtaagataattatgtttcaagtgaacagaaagactgtaggtgtgaaaacagctttagtaatgggcataccttgggggaagtcaaaaggattttaacttaaatatcttacgagctaaatcagaattagtaaaacaccagtatctaatagtagaagcttttaaagtgcaaattttatgaaagtaatatatcagaagatgaaatggcttgagcatttggtaaaaataactttttcaaaaagtttaaaaaccttttttgttttgtttttttaaaaaaaatttgttcttcatcagtgcatctcttacattcaggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcaggtaagactaggctttcttatcaataaaataaaaactgccagttgcattttttgaaattattctctttcttaagctcagctgtttggttaactgtttgacgacttttgaatcgactttctacagtagaaagagttttgaatgtagattacttgttctgaggtttttgaatcagtagtgggaagaacaatattttcttcctgatttgactgtttaaaatgtactgaattttgtgaggaacttaatgaatattgagcatcatctgagcacccagtaaaacaccatggattttccaagtgttttacaaagattctatgataatttccgatgatcttattcctttcatgtaatagatgcataacatattcatctctaacacgtattcattctgttgaaaatgtatttttttagtttatgccagatttcctcttagtagagaaatgatgggaacatcaacataaatatgatgacatgagctttatcaactcaggcgccgtgcctcatctaaaatgatcaacgctgagatgaagaggcaagagagctttcagagataaccaagtatgatcatgtcagtgtggtacacaagacaattcacatatccttaatatcaaagaactttaaagtcgtttcccttgcataaaaatcccctcacaacagcaatcacagatggagaactgctggcaattccacagcctttttcataatctaatacagtaccgggtcatagtatgtaaactggaaattgtcgcttaatataggtttcatcatctctaagagaagttatttaaattacctaccataaaattggaactgagactttccccaagatcaactattacgttagtacatagaggaatatcaaaaatgtaagagttgattcattaaaattgacagtaggatgagcctaaagttatattcaataatcagtttatttacctagagaatttcatgctgatttagtgtgacttataaaataagggctggagagttttcatgtatgctttatatcatataattttgtgagaaatattttttctataacctaggaacataaattatgaagaaaagttatcacatattaataaagaaattatatctttaaaggaagatgagtaagaagatttcaacatgctttttctaatgtaattgtggatttagttcatatacatatattaattttatggctgtgaaatttctgaatatcaggctttagtgtattcatttttcctatttaatatttttaatatctatattattaaagtaaatttgatccttatgcattgtatacttcttataatgtactaatgcccaattttaaattttatatttttgtttgtttgttggggttttggtttttgtttgttttgttttttgtttgagacagggtctcactccgtcttccaggctggagtgcaatggcacaatcttacctcactgtagcctcaacctcctcggctcaggtgatccttccaccccagcctcctgggtagctgggactacagatgcgtgtcaccgcccccggctaatttttgtattttttgtagagatgtggtttcaccatgttgcccaggctgctcttgaactcctgggctcaagcaatccgcccaccttcccaaaggactgggattacaggcatgagccaccgcgtctgggctattttattttattttattgtttgagatggagttttgctcttgttgcccaggctggagtgcgatggcatgatctcggctcgccacaacctccgcctcccgggttcaagtgattctccagcctcagcctcctgagtagctgggattacaggcgtgcaccactatgcccagctaattttgtatttttagtagacataggttttctccatgttggtcaggctggtcccgaactcccaacctcaggtgatctgccctcctcggcctcccaaagtgctgggattacaggcgtgagccaccgcacccagccagtctagaccattttaaagtttagatttgactccagttcatcttataggtgacactgactaggatataataaccagattttcttaaggctaggcacagtgacttaggcctgtaatcccagcaccaggaggccaaggtgggtggatcacttaaggtcaggagttcaagaccggcctgaccaacatggtgaaaccccatctctactaaaaatacaaaattagccgaacgtggtagcgcacacctgtaatcccagctactcaggaggctgaggcaggagaattgcttgaaccctggaggcaaagattgcagtaagtgagagatcgtgacattgcactccagcctggacgacaggagcaaaactctgtctaggagaaaaaaaaaaaaagcagattttcttaagtggaagtcctctataacttcaattatagtagacagattggatttatagcaattgtccagtgaaatatgaaaaaatattttcccactgaaaccgcatatgtgattatttgtgtataattcaagaaatatacctctaagctgagcacaatagtaaacatgtaacttacaaattctagaaaataatttcaggtaagaattgtctattgtgttgtgtacttgaaaggtttatttaaagatttagttgactgcaagttgtatataacatttaagattagagaaatgaaaggtgcagtttcgggttttctcataatccttctagtatttaaacacaatacatgtgatatcctcttttcttttctaccacaatatatgtgtttaagtaggttatgcattttcttaagcttcacggttattatagtttcttcctgtggtttattcaagatcagcagagcaaacaactgtttctgagttcagtgtttaaacatgaaatattgtataaggcagcccaaattgaacatttctctgtttctggagaacattaaataaatcaacctgaaataattaaaattggccagccattcagaatagttgcttgagctttcgcagtctttgtgaccctttgtaaaactgcccgtttgattgttgccaaggaatcagtgggctctcttctccctgatgccagttcattctcctggtcagttagtggcctcaggagtcaatgcagagccttatggtgaagtatactgtagcattttagtgcattcacatgaaggctgttgtcgaataggagttggaagcctgagttctagcataccctcaccaccttttcactgtgtgaccttgcagagtcccttctctgagccttagtgtccattggtaaaatgaaagagttggatcagatgatctgtaaaatctctttagtctctatattccaattacagcaagactgtgccactaccaaagagttgatgtaaggacacagttaagtattcatagattctaagaactcatcgttttagtaacggaattgaattaaacatataatctaacttcagaagtgaactaccaagataactgaaacaaaatctatttgtttttaaatggtctattagataatcagcataaatacaacaaacatgggcaaacttttcttctattgattttccaaaagacggcttattaatacattgtagtttaaagcaactttaaatgaggatttttaaagcgtgtatatttggtaatattaaatcgtaagaaaatgacctttaaacggagctttcacactaaaattatctcactttatatgaaacctgtatcaagtataagctttgtctcacgatggctcccgcggactagtgcaattgaagagttagccccaagaatttcttcctaaaaagagcataaggtcctaagactcctcttctccccaaaaatatatctgcatctccatcttagaaatattacaaagcaaaactcacatttgcccttaagtgaccactttatgccctaagaacaaagattattaagtatttttattccttgtaatttggtaattttgggcaaagatggttttagtgttaaagtagggaactttttttaggtatttgaatcgccctcctgaattcatgtgcgaaacacttctgcagatgagcctagaactgggtagatactcaaaacctgtcagctcctcctccccaccatcatgcccactaccctggccttattttattgttcacagtgtgatgcgaatggttatttctatgataaaggtgatggttgtgcttttgccttgaaagaccagctaaaactcaaaattcctcccgttcactttttcagttaccgtgtttaatgttagggaagaaaaatgtttatatgcttcggtcataaaaagaaactttttcttgtctctttgccatgcaaatgtgtaaatatttaaacctgatgaggaaatgaatggcttatttgagacagagtcaccattcaaaactgctgaattaattttcctctgacaattctagaatagaattccagtcaaattttataggtcatgtatccacaccagtcagtattttcatccttataaggtataaatgaaaataaacatttttgactgctgatcaggttatactgtttttatatatttctcacagctgaattctgttctgatgaaactacacaaaagaacaaaaaaaggttttacttataaataaaaattttagtaagtcagaaactgaattagatactctaagttctctccaatattaacagtagaggtctatggtcagtaaaatggcaatatatttaactgtgattctcagaaattccaacaactgattttattccagtttgattggattaagagattcatataatctttttcttaaataggcctctgatgaaattccatttaagaaacctatcagaaagtagaatatttatgatttatatatgcagtagtataataataattatttatatatagtactatggcatatgtttcaccataaacacacttcaggaatagaatgaaactaggtaacattctatagacactgaatcactctacttttaacaattgtaatctaaaaaactccttgaaactacattggaaagtcttttcagtgtctttcaaattccctgtattatttctagttacaaaattttaccccactatattaacaatcacattttatacttttaattcttttttaaactctccagtcaccaatgttcatgtctaattttactacaacaaaacttaggtttaatgatgacccattcataagaataatcaggcacgtttactgttactgccatcctttcagaacccctccattgtttaactgtttagatcaaagatgtaaaggcatcttgttacatgtttctaatctaacaataactaagtaaagcccatggcgttctccatggtgcttgagatggtcacatcagggtcacaagagaggtggagtagggtgggaggaatgaccccacttggagcaaagtgctcttgagttcacaagccaaccccaccattaccagatgtctgagagcctgctaccctcctcaagattcagattccttcacctgtaaagtgcaaatgttaaagccttcctacgagggttcctatgaggaaccagcacggagtaaggattcaacagtagttgttgctacatgaatgttaaatcagagaagactgtacagggttatcttgtggtctaactaaaacaaggttgctggcaacatggatggaactggagctcattgtgtgaagtgaaataagccaggcacagaaagtcaaatactgcatgttcttgcttatatgtgggagctaaaaaagtgaatgagcagaaagaggagaatgatggttctcagcaaactaacacaagaacagaaaaccaaacgccgcatgttctcactcataagtgggagttgaacagtgaggacacatggacacagggaggggaacatcaccccagggcctgtcagggtgtcaggggctaggggagggatagcattaggagaaatacctaatgtagatgatggattgatgggtgcagcaaaccaccatggcacgtgtatacctatgtaacaaaccagcacattctgcacatgtaccccagaacttaaaataaaatttaaaaaaaagaaagagtagaatgatggataccagaggccgggagggcactcaaaatacgtacgactattatatatcaattatgaatttaatgcattaaaaataagcctgctggattggaaatgtcagttcatgtagattttatgtttgtatccccaaactgcctaaactcatcaaacttttgatcagtcagtagaattaaataaatttggaaaccatattgcccaataagggaaaaaaatggtccctgatgtttgaatccagccctgtgtggcgaatagtttgcgtcctccttgtaaatgctatgcatgggagacttctaccatttggacctgtcaggaacttctttctaacattgtatttgttagagcaaaggaagacagattgaagagaaaaaaaaaaagagagaagcagccaccctttatctttctgactatttttcctcgtcctccccccagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttataggtaagaatagtcttcaaagcagcattttccaggctatagcctaaacgccgtgtttaataaaaactaaattatctgtaccaatttggggtaattcctagggtgttaaagcccaggtaaaatgtgagaattatttttaaacctttatttgggaatatgtgacaaactgtgaagcactgggagaaaatattttctggaattaccttgggagaggagaatatgtcatgaaacactttgaaaatctgcatttgaagtgacagtgctttgctttactactcaaattatctagcataaatgaagatcaaagtgataccgtttatcttttgcaagaggcaggctatacaacaagtgttccttctttcctttttcttcagagtctgtggtggaatgtccccgaaattgccatggaaatggagaatgcgtttctggaacttgccattgttttccaggatttctgggtccggattgttcaagaggtatgcaagttagattcttctcttaagccgatataaataagctgtagaaacacaagtgattccaaaaactaccgagacaggaaagaaagggggggggagactggcatattgcttgttccagcgatgtgtcttttctttcggaagctcggtggaaagtgtggctgtaattcttctgtcgtgtcttgtttcacagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaaggtaaacatgtcaatattcacagaagtctgttgttatcttcataaagaaacagattgtatctgtaatctttagttgggcagatctcttttatacgcttccttttgaaagcaattttgaaaaatccatgtttatgaatgcattgttttactaacattttaactaataaaaagaacaagcaccaaagggcccctttgctctttttcagcactgtgaatcattccttttcttcactctgagaaagcaagcaaacctttatgccttgaaactaacagcggacggttgattttatttttctttttatagttttttacattgatgccagcttctaaatctagcattttgacatctctagaaagacagagtagtacacataatatgctacctaaaagaagtatgacatcatggatgtgttccatagctgtatacgtataatgatgagagtcgagataccatactgtaaagtgcaggtgaattgttttttcagaaagcaaaaaagcaccatttccattcttcaatcaaattgattttattgatctgcacacacaaagtaatgcaattaagtctctggaattaaattttcaggccattgaccctacaagtgtaaagttttattgagtcaaattgctaaattaaatctcgtcatctaaagcacattgaagtgaattaagaaggatagagagtatgcaactcatttatttctcaaacagtgtgaggatcccatacagctgtcagtactcagtggtcacagattttgttatagagaaggcaatacttattactctgtgattaggcagaacagagagcaatagtctgaaacctcaagagcctgtgtgtgtaattcaggaaaattacaaatccttgcaagagtctcaattacctaaatggcattaggctggatcttaatgctttattgtattataattctttgcattttcagaaacaagttcttgaaaatggtagataaatatttgattttccaaaatgttcatataaattagattaggatttaattcttttttctgcatgcactatgatatcttctggatttaataaaattgttcttttctttacaccagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacggtgaggttaataaatgcagtacaatcgagttgcttaatactgtttggctaaagatgatattttaatctttaaacctccctttttaaacctaatacaaattttagtaaagtgattctttatggaaataaatattaaaagtaatgatatgtagttgccttataaaaaagaaggaaccaggcttagccagtttgtcactaaaatttcccctttagtattatgcggagactcatctttcatctgcatgagataccatatcttcttaactctcaatttatggaactactaaccaaaactaacctctctaaaatcttaagtatagcttggggatttaagcacattatcttataaacagggaaggctcaatttaaaaaaatcatttgacaatataaggctaaacatcacagtaaagagtatacaggtatagacattatgatatgaataaatggttcaacactgagtttttaatcataataacatggttataatagaaataagacaaggtaatttcattcaatcagccaagttgttattgagcacttactatgtgcatggcattgtgataggccctgtaagactgaaagacttaacaaatcgtgtctgccctctagaacaatggctttctaattttttgaccttgaactatcatcatgacctagtataagtatacatgcacatactcacataattgaaataaacattttacaaagtgatacacgctgatttttttcaagcctattttatttttttcaaatgttggttgcaactcatgagctaattccataactcataagttatggtttgagaagatgccattctagtgtggaagattacagtttatttagggagataagatgaatacatatgaaaaattctaaatcaatacatcctagtttaatactatattgagtgttacatggaatattatgctaaattcagtggacattcagaggagtgattctaacttaatgagtattcagagttttcaaggagacttgtattaacatttctttatttaatgatggtggtagtctgggtaagggtataatttttggctaggtgaacagtattagaaagtacttaagagcatggactgtgaaatcagatgtgtggattcatatccaatctgtactccttaagagctatgtgatcttaggcaaattactatatgcctcagtttactcatctgtaaaatcatgggacactcttcacaaagatgctgtgggaattacttggaataatatatataacatagttagtacagagcttggctgataataaattctaaagatagcttccaccaccatcatcactaccatagaacatccctaatctgaaattcaaaatgcttcaaaattcaaacctttctgaacaccaacatgatgctcaaaggaaatgctcattgcagcatttcagattttgtattttcagattagggatgctccaggggtatttattctgcaaatattataacatctgaaaaagtttaaaatccaaatcacttctggttccaagtaatttaaataaaagattagcaaagatgcaattgtgagaaatatcattatattcaagggacagtgaaaagaaaagtatttggaggcaaaaaaattggattgggcccaattttggggagtatggtttagaaatgatagttttaggcaatggaggatttatcgatagcaataatttgcccactaagacaatgagagtattgtttttggaaaactgtcctgtagataataagtcagagagcatgaattgtgagactttgatggcgaagagacaagctggaggactttcccacaagcgtgaggtgatgacagcatgaattggctgggagtcagtagaaataaaaaagataaatctgagggacatttgaaaggaaaagcagacaggacctgctgaaaaaaacacaatagagacgtgtgttgagaagagctgtaagaatgaagcaaggaaaattggtgctaatgttaatgtccctgaatgaagcaagaaagttgggaaagggggaggctgattgaagaggcaggacgtagggaggcaatggaagagaagtgagaaatagaaaagagatgaattccgtttggatactcaaactaagcaaaactacacagttcatcaaaagaagaggaaaaatgagaaagagaagcagggaagagagaagtggaggaggaagaggacaatgatagaggaggaaggacaagcagaagaaaggagaaagcaaatggattttactagcagtgttgagtgaataaaaacatcctgcttagattaaacataagtcttggcttcagtgaaggggtctatctactttcctgcccacactgattgcccccttctctaagcctgtttaacagtaagtggctgagaaccagaactcagacactgaactgcctgggttcaaattttggactggccccatcacaaaaaaaaaaaaaaaatttggactggccattcactggcaatatgacgttgggcaatttatttaatatctctgtgcctctgtttctttatatgtaaaatggagataattacaggactactttatacagttgaggtaaggcttaaatgagctagtatgtgaaaagcacttagaatagcaccttagacagtaagtgctcagtaagtgttaaccattaatagacgtagtagagggtggtggtagtagttactatggtagaagtattctaaaggctaattgtagttcgtcattcttaatttctcatcaattcagaggagcttccacattaaagcagtgattggacatggttccctaaatgtgaaagttatgaaatgcaaattgtttcctctattagtacaatctaatggcataaaactacatgaaatcttgtgctaagaagctaattcacatgtttatttttagcaagaagtaaaaaggctagtaatttttacaaattgctgtttcctggccttttgagaagcttgggtgacatctctgctgccctatgagtcagtatcagcatgacagatttatctgctactctttacctactacagattgaatcctggaagcccagactaacaaatgtttcctatcagctaatgtataatattgatgaaaattttctgttgaactcatatactacttagagacaagttttcatcctgagttctccttcccattctgatttttgtatgagttttcttcctccttccctccctctcttatctctccttccttccttcctccttctcttcttcccttccttcctgttttattcattctccctcatcttttggcccatacacctctggatagcttgaagaaccagaaactttgtagagaaaattcacatctgctagagcaaataacatgcatagaataaataagagtaaaaacacaaattgggatctggattagagagagccttgaatgtcttactaaagagttttagggtattaccaccaaccaacacttacccagcatgagtgagtggtattattttaaataacatgttaacttgttttgtccgctattcataaaatatattttgtaattacatataatttacatataaaataagcatttagtgttttctgttgagtttttacctacactaaaaaaccctttccacaaaaaatatccaattaaatgttatagagataattacttctatagtaaaggtacttggttcaggtctcttaggcctccatcagtaaaacaggcatattaagactagctgtagaataatacttgcttgaaatactgtcattcagatttgcttcctacagttatccaagtcggaaaggaacaagcacaatagccccttttttcatataaagttattatagtatattacctgaattattttataaagggtagtttgtaactgatactaaataactcaaaagttaattcagccctcttcataaaatgatactgctatgaattggaaaatatacatataaatgttcattaaaagattaaattggctgccaaaaatcacacatcattattttacatatttagacggaatttttttcatgctactgtaattattttggtagttgaaaatctaattttacctgtatactaaatgactgcttaatcatagtgagcagagatctttatcctattcatcttgatatcctcaatgcaaaaaagaaacttcacatatatttaactctcaataaatagagtagtataatgaatataatactctatttttgaagaaagtaattatactaagtatagaaaaaatctttatgaaactttgctattagccacaaaaagacagaaaacttacttagaattcatagtaaaggtctcaaatatgcttccaatcacactgaaaatatctggtcttgtgtacctcaaatttatctggttgttgcacagttctcatttaaagcttataaaagcactgttaatttacatttgtggcttaaagtttacaagcagtataattctgaatttctaagtgaatcctaaaggaaaacactttactgcctacctcttttgttgatgtggaaatgaccttcagatatctaaattcaataagagaatagactttacacccgaagaaacattggttaagctgctaaaagagaagaaatgaattatttccatctgaaagtttataggtttgaaagcaacagagctttcctctatcttcaacagcagtttgttcattaattagcccttcaattccacttcaattaaattaactctaattaataagttcattacaaagattgacgcaccttgctcaaagctagtgtgctaaatgctgataaacaccatcaccctaatgaaaaattgattagattgaataaaaagggtacctcagaaagaaccctctcacttctggagctgggttgatgttatgttgctctgaagttaatcaaactatcttgaatctcttaatcaaaagtttaattcaaaggagatagaaaatattgcatgaaaaaacctgcgtgctaccctcttccagttaatagtcctgggtgttgtttataaaaaatattacaactctcgtagtgccttgataaggtgtttagcctgtgagatagagaatcacgtgtctgagaaatgttacctggggaatgaatagggaaaacagaacatgtgactacataaacagctactattttttaatcaaaaaaaggttttagtacattttctgtttgttagaaatgattttaggtttttattgttcagtgctttatttttgtaagaaaaccaaaactaatcaatagtcttagaattttaggggaaaaaactatagctaactttaatcttatatgtaaaaatgaaataaccttcaaagtttcttttacctttgcctctccctgtctctcaattggaactagttaaataaagcttttaagaaagcttaaaattttttttcttacacatctgaattctttttaaagacctaacctggtattaaaacatttgaattcatttggtcacttgtgctcttttcagtaattctaggaattgaaaaaccttgtttttcaaaggagagtcaattatatgtattattaaactggttttgtactgtggactaagaaatttgtatctgtcaactgtacaaatttactgaataggaaaaacagtttctttttacatgcatgtctgtgtcagaagcaagctaatttacttaagtagattcctcttagtgaaagtttctgaatatttaaaacatttaaatgtggcattagaaacaaccccatttcaaattcttgccatatgtatgaaatccaagtcctgttagatacctgagatgctgaaatatttcattaatttggggatgggggtgtggggacatgttttcttggtgataggtgtatataaatatgaccaccctctatatatgtaatgttttctatataaagtattgtatatgtaaagaaattatttctaacaattgtcatgtgtattttctgcatgattagagcagcatgtaaaattaaatgatgaataaagacgtagagttccaccattgatcatttcctagtagtcagtgctgaaatttacgtagcatacaaatacttttgatttcttttggatgattttgtgtttcccttgaacaaatttgtgtggaagataaaagctgcttattaattccccttctctctcccgccactcttctctcctgttttgtgtcctcttcctcccacatagaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcggtaggcttactgcaagtctgtgtctgtccccttcctcccagagaagagcaccgacggtcagctgttttcaacttggaaaaagcctatttctttacgttattttttacttgtctttcttaacacgaaattattttttaaatatggttgtcattttataatggcaattcagttctttttagaacagctgtcacaagtatgagctataaacttttttattcattggtttttgggacggccacaaaaatggactcacataaaacagacttaatgatttgtttatgtgaagttttatcgaatattacttcttgatgttccatattgtcattgcatttcttaatagcagattttccactttagaaaaaaatgctttaaatttttttcaaatatatgcccttgttggcctctgtagtttccagaatcacatagcttagacttgtccatatcttgagtctctgcaaaagaggtttgacttattatgacttcattttgtggtatcatgagaaataaagtagaatcaaatgtacaaatctcgctgctcttaaacaaacctgtatggttaacactttttcatatatgatgacatttgtgaacatctgtaggttaaataaaaccatcagatagatgtttcagatcaaaacattagtatataaacaatatttagcatagatacaaaagtatccaaaacatatatatcatgttttcaagatacttagtgtctttgcttttaccatttgtcactaaaattaaaatgtttaattttaaaagtacaacaaaagtaagtaataaatttctatatcacttcagtgaaagtacacagtattaattataagtggcacggtcctaccaaaatttcagaatttgtggtatagtatttctccacattgttttacatccctagggtgaaatttgataaatctgttgtggggagtgtcagtgtcttttaaagatttcttcttccgatgtatccgtaagtattatgtacttcgcttttttgctcacaggatttggttagccgggaactttgtcatgggaaaattgaaatcatatgtgtcttataaattgtcacaagtgtgtcattatacacttcatgtaagtttttttctaatcttactgacatccttgacatctgtttcaagggtcccaccacgcccccacgctggtgatcttcaagaagaactcaggacccagaggtagttgtgtcatggctataatgtatcacaaccagaaagaaaaaagacacatccggcagagtctgcagaaatccatgcacaggcttcctatcttccttctctcccactaggagaggtcatgtgtagcatgctccttttcccagcagcgaaacgaatcgacatatttgcagtatttctgcccagggaagcctgttcgagacttagagcaaacttgtcaaacctgaggcctgtgggccgtatgcggcccaggacagctttgaatgaggcccaacacaaattcataaactttcttaaaacatgatgagtttttcctgcaattttttagctcatcagctattgttagtgttaatgtatgttttgtgtggtccaagacaatttttattcttccagtgtggcccagagaagcctaaagatggactttcctgacttagagtctaagatttttattggggcttctccaggaggtatcctctgtctgccacaaccaccaaaattccaactctcctaagaagagtaggtgtggacaaaataaccttatcagtgtagggaacatccaaatttccagatgccagccaagggccagcccgccaaaatcctgcagatcaggcccactgttagctcttacttgcacagcatccttggagcttcgcttgttgcattggagcttcccgcctgaaatcaacaacaggtgcccacagtcatagcgcttgcacagggctcgtccccactgatgtggctttcccctcccaaagaggctttgtagggcagtggcagcaggttgttcatgtgaactacattaaggcagaagaaagttgatgagcaggatttgtgtatctttttgtggccatacaagggacaatgcaatacctctataaccaaacagctccatgccccaggtcccagaatgcctatataccagaggcagggcaggaaaactatacctctgatcacattccctcattctttgtgactccaccacccgatacccgatacatcagaagaaatgagttgagtctagctgagggagaaaagttatgatctgactgtatgtatcttaggaagtacaacaaacacgtgtgtatagctttgaaaaccaggaagtgtgccaaaaagttatccataggcggatttaacttaccaaccaatagttattcaacaaatcattttagtgttgttctcagtggccttggtattattacatggataatagtttcccatagatgagctgttcttgaacaaatttctagttgtttaggaacaaacaggatttttattagcagtgggtctttgtattataatttaataaaccctgcaatagttcttaacaattccatttcctatcattttaatttattctgttgcttttatactccatatgaataacattgtgggaaataagggacctgcttcatttacaaataaatcttagatgtgaaccttttaaaagatgtagagcacctttaaagcattctgctcttttatactaataagatgagttatttccaattttggcatacaaagatccaattgcctttcccctgtttccttactacctgtgtatatgcccaccatagtttcctggttagggcccttagtggccctacggggccatttgtgagccacagattaaacacccaggaaactctggtgtgttttctcacttgggatggttactgttcttgcatttcctccccattttaacccctacgcatctggctgaaagaagctgccacttggtgaaagaatgctcataaatcagccagatttttttctttctccatattatgtgccatctcattgaataccaaacaggaaggttaattgaaagagaaatggaggagaaagtaaacagaagcaaacaaaaattcccactagaaagcaaaggacattcttcattagtcatcctactgtcttcataaactctgtctatgctttcataaaaccataggcattttgatagtaaaataggttatgaatttggagtgttcactgaacaccctgtctacctgaaagggttctattctgatatttttattagagtattcatattttcctctcattatgaatcatgtgttcagcaaattaggcatattcgtctgcaggttcatcatcccaagtcctcctttcttgggtttccctttgattggtgatgcatgcagatggaaaatgaaacaaggagaaatctacttttagcaatattgtgattaaaatagatacttctcctttcctccccagaaagcattcatgattattagaccctttaataaataaagaaaaagagaagttacatgattaaaccacatcaaataagcaccagtacttactgctaaaatgatttaacagtaatagcaccgatatagatgctccactacaaaaatactctcttttatatgtgaccattccatataagcttcaaaggattatactcatgtgctgccactgtttttcatgggtaggaaatatgtaaaaatatttagaggattcagagacaagttaaaaataaatataatgaaatgttttttaaataatagttgacataataagaatattatctggctatctctatgtaaaaaagcttcaacagttctgtcatctgagagttgaggtaggtcagagaaattgggcttcttcttgcttagaaaaagagggaaaatctcctatgggactgtcctgtggatgcagttagttggccatagatgcaatgcaaatgcagtggtaggctctgctgaacagatggttataggcagagtcaatcacttttaagtgtaatacgaagtaaataacctggacaatgataaatactaagtaccaaatttttactactgctaacctatcacttccacaagaaccattctttttagtatttgttgaagaggtttaccccagaattcattcatttgtatcccagagaattggaggctgtaagtgagattgagaccatagcagggtaatgattgaataacatatttgattgttatctactatggagggttgttgtgaaggaaaagaagactcagctctctgtagacaggcaagttgtcttctggaggctgattggcattttccatttatccaggagacagaaatggagaatatgggtttacaatgtataaatgtttgttagatataatgaagaagctcgagtcagaaagcatatttaaatcctggaacaagctactcaagaaattttggaacctcccaagtaatcgtagtattgttaaagtttaatactatgattacttaggtgtgaaacactggaggtttcgtcagttctttttgttagcttaaggagtatttttagaatgggagttttttttttaacttctctccatccgttatcctaaaagatcaagtctcttgtgtagtagccctatttgaaggacccctcaaggtctcttgcagttctaggattttttcgctgttgataatttctgctttatttggaaaactactagatttaaacatggggttctctttttatctctatgtcatttaactttttgtttttcctatggcattgaaacatagtgagaaaccatcttcactttttcagatcatttggggtttgttttgtgggatgctctactttgcatgcctcacttactttttatttgttaattaattcatttatgtgtccagtaagcaattattgaacatctcttctgtgatactgagaacaatttcttacaaaagtcagtgtaagataataaaaaaggtatgggctttgacattttaaataaaatgtttttaggtcagttttacaatttattcactataactggtatcttttttttcttcttttttttttctttcgagatagaatctcactctgtcgcccaggctggagtgcaatggctcaatctcgggtcactgcaaactccacctcctgggttcaagtgattctcctgcctcagcctcccaagtagctggggttacaggcgcccaccaccacacccagctaacttttttaattttttagtagagatggggtttcaccgcgttggccaggctggtgtcgaattcctgacctcaggtgatccactgcgcccgtcctttagcttttatcttaactgttcttagcctcagttgggttttttcgcaatgtaaaatggctataatagtacatatatgagattttgaagcagaataatgtttaagagctttgggaattgaaattcttgccgtaccactgagtgaccttgggcaagtcatttaacctgttttatatgaaatgtgaatattatgtacttcatgggattattagaattaaatggaatactagaatgtaaagcatttagcaaataatgttcaataaattcaagttttaattttgttattaagtgtaaatgagacaaagtacaacccagaaaatgttttgggtgccaacattcaaaaacaagaacaacagaacaaaactcctgtccaggacatttactttaaagagttaatgacatttgcattttattattataaaatataatctagtctcataatggatattgtttaacaagaaatttgtatgtttgggttaagggtttgagggttggttttatttttttttaattttcatttatttttttatttttgagacagggtctcactcagttgcccaggctggactgcggtgatacggtcacggctcactgcagcctctgcctcctgagcccaagtgatcctcccacgtcagcctcccgaatagctgggacctcaggagtgtgccaccacacctggctcattttttgtatttttgtggagaaggggtttcttcatgttgcccaggcgggctggtctcacactccaggacgcaagcaatccacctgcctcagcctcccaaggtgctgggattataagcatgagccaccgcacccagccgagagttgttttttaaaatcgtgatgatgaaagaaaggtggaggatattgatgtatttttcttctagtaatgtctcaaacacagagttgtatattgagctacattgattttcatgtacttttaggcagttcacttggaaatttggcctaggggaaatcctaattcctttaaactacaaaagagcagctatttgtttttattctaattcttagtacattaggaaacaagatcattaatgatcacaaagacatgctttgtttgctcagacaaaactcacacatgcagtactcagcatcctctgttaaacaccagggctgcccttgggctttgggatgccgaaggttagaaattgagaatgaaatgcacacagctggggaggtatttcggaaacaagatggggtggaaagagagaaagagcaaaacttttactgatacagacaagcttaggcttggtgttctaattcttatctcagataatggtgaaagaatagtactttaattgttaaattaaaaagtaagtgacaaatttgaaaataaaatgaccactctgataagtgcttcacttaaattacaaaactcaatattctttgcaacttttgtagtgtttcccagattgagcatcatatccaaaataaaacaatatgtaattctaaaaatatctttttagattttaagtcacattttgtttataatttccaataacagtggatatggggcaccacatcatacccacaaatagctgttctgggaggcatttggcttcacatcagtcagtggttggtagtggtgatgaaaggcaaccttgcgccaaactaccagcgtccctgaccttgccagagacaggtttactgtgaagctggtgtagcataaatgtcagggtccttcatttgcactggcacctcctaagatcccacaagggaacacccatgggttcaggtgtcgtatgttaatataaaacttgcaaatcagctgacttctgacccttcacactccaacatcctctccaccacacttttccttgtgcagggtggcattggggtggctgtgggcattttgagaattccgataaggagaatttgatctgggggtacatttagtttagatttaatgggatatgcatatgaggtgtgaaatcacttctctctgtggctgttactgctagccacctaggaatcttcctacctcccactgactcacctagtgacacgaaagtacagggtcagggagttactagatgaagatacgactttgtcctgtggagctctgcaccagaagcaagtaggtattggaggagaagtaaggtttgaaatgtatggaaacagaagctagtctggaaaattcctcatgtcatcaaatacctaaaatgcctaattaaaacagaagttttctcccaccaggcatgtacttgataatagaatttatataattataaacatgccatagctttttcttttagatgaatatttctcctttgagtatttatcagaattcctgtgtttgtagggtataagtctgtagcagtactgcagatactgagttcaacagtgtgtgaaatcacatgtgttactcatcccagtgtatcactgaatcacatgagtgcaccagaaaaagtcttgtttatgtgacgtcaaatactgacattgcaaatttaacataaaactcaaaatagtctactctacagacatcacaacaaaatagttaatgagtattatcaactcagcatatttaagatcagtttattacacaataaaaaaaaagtctttccaaacttgacagtaacggcacaaatttacatgacactaccaataacaaattttgaaggcaaatgaactactgttgatagttttatcaataatgaaaagtaaactatcgcatagaatatagactcaattatctctctatactctctatagaaaatattacaaaaatcgttgtcatataaagaggcaatcaaagagtaattatagcccaaaaatataggaaaaatgttcattagagacatggcaagcactgaataaaaaatggatatggggccgggcacagtggctcatgcctgtaatcccagcactttgggaggccaaggcgggtagatcacgaggtcaggagatcgggaccatcctgaccaacatggtgaatccccatctctactaaaaatacaaaaattagctggatgtggtggtgcacgcctgtaatcccagctacttgggaggctgaggcaggagaatcgcttgaaccagggagtcagaggttgcagtgagctgagattgtgccactgcactccagcctggtgacagagcgagacttcatctcaaaaaaaaaaacaaaaatgcatatgacttctctcatgtttgtggtattaactgaaaaataaatgttttgttgcggtttttctcattctaaatacttttatacctgatttcatttttatattttgatattctttttcttaaagagggcctcccaaattatgtaaatttcagacccataaaccctggatttccccctggttccagctctgtcacttcatatctgtatgatcttgggaaattacttaagccccctgtgcctcagtttactcatctataaagtgggaatgaaaatagtaactacctcgtagagtccctgagagtattaaatgggtcaggtcatgtggaagagcacttagcacagtgcctggcacacagtaaacaccctatagatgtttcttgttgttgttgttgctggtcgttggactgaaattcataacaaactgactgtgactaattcctccctgctaaatcttgtctctaggcagaggaattagcctcggctaattcttccagaaaaaacaggagtgcatgctggatacaaggagagctaatcccctctgcctcctggcacatgaatagtctggacatagatgcctcatgatctgtcattcacagtggaaagtgggtcgccaaggaggcagcaggcgtggagttgagggggagattctcctaaactgacctgattggcgctgaaaatctaggggaaattctcctaaattgacaggctgaaaaaccttctgtgaagcttgcagaacgagaacttcttgaggtccctcctgctctgcaagtcccagtgattctcagtaataagaaatttgatggacagaggggatagagatccctgagagagtcatggaaagcccccttcagaactcgggagtatcacccatgttctgagaaccgggctgatttcggtgtctgtttcttccattgagatgacagtatccactggcagctatccactgggggccttccaatactgtttttctcattttagtctagtttcttcagttaacagttttataaacactactttagcctctgtaatcccctcagacttgtaatttttaaaagaagaggtcacttaatctcttttctacaaatgcaaacctggttcctctgacctttctaaaaggtggaggccctgtttggttgtcagtattctctactgtttcaatatttttaaaactactacaaagataatgtttattttgatgttgtaatctatgttgatgttgcagtttgtctgtccttcaaattcttctttcgtatttgcttgtctttacatacaccaatttcatcaaaaaaaggacatggagccttgggttccgcttccttgcagccagcattgagagcaatggcagatctgcactctgagccaaattcgtctttcgctcagtgttccacagcctgttgagtgagagagtaatcaaccaccaaaaacaaatttagtggcctaaatttgaaactttagtaagtttgactctgtgtttctatcatagtttagccttaaatactacctgccaagggtttatgaaatcattccatttctactgttacaatctgtatactataaagccccaaaggtggtagtaatttggactcttctaccaacctctggtgaagtgtgttacagatttaaccttgtagtgtccctccttccttatctccttcaccttcccgtgtgagtcatacgatgacgtctccaaaagtcccattagaattacaactgcaactcagtttacagattacatcctcaaaaaagtaggtgagactcctcactgacttctgcacctgacttgctgtgtaaccgtcaggaaaagtcacagtcccgagggccatgtggatacacgttctccagtcatgttggtgatttattttccactaaagaatttcccaaggcctcggtttctgtcccttagaatgggagtaagtgtggggataaacagctctcactattgacatcaggccttgagttccctctttctccaccctatccttcatgccgtaatttatcctcatgaaaaagacaggcagcagcatagtcatcagctagagctgcgtggtttcatatcagacggcagtgccagtgctactgagaggtaaatttctaggacaggtgtgttgttttgggaaacgttagatgtgttttttccatactttagaaaaggaacattttttgaggccttctgagactcaattctgagtgtaaataattgcttggtgggtgaatacatctggatttaacatacgtttttccactgaagtgatttacacatagctgtgaggatgagaagttagaattcttgaaaagaaatacgcttcacatactcttcacgtccttgtttagggtcatatgataaatgaattctatactgtggtgtttacttgtgcaggaatttctttccggtctacctcctgtggtctaacttgagtcccaatagctattgctaaattaagctttctcctacaaggcccactggaaggcgggcccactggcattagaagcagctgtttcagaaagaatggagagttaaacctgttgtgatttttctcaactgggagcaatacataagcaacttgaggatttgtattgttttttgataagttagatgtcattgaaatatgcctgattcctttaggcttggcaaacccgattccttcctttcccaggacctcgtgtttgtttcccactgtgaaattaatggtttgctaactagttcttttaagtctcaaaacagtttactgtgtagtggctctgtgtcttagggaaacaatttataaattataattattatctcaaggaaatttttgaatccattaattttaattacagttatatgccaggccagaaatttaaaatatgaatatagccatgtattcatgcctgtggtttccatttttctttctgaaaccgcatgcctcatgttaagccaatataagttgttttttaaaaagtttattgagagacatgttatctgaataaaagccgagtaagtgatatgtcaaattcatatgatactgtttcattacaaacttgacattttgttcctttactaatatactagaggatcttttttccatttggaacacctcattaatttgtatcttttaaaaaccatctaagatctaaattaccaccgaaaccgagtatattggaggttttaaagctcagttgactggatatacaatttaaccagaaataaagatagaaaatgctccttctgcttgccaagttcatcagaagccttttattgaaaagtttagatccaaggcatttaagagtgaaaccagctgcagaataatatgttgtcagctatttcacaatatcagcaaggaagagaaagattctctcgagttccagattataaggatgccacatgcttcccaaaagtaagccaggtaactggagagtgaaaggcagctagtgaggtgtttatgaggctttgaagtaatattccttatatgctgagatccttattacctaatggggtaaataaaatgttgggacttttcattcagtttaatgtaagggtagagaaattaagcccacaattttaagaagtatgattatcccttcccacatggtatgttgttatcttttcaatggcagaatttatctttgccatttcttgaatatgacaagttgaaaatagcctcttttcattttaaaacagtccctctcccacctccctattttaaagtgcaagtttggttgtggtgtctgtccatacggaagcacagccttccagcagccttcgtatttaacatattcgcagattatggtgtgactggagccaatttttgtctgttgctcttcatgataagttcagtgaccctctcttttttgagtgcctctttaatgaagctggaacccagctgtctgaaatatgactatcatttctgggatttaacaggcatgtaccttggataaattaaggagcagtcaaaggaggtccataaatttgaatactttgccagctgcttttccattaaactctgttggttgaatgaaattagtaaataattatgttggtggggaatctactacatctaaatgtgatataatgtcttcctttaacaacagagcttaatttttcttatatactaaattagtttttagggtaatctacattgcaaattggtcaatttgcatcaaaactatgcctagttgttctgatttgtcaacacctctttttaaaaaagtctttaactttaagcatgggtgggtaagaccatctgcttgtagagctcgcctgcagctccaccacttagtgcacgagacaggttacagctgcttaattgttatggtgttgaatgattaccattctgtccaaaattaatatttatatatgtgtccacagaaagcatgtggttaaacataagcaatctaattgtgaattaatgacataaggtattcattaatgagtccccacctgaacaataaggggtaaaataatgcttttcacatacagtccaactcttgacttttttttttttttttttttttttttttgagacagagtcttgctctgttgcccaggctggagagcagtggcacgatctcggctcactgcaagctccgcctcctgggttcaagcaattctcctgcctcagcctcccgagtagctgggactacaggcgcccacaaccacacctggctaattttttgtatttttagtagagacgaggtttcctcgtgttagccaggatggtctcaagctcctgacctcgtgatccgcccacctcggcctcccaatatgctgggattacaggcgtgagccactgcacctggccccaactcttgacttttaagatgagtccccagtagtgattatgtatgtgagtaatccactgcaatacattggtatagataaggaaaaaaatcaccatgtagctgccatgaaaagcaaagaggaaactatgtggttatttcacttactctaactcttccctgcccctacaagcgttgtcctctgaattgtgaccagtgtaagaacaaaccgcatagcaaaagtctagatatgcaattatgactacatgtttgtgtgccacccacagctactagaaaggattgtctcagccaagggtggccttcctcctgtatttaagaatggtgacatataaacttacaccattctgctatgaaaagttagcaatatatatcctgtctgctcagtatatttcataatgaaaaatctttagcaaactcacaatgtaaggatagggatatgcatgtaaaatataatatttgaatgtcttagtttccaaatagttactgtaaatacatgacttgtatttctgaatttgagtggactatatgaatatttgtgtgagtatctacacttttttagaaaagattaatttatcttgctcaaataaaattactagtgaaggagcagaaaatatataagggcaagttgtgatgtgttctttattccaaaaagctgaaccccatgttgaccaggaattgtgcatctaaccagcagagggtttgtgagagacaaggaagaaaacttcctgattccaaaatggagttgtccctaccctgggaacaggccagttcatataaagaatgttctcagcaaaaggagggcagcttggggaggcagagtacaaggggcttctcctgctggtatggagcagaatggaccctggggcttatgaaaccaaatcattgccaatcccacatttctttcctcaaagtcagactttttcttttcttcatagtcacttaaaaaataccagctccctcatgagtttgtcctttttaaactctccctattaataagatgaatcaataatatttaatatgtattgagcatttactacttgctaaggcccaatgcaaactgttctacattaattatcatgtttaattctcaggtagaagctagtaaaatctccactgaagaaactgaggctccaaaaggttatgtaagttttctgtggacgcacagctagtaagcaacaaaatcagaaccatgtgagcgatttccaagcccacgctcttttttttttttttctttttttgagacggcgtctggctctgtcgcccaggctggagtgcagtggtgcgatctcggctcactgcaagctccacctcccgggtgcagccattctcctgcctcagcctcccacatagctgggactacaggcgcccaccaccatgcccggctaattttttgtatttttagtagagacggggtttcaccatgttagccaggatggtctcgatctcctgacctcgtgatctgcccgcctcagcctcccaaagtgctgggattacaggcgtgagccaccgcgcctggcccaagcccatgttcttaagccctagatagactgtcctgcctcctgaattatttttcaattgttcttgtgtgtatgtgtatagtggaatagatgaaaattaatttttatgtgttgaaaataaattaatgtatatgtccctgtcacaaaagattgaattgtcatagaaacagatgcaaaaacaataatgccggtgatgtcttagtaaagtaccacacttttttatccaggaaatgttaaatgatagctgataacagaacttgtaatttgccaaaataaaaaataacaattacaacaacaaaaaatggtttgaggaaaatcagtttatactgtggaggatttaagaacattgggagctattgaacactctacccacttcctttcaaaatttaaattaatgtcctgttttcctgtcactggaagttagtgggctggaatctatgtagacattagccaatggaaaactctcatagaaagtgggtagattatttgtgtcaccagcatcagctcatgagaaaaggctgagaaaagtgtatacaagtggtaaacatctttgcatactctcacctacaaatacagcaaaattactttctatatcaatcacctttgagaacagccatttgtttactattttcataaaataaatcataatgtatcctaggtaagttaaaaggattgttcagttttgtttattattttccagttatggtcaagaaaactgacatgagaaagacccattatatttttcatacgtaaaagtgttagtctatacatttttcttaaatattaaatgttgtgaatagacaaaagtggcaattacagacaaaaaattctacccattgatattgcccagatctctggatgattgttctggcttcctgtgattggatttattagcactatccagacaccactgtaatcactgttataaccaacttcatttttcctaaatcttaaatagccaaatattcacctagtataaaacattgtattatagttttttttaattaatgttaagagctgtctctgactagtttcattaccaaattggagtactaaaatataccttttttttttaatctaggaaatcctaaaatgtgttttttgcttgtgtcattcaataaactcacacaaggaataaaaaataagggagatgtgttactaacacgtgtatgtttatggttcagtggatgaaatcatcccacatgcaaaggctaccacaaaactcatacatcacacaccacacaaggcatctctttgcataggctatgcacatcccaacatcagtgagcctgccttctgcaccttgagtgttccactgttacttccattatgtgtatgtagtccatggtcaggcatgaaatcctaaattgaaggaaaataccaaattctgttctaccagtcatctctacaaagctctgcagcttataaaggcactctttcagcagtgctgactttataaaatgtgatttatctcaaagcagctcttccatagaatctggatttttctgggctgacttaaatcaggaaaaatattatttctctcgtttggaatgccttggtataaataccgttccaagttgaagtatggtattttgcttgggtaggtgcatgtaagaggcaatgtagttattcagataatttttacaccaagtttccaaactgtaaaaagaataaaatatgtaaactttcaaaagcagtttatttgaagcaaatttttgaaaaagtattgccaattgtaggggagcagatccctttaaagcacgtgtgcacacatgcatacacacaaacttttttttttttttttttttgctgacaccacctcacttactagttggtaaaatgcaaattaattgactttcctaaataggaaagaatttttttgatgtttgtccataatctgataattctgtggtgaaagagaacatattttaaggagtcttgagtaaactcttaagaatatgtaattgttttatggtgtttaaaattatgtcactgtcataatcctttatggtatggtaatcagtaataaaacattgcagtgagcagcagttaaggaacatcaaatcaatgggtgtgcaccttgcacgctgatttaaacagttgctgattggaataagtggatttaatatgtacgtatttgtagactgtagcttttctgtcatcctgcaggaattggtacttgactaatctgagaatgatacctacttacaactttaatgaggtactaatgtgagtcattttttaagtccgtgttcggaagtattatgaaatgctcaatgctaactaaaaatctgccctctactccaaggacttcacagtaattatcatagtgaagaatatgtctgtattttatgatgtacgtatctgatgtctacactataccgaggattcaagccagtagcccggtgaaaatattatacggtactatttaatatgcctccaccaagcgcattgttgacagcggaaacaatgtgagttgttcatagccatacacatcagcaactgcttatatacagtgaaaccgacttgaccttcccttgtgagctacctgacgtctatataacccgcttggtttgcctttgttgcttctctgtgtttatgagagtcagcctgatggcaaaaggaagcaaacttggaattaaccttgttccatgtctcagccggacaggaacatatactccttagacctcatttttaaatgagctgccttcttgggaactactactcagcagatatttctcgtccaacatttgtacatccattcaactgcttctggtctttgaggctttttggtttctggttttttcaacttacttgtttttatttttcctggttttatccctagttctactatcttgcccactggttttccaaacttcggattttttagaacagatgacagcattaaagctttctttagtttatataaggtactgtcatttatgaagcggtgtcatcagataaacattttaaattcattcgggttttaagcttatttcctttaactgtcagtgttggaactaaggatttccacgttgtttagtctgattttttttattccagtaaattccttgggaaatctataaacagatgatgcttctagttcgccttacacaggtacacagttctggttcttctgagttgtaactataacgtttatttagaatatggattttggtgtcagactgcctggttggaactttgtctttgccactgctagcattttgatcttaggaaacttctctaatttcttgtgcctcagttgcctcatttgtgaaataagggaagataataatgtacctgttaccccacagggtggtgaaaattaaaccggttaattcacattaaatgcttaggagttttcagcacataataaatggtagttattgcgaataccactgtccatagttagaatacatgggaggggagaggaacagatgggtgaaggacaggggaaggatgttgtaaataaggttttgctcacttttgcttctttctcaaaagatggcctctgtattacttatagaatttcttcaaaagctgcagacacatagaggacatactaaggccaccaaaagtacatttggtcattttatatggtcattttatctgctttaatataaagcagatattaacactctgctttagccaggcacagtgactcatgcccgtaatcctagcagttgggaggctgaggcagttggatcaccttaggtcaggagttcaagacaagcctgagcaacagggtgaaactccgtctctacaaaaattagccaggtatggttggggtgcgcctgtagtcccagctacttgggaggccgaggtgggaggatcacccaagcccgggaagttgaggctgcagtgagccaagctgtgattgcaccagcgcactccagcctgggtgacagagtgagaccctgtatccaaaaaaaaaaaaacaaaaagactctgctatgagccaggcagtgggaatgcagtgatttacgtggcctagagtttacctctctaatggggacgatttacacattaagtcacctatgcctagaaaggtcattaaagtctagtattttcatggcatctgttagtagaagtgaattcatcacggccaattcttgattgttctcttttcctgttacatgcactttgatgtgcatactcctagaccttatccaagagaggtgctggggtagagggaagaaaaaggaagaataagataacagaagagatggaggggcgcccagaatgttgatagataagcagatgaggcaacagcatgaagatagaattccaaaaagatgctattccttcctgatctgtatgggaggaatgaagcatacaatactatatatgagtgaggcccatcctcagagacctgagagtccaggtccatcactaaggggtgcagaaaagagcaaattatcttgtgtcctcctccacctatctttcccaaaatacaaaggaggaaatatggcaattaggggctttacaaaaaaaaggaattcttaaaaagaagcacctagaggggagatgtgtgaaaagaatacaggagtagtcatttgctttgttgatattgaaaatttatggactaaatatataatataaacattttcgatgagccacatttgtctttcacattcaaaacttccatgagtctttgcctacctgtaccagcaagtagaccaaggacccgcaggtcataggcttgaaacccgaatacttgcctcatttgttatgttccagggatggctgtgtatctgaatgtattttgaaaaacagttaaggccaagaattagccttggcatttagagtaatctgtagatctgccttgtgctttcctacggaatccatgtagaagccatgtaaaagaaggtggaactgcctggtggctttggagaacgaagtgtctggttctgagctcctttcatcagttttttctactggggggaaaaaacacctttttttttttctttttttttctaaatctccaagagacgacattgtgatagagtggtttagagcaagctctggagccaggcagcctaggttgccaaggtgttaccttgcccaagttaatcactcctctcctctgtttcctcatctgtatttactgtctcaactgttattacatcatagggttgtggtgaagatgaaatgagagaataatatatgcacttagaacagtatttggcacaaaggaagcctttattattacctacagcgagcagggctggcggcaaagtgcttcgtgtgtgtccctggatcattctgaacctggtcagagctacgagatagaggcctgggccagagctagaaatttaggaatcattaatacatcagccaggtgttcataatctgtacattacagagccagggctcatggaagagctaaaatcaaggcggcattttgtgtttgtgaacatatgtgaatttttctgggaagagaacccaaaactttcaccagtttactcaaagatctgagacctggcggggcgtggtggctcacgcctgtaatcccagcactttgggaggccgaggagggtggatcatgaggtcaggagatcgagaccatcctggctaacacggtgaaaccccacctctactaaaaatacaaaaattagccaggtgtggtggcgggcgcctgtagtcccagctactcaggaggctgaggcaggagaatggcgtgaacccgggaggcggagcttgcagtgagcggagatcgcgccactgtactccagcctgggcgacagagcgagactccgtctcaaaaaaaaaaaaaaaaagatgtgagacccagaaaagagtaagacttgccatctcacaggaaatatggtcctactcatgccgtgtgtcccacgtgggtgttcttccaaggtaaataattgaaactccagggaaagtattttatgactgcaacattttactagaaagcagtgggtttttttttgttttttgtggttttttattttgagacagagtctcactttgtttcccaggctggagtgcagtagtgcaatctcacctcactgcaacctctgcctaacaggttcaagcaattctcctgcctcagcctcccaagtagctgggactacaggcacgcaccaccacaccccgctaatttttgtatttttggtagagtcggggtttcaccatgttggccaggatggtctcgaactcctgacctcaagtgatcctcctgcctcagcctcccaaagtgcaaagattacaagcataagccaccgcatccagctctggaaaatagtttttttaatggttcccattttatatgtctagcacccatttttgtaagagttttatcgtataaaacaaatttcaacttcttagtagattgaaggaatgacttttctctagtgtcagaacatactcgttagttttcaaagtaattttttgcaacctaatatgcatttcagcaattgttaggtacattaatttttaaatatgctgaattgtttttatgattattatttctaatggcttcttacaaaatgtctgcatttttttatttcctattgtggtttatataatgatgtttatattgttgcaattattacttttaataattatttgaacctcatatattgacatctccttttaacttcttcattatttagaaccaggtttttgtggtatttcagaaagttttttcttccataccaaaatatttcttgttgttcttccttcttttgctcttagttttaagctctcaggctcacagttctctatgatataaaatgcaaatgaagaatcgtggtatctttctcagtacagatatttttcttacggttggtttttagccttttgcaaaacttgtgttaagagttgcaaatattttaagtattatgttaattttgaccggctatatattttaaatgtattttctactttgctttctacttctgatgttctggtgacccaaagacctacctttacctgtaaatcaatctacagctttgcataattgattctgttggcaaaaataatctgattggctgattagaaataattttgtccacccttaaaactgctaatccagatcagaattaagttgtgttatttattttggttgtgcaggcctaacgtaaaagcaaaaggtttactctctaacagtgatcagcgttattaatttttgtaaactaagaatttctgtagaaatactaccctatgagaatcagaaactccagaagtttcgatggcactttctttatgttcaaatcatcaattaagctgttacagggttctactagtttatatggcatgtaaagtatatagcatggagaaggaattataaagaaattatatgaatgttatgcagtaatacatttttattttaatgtttaaaaggtaaattatttttattattataatttcagagtagcacctaacaccatatgttcttcactgtaattttccttgcatcatcttatcaattagctgtaaacatgcttattttaaaatgccattcaaacgcctctaatagaatcctgtggcaaagtgaagaatccttttacatacacagtacagatgtatcaaaaccatgtactgttttgtttacacacatgacagaaccaccacacctgagtggcccaactgagggttacagtttcagtcattctgttaggagtcctcctaccacttgcatatgtcagcagtgaaaaataatcaacaaaagcatctttgaaaagcaattttagatcattaaagatgtatgaattttgacaaggcgggagatttgaggctgattaagatttattaggtctccacattgaaggaggcatttatgtctcatttccaggggaaaggcatagcctaattgtagcctcatgaaacaagtggacaggggcaggtacaggtacagaaaaagattcagtcttagtcctgactgttcctacacaccttttgtgagaaaaagagccttttccagtaggtttctgaaaataaacaggatcttagaatagtccctgtttcctaatgggctatatatgcgataaatcattgtctatctggcttgcagtcaagagatactgggtaatcgttttctaaagaacttacatgtgccttttccaaatataacatcaaaatattacatttgctcaacagtctccatttctttttcttctttttgcttatttattaacttttaaagtttcattatttgtagatctcatagttgtaaatttccaaagttctttaagaataaagaattgattccatttgttctgctcagctattataaaggagaatgttgaaatgacgagagtggagtgcattccaaataatctgtgaaaagtagtgttagttcagtgagttgaaaatgctgagtatttgctggaatcatgactacatttgctaaaaatgtgaatagactggatttttaggagatacgaagtgcatctctgtcatgtgatgtgagtcttatgtcagctgaagctactcaatttgcatgtagattctgaaaattttcttgtcccatgtgacacttctgaaatgtctgtctgttcttttttcctttttaatttcccaagctcactatttggataagatagttaaaggtactgtatactcgctctttgttgacatatctacatatatatctctatataactgtatatcactaggtttgacaatagacttttccatgcatatttttgtaaattataaatcagagttaaattatgtaaaatgccttggatttaaagtattgagacttaagtgtctgtgtctcatttttataattttgggttatcacagatttcattctttgtaaaagcgttagttttctctagaaccagaaactgaagataatggtacatttgctgttttttggttttggaggtttttttctttcttttcttttttttaagatcttcactgttggcaattcagcttaatgagctttaaattctaagctaaagaatcacaaatactcttatcacagaataagaaattgtcaatctaaagaagatcctggttaacatgttgagagaaatttcgtttatttcatatggaagcttctttggtttttttcctaaatgtttcaaaatatatgtggtatcacaatttgtgttttgttattttttaaaacctataaatactgtacagtctattaaaaaaagaactgataaccttgttcagcagaaaacagcagattctcacatcttcagttatcgtagaaatagatggaaaaagttttttcagaagagaaaattccccttccctttctcctcagattacctactttctattccttgtttgtgcttttcattagaatatgaaaatattcatggcaatatccaggctttcatataccaactcctacgtgcagtcagtcagctgccgcacctccttgtcagtggggcaattcaacctttcgttttcattaaaaaaaaaaaaaaaaaaacacatccataaggaagattcaccttttatttattgaataatccataaatacagacggtaattgtctgagcgaaaagaagcagcaaaattaatctcttcctgacctgatggtatccataagtgtaatttcattgtactcttccatgagagacagtcgaaatagtcttctttctgttaactctaatcttaagagacagaatgtctcttggcgatattttcttttcaagttccacagtggaggaggggacaccaatatatgaataattcttctaacacagacttaaacatctttaaaaacagattgttccctgaaattttgtcaccggagcaatagtagcattcaaatgataagaagctgtaaaacaaaccccaattgctatagcaagtatttttattaatatgttttataccaaattataaatagctctgtccacagaaatctgatgaatagccagttattcttagaattttagagcatttctctccttgcttctgtcagtgtcatatcacactcataaacaaggacaccagaatctacccaagtgtcatcctcataaacagatcacattggctgcatgccagatatcatcagtaggaagtggcaaaaattgttttttttaaatgtcatgttagactgaaacaattatagattttggatatattaaattattttaattgtttcccaaattttccctccttgcccataaaagcagacaagataggatataaaggtaacagcataaaagccttagggagattgtcacaaaatatcactcttcgctatctgtcttgaagcacgtcactaccgtgtttttgttcagtctatcaatgttttattgtggtccttatggtatttcattttgtccgtcctaagtaatccaatatgcacagctattacatttagttggaaatcctgtcggtcctgtcccatccgtatgcagcctgaatcctaatgtttgttagaatagatgctaagctgcttcactatttcctgggctttgcttattctgtgacaaggaatgtactcttggcataaagtatagtcattaatcctggcctatactttgtgcaattatttaatgcactgtaatttcacatgaatgtacggcaactccgaggccagataaaattaatgttctctttttgacatcattcatatcctcatacccactttcatgcttttggagtttgagggaatttttttaagcaacaaggtgctttaagaaggcatgtcttgataaatgaccagtaatgtttaaaacagattacaaatctagactagggattctgaaattattttgttgagatggcttttccacaccgtacaatataccttgttgcttggctaaagggaaaaaatttaagttaattttgtctggcctgcagctatttagtggatcgttgcatatatttctgtcctgcacaggtaagtggtgtctcaagggtcaggccaatcaaagatgccacttggataagaattagattccatagataacgttgctgtttctatccatgtgcaattacagtatttgtgctgtttataaaggcctgttcccactaagtgtcccttatctgtttattttaggtgcaaaaactcaatactcaaatcactggtgttttccttctttgtctcgacagagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggaggtaagaaatactgagcatgaacacgagtctgtgccagagcacaggttcgtaagtgacagtgagtacatagatatctgttgccaaaaaaaaaaaaaaaaaaaaaaaacctgatccccatcgattagattgattgaaaaatgtatgagtgctgatagaatgattttgctctccatttttcctgaaacaaatgcaagattattatcattcagggaaaaggcaaggtaaccaagctactgcataatgtccattgttctccattccttttcctggtccccaggtgactcttctcctcaaccacagtatttagggctctgtgaattgggagctccaaagcagtattttaataactgacattccaaaagatgcaaagaattttccagcctcttctgttgaaaggcatggatggaaaaaaacaaaacagtaacagagaacagtcccctggatgctgtactctagtgacgttttatccttaacttgatactcggttaaaaagatggtgagattccacccagttgaagcccttggttaagaataattattttcaccgttgacctcagcctccatgtactgtattttaatttcagggaatagagtgagagttggtgatttcctctccagtgatggaatagttggccctgatagctgttttgttttgttttttgttttttgagatagagtttcgctcttgttgcccaggctggagtgcaatggcacgatctcagctcaccgcagcctccacctcccgggttcaagtgattctcctgcctcagcctcccgagtagctgggattacaggcatgtgccaccacacctggctaattttgtatttttaggagagacagggtttctccatgttggtcaggctggtcccaaactcccgacctcaggtgatccgcccacctcggcctccaaagtgctgggattacaggcgtgagccaccgcacccagccagctgttcagttttgacatagctttagcgctgcatttttaggagggctgtagttcctatccgggcctctgtggacacttgccacgtgtgttaggttgtgtttccctgccactccaccagccccaaccattctctctgctctttttgagactgtgcacatggatgataaagcactggctagagtgtaggttttggagcagacacatcttcactgaaccatgtagtaatcatgtgacctcagacaaaatctgtaatcactttaacctcaattgccgcatctataaaataggaataaaagagtttttgaaaggattaagtgagaagatgcatgtgaagtgtgtagcatattgccaggcacagagcctgctctaagtagcagctattattatccagtttcccttctttgctttcaaaagtgctcatcttgactaagtgaacttcatagaaggttgtcagagaagattgaatagcctttgcctttctatacctatagagggcctcaactactattctgtaggaaacagagcgaccagaaccaacccctcaacctcccttccaacccaaaacacacacactcacacacacacacagagacacacatacaagcaagcctgggccgacagtcattctcaaagcaaatgttacttgtgtcttatccttccgacaaggtgctgcaattctctcctttagtttctagcagactgttcactgttttctcttaacttggacagtcaagaaacttgagccacaaattctgagctaaagcctttccttcctgctccggatagatttaggtggcccgtagccttcacagcttttcctgcttaataataccttgttgcctctgactcctcttaactgtgtgctttatagacatggcagcattaatcctctcaaaaccacagtacagatggctcctctcttcgttactttcccccaaagaaccccctactccaatgttgctattgcctagggaggaaggagagcttctctttctccttgatcatatagttcagattttgcttctaagagaagattgcactgaggagtttacagagtctctcagagggaagcgggctgcaggaccaagtctgcagagacactgccgagtaatttaggggctaatcaactctttagtggtattatcagctaaagaggtttttccttttcctcaaaatttatcaactgtgaattggcctcattcccctttgtttattctgattagcatgaaactatgctatctctaggctcccctctcggaggggaaatctgagctgacagaagacctcctgtggattctctgcttatctcacataatttgtattcctgcctctaacctaattttgctgatcttttaagaaggaatctcagtgccagccttcttatgccctgagattgtaacctggatgctttataacctaagccagcgggttctttgaacttaagcataagctacatgtataaagatggtattttccacaccaaaccccaaatcaaaacacgaaagatggcaatgaaggatgtcaattatatgaagacagtcgaacagaatgtttaggaactataaatccactccttatttaggactagactggattttattagactgaaattctaggatatatggtgactgattgtagtgttatagatccattgtctaagtttagttatcaaaatggtgacttatccagagagtagctaagtaacttgatttagcatattaaggaactcaggaggaggagagggtgaagagcccaatgtggccctagtcagcaattgaacactcccaataaatagctactatagtttgagcaattttgtagaacacagtgtttgtaaaagaagagcaaaggaagttgcgtaccattcccggaactaaagaagtatcaaaaaattttaaaagagacatccatcatatagggagatcttgaaatatcttcttaggccaagcatcttccttcccctgcaaaatttattttacttcaccccgtcaagtttgccccatcaccactgttcaatggtaaagagtttaaacatctgaatctcactaaataggtgttcctccttgccttcatgtatgtctgtccccctttatctctaaaaagctgctttagaagggaattccttatgaggaataggaagaacgtagatgggggcgacttatcttcagccacccttttaacacctgtgctgctttccaataggtccttgtttcctttcagacaaacagctgtcatgtacgctgggtaactgtagcttttcagagctaagggcaatctgttacccgtaataagggccctgacaaaggtctccactctctatgaaatcagtaaggtatccccctcatctgcttctcaaatccagctccaggtaccaaatagaggctttgggagcagatccttttgacaaaggcaagcaatggattactagattcttaaatcacacagtggaaatcagaaacaatgctcactggaccagataattgtggataatatccccaatggggcacgtagacactttgggagcaactagttgctgtcctgtcctaattgagaaagcttttagagcaaatgatcaccagtacttcacatggcttataaatctttcttcttcaactccaactttacttatgaagacaacagtcctgtaaattgagcatttgttgctcatatcccaaaacactgtgatcatgaagttgctgagtccagagaataggaaggtgaagagatgggagctgctcactcctgaaggaagtgcgatctggagtgggggttaagacagtgactgttaaccacagtcttcggttcctcaagtacctcttttcaccagccatttgcattgaagtctgccctgtctcacagtgaaccctaccacagacttccactccccctcaacaggaaaaccttctcctttttgaaggttctacttgaccattctgaccaggaaagaccctggtctcacatgtgagacgttcaactcaaacattattacacgtaaaaaaaaaaattattagcttatataactgaaaaattcagatagagttgcacccaggtgttcaaatgatgacaccagaaacttaggtatattcatctgttaactctgctttcttctaccttagaatcattctcaggccatctcctccccaaaaaggccaccaccagctctgagtttacatttcacttcctaataactccaccacaaagaacacacacctttcttcatggttgtgtgtggcctgggcctgagcctgagcctcactctcgttggtctgaattaggtcacctgcccaaaggaaaactgaagtgctgtcaccagaagaaaggggcttggatgctgggcaggcagaaaaacggtctactatgggaataagaatagttctccacagcattcagctttagtacagtcagatcatgtactgcagtaactagttcatatgctcatggactgtcactttcagaaggaatcttcttctctctgtctcctccttccttgccaaagtatagccttttgacttgacaagaataccagtgctgaacctctgatgtgctttttagtgcccaagattagcaaggcagctatctaattctccccatatacttttaaaagcatcattgcttttatttagcctgctgcgaagactcattcggcaaggggttgcttgactttaaatagctctccaaatgatggtctcactatgcaagcaccaaaaggcaatagctcgccagagataattctgtctctatggaaacttaagatactttttaacaagatgatttctccacaatgcattgtccctggcagtcgttaccaagctcccatcttctccagagggagatctagtcagttccctttgacaccttgcgtccctgtctggtcctccagtggccagctcccccgtgggcacctgagacatgagactcaagccctgtcctggagactggctggttgagggcacaagaatgactttaaaagatacatactaaactttgtgcaagaatggtggaataccaaagcataactcctgccaagaataatacatattaccagtaaaatagagttcttttttttttctttttttttttttttttttttttttttgagacggagtctcgctctgtctcccaggctgcagtgcaatggcgtggtctcggctcactgcaacctccgcctgccgggttcaagggattctcctgcctcagcctcccgagtagctgggactataggcgcccaccaccacgccctgctaatttttgtatttttagtagagacggggttcaccatgttggccaggatggtctcgaactcctgaccttgtgatccgcccccctcggcctcccaaagtgctgggattacaggcatgaaccactgcgcctggcctagagctatcttttatcctttagaattattactttttggggggtatatcaggaagatgtacctaaaacaggccattttttcaagcctctaggggctgattacagttgagaagaaagcacaagtcaactgaggttattcagaaataagaaagatagaaataagaaataaataattagataaataagcaaaagaagcagaaatacaattcgaactgcaagaaagctgggtgcagtggctcatacctgtaatcctatcatttagggaggctgaggcagttggattacttgagcccaggagtttgatatcagcctggccagcgtagcaaggccccatctctacaaaaaatataaaaatcaggcaggcgtggtggcacacgcctgtagtccgagctactcaggaggctgaggtgggaggatcacctgagcctggggaggtcaaggctgcagtgagccatgatcgcgccactgcactccaggctggatgaaagagtgagaccctgtctctcacacacacacacacacaaacaaactgcaataaaaagtaggaatgtgctatcactagaaaaggggagtgaaggattgaaaacaaatggatgaaatattaatataaacatgagaatgagtataatgaatggagagatctatatttgtagattactcagtgaaaataaggaaatgtttgaaaatagaatttttaaaaatctagcaagaaggtgggactattatgttctctaaaaacagatttaaaaataaaaataatgaaatggcaggaaacagcactggaaaggaagcgggggagagggagtttaaaaaaaaaaattacaagagatcacaagtatttcccaaaatgaatccagatattatcagacatagagtggtgcttacagtctcagagcattaccctgtattattcaggtagatgatggtttggggggaaattactattaatttgaaagactctactggatcctacctaaagtaagaaggagattcaggttactctgaaccctttggctatccacagaattttagaggatagtgaatcccattctgggggaagaacatccagcttgtgccctataaagcagaggacttcagtagcttcctgctaggactcaaggaacgtaagatttaaccactgcatcttaatgggttttagaagaagaggaaaatcagagccacacgggttggtactaaaagtctcccctcttttttttttttttttttgagacagagtcttgctcttgttgcccaggctggagtgcaatagcatagtcttagctcactgcaacctctgcctcctgggttcaagcgattctcctgcctcagcctcccgagtagctggaattacaggcgcttgccaccaggcccgtctaatttttgtatttttagtagagacgagatttcaccacattggccaagctagcctcgaactcctgacctcaggtgatccacccacctcagcctgccaaagagctgggattacaggcgtgagccaccacgcccggcctaaaagtctcccctctcttttacacccgtgcccagcagctgccacctgaagcttaagaatgtggacgtgggcactgcgtggcatctctttagaaacaggcctccgggctacatgtctttccatgttaagaacccctgcattaaggtaaggggttttattagaagtcgtggtacagagatactacactctcattgtcagaagagttagccaccatcagtaacttcgtgggcatctcgtgaattcatatgcacatttatgttattaaacttaaataaatactattctaaatttgattcttccaaggacgatatcttagagatttttttcatgcccgtacacataggcccatctcattctttacaacagaaacctggtgtactaattaatttcaccactgctacactgacgataatttaattgtttctaatttttttgcccttagtatagagacaaatctgtagcgaatctgtgtgtgtgtgtgtgagtgtgtatctgcatatgaatctttgtgtaaatgtacaaatatttctttaggatggatttttagaggtgaacttgctggttcaaaaggtattttaatttttaattttgatagctactgctcaattgctttgcaacacttcatcaatctgaaggtgttcatagtctatctgtaattattgtaagtaaacaaaaatgttcaacaaaatgaaaaatatcaattttgtctgatgaaaatgaccccatttttatcattttaatttgcattttcctaattactagttagattgatgatctttatatttatttctttttttgctaattgcttatttatttcccttgtttttttctattgagctgcttgatactttctttttaactcttaggacttcattatatattctacttattctttgttaggtgtgttgcaaatattttatcccaggtgttcacttatcttttaactttgtaatttatggtgcatgcagaagctttcagttgatatgacataaatttgtctgaggtttatctttttagtcgtgacttctgggttacgtgtcttctaagtagagcctttctgagatgagacatagtgttacaggatttcatataatttcttctaatactttttataattccatggattgcttaatattcaattaatcaagaacatttttaagtacctattggagtaaaaaagaaataggaattcaaggattagcatagtgtctgagggtagggaaagcatgatagaaaaaaagcagggcatctctcatgtgcttctaagccttttcaactgtttagaactcacaatctttaggaacttaattcattttttccttcatttagcaaatgtattaaatgcctacttggcgccagcaagtgtgcaaggctctggggatacgatagtagggatggatagtgaactagatgagccctcaaggagcttaatgagacagttgtctgagatgattgctgaaggaattgagggctatgtggagaagtaagagagaagcttagagatctccgggcaaaggaaacgattgtggtgaaaggtcttataagccatgttaaggagttgtgactttactcagaaggcaatggagaccaagtaaaggaagcattttagccagagaagtgaaataatcagatttggtttctctaagggtactctggctaacatgtagagaatggatagttggggcaagactggaacctgggaaaacacactgttgttaagaatttgtcaagagaggaccatggtggcctgatggatagtttcagggaaagagaaagaaatagactaattcaagagagatttgagatgaagaaaagaagcaactggtgattgattaggtgccagaaaaaggaagagacgaggagtccaggataacgttcaggtttctatgagaagctgagcggggtggatggtggaaccattcattgaaataggaaattgagcagcagcgtatttggaggagaagatcatatacagacatgttaaatcatattacacatgttaagttttagatgcctgtgcaatatccaagccagatatctagaaggcaattggtggctttgtagttcaggagaatgaccagcctggagtcattagcattgaaatgatgtgaacatgaggtccaaagccaccaggagagcactgatgtagacaaccaagaatgtgtggaaacctagcatgatcccaatccagaaatgaatgcatatttcagtttgtttcatgcatattacagaatgtgactaaaaagaataacaaaagttacacctgtatacttttaaaattctgaattccacaaataaaatattacatgggaatttctaattcggacttgaaacttggaagttgaggggtgggggcgaagtaccaaatactgtggggaaggacagtgggtatcaattatcttttgagtaaaaaagaaaattcatgactttttgtccagtctgtaaaccaaggttttgaaaaacaaataacaatatccatagctctttgaaagaagaaagtgagagtattgacaagcagcataaagccagcatagaaggtaacccaggaaaagacctgtagtcaagagttttaataatccaacaaaatgtgtattgtttaaatttgccagaaaaaaaagaatcaagagtgatgtgtaaagtataataggaaatatgacaggatagagaccttgaagcaggaccagggattggcaaacagtggcctctgagccaaagcctgattttcttaatagttttattggaacacattcatgcccattcattgacatattgaaggcagagttgaacagtcgccatagagactatatggcccacaaacctgaacgtatttactctttggttctacaaaataatttcgccagccactgtaaaagaccagtgaaaatgcccaaagaaagataagagcatgtttaaaaataatggacagaaaagctaacgagagcaataatattacagactgagcggagggaagcataaacagtatgatctactttacatcagagtaccacgtagactgcaaagcctaaacagaagaaagacaggctcttaactgatcactgcagttattattcagcgggttttgagcatttctgatttatgtagatttttatgattaatgctattagacatggcttctataccaagataaatttaagccaacctaatattcctgaaactaaaatggaatctcgatgatttttgagaagctattccacaaagacaattttactacactatacatttgggcaagtgggtaatcaacttagttaatactacataaccttagctgccgtataaatacagaccaaaaaatgaaaaatgttttctcaagttataggaagccagattcataaccatccgtcacttgcttgggcaagttactgataaactctgcagaagaataacaaacagtgtgtccctgcaccttggctgttgaaaatgagatctttctctgattgatgttagcagagaggcttgtaaaaatgcatttccaactgattagttcagaaggtgtcaatctcatgcagttttatgacctgcagactacatgccagatgtacatttgctttttataaactaacaaagatgaatgactaaatttgagcattcctctttggcaactgtaccatctattgcctaagggaagacactggcagcattatggcgggggagaagagggtaaggagcacttaacccttaacttaccagattaatggagaaaaatataatatttggaaatacttttcctattgaatcatttctacttttgttgaagaatgactgcaagggaaaacctgcaagaatatcagatatttgtgttgttattctcccaagcatatgtacccattcgaaatccatcaagtaagaactaaaggtactatatcataaaacacatttgaaagattcgtcataaacatcaaacatataactatgaattgggatggaaaggttgaggttttaaaaaattttttggtttgtttgttgttttgggttttttttttttgaaacagggcctctccctgtcgcccaggctagagcacagtggtgggatcatctctcactgcaccctcgaactcctgggctcaagtgcctcccaagtagctgggacttcaggtgcacaccaccatacctggctaagttttctaactttttgtagagatagggtctcgctgtgttacccaggcctgtcttgaattactgggcttaagtgatcctcccaaagttctgggattacaggcatcagccactgtgcctggctaattgtttttttgaagccagaaatgatattggagcagtaggtcaacagtctactacttcagaattctgaatcttaacaactatgcttctatttctttgagagagagggagaaaaaatgttttacattattattatatatcctcatgaaaaataagccaatagcatagtatagtctttcttccactagaaatattgagaaatatttatacatttttcatcttcatgcccttttgcctaggaaagtaatattttgataaatttatatgaaatttccaaactcagtttcatttgattttcttttcttttttttctttttttttttttctttgagacggagtcttgctctgtcacccaggctggagtgcagtggcgcgatctcggctcactgcgacctccacctcctgggttcaagcaattctcctgcctcagcctcccaagtagctgagattacaggcacccaccaccacgcccctctaatttttttgtatttttagtagagacggggtttcaccatgttggccaggctggtctcgaactccttacctcaggtgatccacccgcctcggcctcccaaagtgctgggattacaggtgtgagctaccgcgcccggcttaattttcttaaaacatgattttagcttttttccagagaaataaacatgcagtttcaaatggttaacaactcattatcttagaaatataacagacatgaaaatacatgctatcataaggaaaccgtgtgtaatcagatctgcttatcagaaatcctgacccacacattttcatgtgtatggaaattatggtaacaaaaaacttaaaatattagtgtgaaaagagtccaactttataaacttaattcagatattcacttattaagcctttcccccctcccccaactacaaaggaaatagtgaagagatttttagttactgtctctggataagctaggtctctgtcaatttcaggtgacagaaaattgaattcaaacagacttaaggaaaaagggaatacgtttctataactgaaaagcccaggaggtcaagcgcagcttatgtctgtgtctgacctgttagtttttgctccagcccttgctccgcttgcctggggatggctccattcccagcagcttctataccggcagcaaggtggctgcagcaatcccagtcacacagcctcacagaacaagcctggtggaggggtaagaatctctttttagattgtttgtgaaattcgctcttgttagacatgttaggtcacctgtacatttctgaaccaaacaggaagggaaggttatgcacatggcctgagaggtggggaaggccggatacgcaaacgaaaagtttcatctgttgcccaaagaaagggaaagggtctggggaagcacagcgtccgctacttttattcttcagatggccaaaatgacctgctgagccaggccttctcacgtcttgtttcttaccttaccgtgttgttgctgacctgccttttagactgggcaatttaattcaactttgtctgttttcttttatctcagtttgctgtcagataatgaaggagcaagctaacattctattaataagaatagcctaacttaaatcaatggctagtatagtatttttttaaaaaaagactttattttaattgtataaataaaacataatggtcatctagatattttcagctgagcttgccatcacagtggtcagacccagacttgatacttaagttggaagattttaaaactattttgtcagttctcctaagagtgattaaagtcttcagaaactgatatttttattaatctataccaataaatgtaattaccaaggagataaaaattcatgttttcagctgggctgagtggctcacacctataatcccagcactttgagaggcctaggcgggtggatcacttgaggtctggagttcgagatgagcctggtcaacatggtgagaccccgtctctactaaaaatacaaaaattagccaggcatggtggcaggtgcctttagtcccagcttctcaggaggctgaggcaggagaatcacttgaaccagttaggcggaggttgcagtgagctgagatcgtgccactgcactccaacctgggtgacagaggaagactcagtctcaaaaaaaaagaaagaaaaattcatgtttttcaactggtcagtaaagcctgaccttaaaggataatgttatcaaatgatcataacctgaaacactcaaccactaatggatggttatagcttttaaacaggatacttgcatgggccattgagtgtagtttccttctgatgctcctggagaaagcactggcaaattcttctcatccattattccttttatgtcatcaatactataggtcaatttttcatgatggatttcttattatttctaatattatggctgatttacatttaccacattttaattaatacctccattttagtgagtgtattctaggagtccaggctcttgtttaaaatttgggaaatgcctgattttatctggaacacacttaaccttccttagaagaacttttttttttttttttgagacagttttgctctgttgcccaggctggagtgcagtggtacgatctcagctcactacaacctctgcctcccaggttcaagtgattctcctgcctcagcctcctgagtagctgggacaacaggcacctgtcaccccgcctggctaattttagagatggggtttcaccatgttggccaggctggtctcgaactcctgacctcaggtgatatgcccacctcagcctcccagagtgctgggattacaagcatgagccactgcaccggccagaagagctattttattgaaaggtggttggctcatctcatccattttatattgatttgtgtttgctacacttcataaactttcactttctgaccctctcccaaattttagagcttcgtcctacatagattcctatttatcatacacacttactgtgctaactcctagtgcattttctctaaaatatagaatatttgagtagctttacttacaactaatccatattccttcatactcctaccaatagattgttctaatcactaatttttttatttcttactcagaacaaacattatatgattcttttcagccatctctaatccaaatatttactctctatgaaggcagatgcaagtagatttatgtgtcacatactgatggggatatgttctgagatagttgctgttaggcaatttcatcatggtagagcatcatggcatgtacttacgcaaatctagatggcacagcctactgcactcctaggctacccatctgtacagcatgttactctactgaatactgaggcagttgtaacacagtggtatttgtgtatctaaacctagaaaaggtaccgtaaaaatacagcattattatctatgggaccactcttttatatatggtctgtcattatgtggcatgtgactattgtatttctatttcttctggtttcaaaaagtatgcctcatagaaattactatcagatagtcgggagaaatcacttgatgtgaaaaaaaaaaaaacagtcaagaaacaaaactgattctacattatggcatcaaaaggaaaattctcttactggggaacatttctctctacagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagaggttaatgcttcttttccatatgtagatttgtaatgatgttatcaacagttacatacacttatgtgaaatactcatgactgtgaacctgaggaaagtgctgttttttaaatacagtttttcctctttctgcagattcttcaccaaactttgtatttcaagcatttttgacacagttcacatactttgtcaatttcagtacctgagacataacaggacattatattaaagagtcaataaatcttcatttaactagttgattttgttagcacagttggaaatgtttcaaaagaagcagtgaaaagaccccaaaaggcagaacagaagtgcacttttttttttttagctgagctcactaaataatataaattatgaatgaatgtaatggaactgctgacggcatggcagtaagattgcataagctgtttgactggtgctttgcagagcagtaatgacctgaaagtaaagcagtaagtgaaagcaggtgtcttgtgtctcactgagcaaaagaagatgatttacaccagaactcctgggtctgcagtaatttaacagcattaatgcagttatagccagcagttgattcaaagttgctgtacaaatgttccttatcgcccccttaaatcttatacttcttggtccctgaagatttactgattgcctcagaattaattggaaagtctacttttcttcatgtgagcaccatatatatgacttatgaaaaaagcacagagtttatcattttaaaaattcatctctaaattattagtcttgataacgctccaaaaaacagattgccacaaattaaaacccaggataaacacaagccctttagagaatatgcgttacactgaattaaaagggacattgtcttgggagtatttcaggtctgatttttgtgaataacgatggattgcatagcatagtgttattttatccttaggttgaattatctataaatcatgataatgttggcctgaaaagacagatgttcattctcattcttctgcttttccaacagccttgcatctgtcatcagaggccaagtactgactgctgatggaactccacttattggagtaaatgtctcgtttttccattacccagaatatggatatactattacccgccaggacggaatgtgagttagtcccatcacactatctctgaaggatttgaaatataaaaactagaccttcctgtaccactgtcatgtttgactgtccttttaaatatggaaatgcagcaactttttagactctacaaacttgtgacagtacatatggcagagatttaaagtcatatactcacatacttcttcaaaagttgattttattttctaaggcatggtaatactgtagttttgtaggagaatgctctttgtctcagcagatgtatgttgaaatctttaggggtaatattttataatgtctgtaacttgagctcagatggttccgagaaaagagtcaatggaaagcaaatttggaaaaaaaaattggtgaacttggtgaatacacataggacacaagagtatttattgtataactcttggaatattcccatagatctgaaaatatttcatataaaagttgggagaaaaagttgattttctttataaagcatattaacttaaggaggtgtgtattggtagttatgtgggatccagacaattcactaagcataccttgttctttcttaggtttgacttggtggcaaatggtggggcctctctaactttggtatttgaacgatccccattcctcactcagtatcatactgtgtggattccatggaatgtcttttatgtgatggataccctagtcatgaagaaagaagagaatgatattcccagctgtgatctgagtggattcgtgaggccaaatcccatcattgtgtcatcacctttatccacctttttcagatcttctcctgaagacagtcccatcattcccgaaacacaggtaaaatattctcacaggcagtacttgtaaatacaagatcttcagatcatgttttgccagagaatcttaaaaataggttatagagtccgggcacggtggctcactcctgtaatcccagcgctttgggaggccgaggtgggcagatcatgaggtcaggagttcaagaccagcctggccaacatagtgaaaccccatctgtactaaaaatacaaaaaaaaattagccgggcatggtgatgggcacctgtagtcccagctacttgggaggctgaggcaggagaatcgcttgaacccaggaggcagaggttgcagtgagccgagatcacacactactgcactccagcctgggtgacacagtgagaccctgtctcaaaaaaagacaaaaacaaaaccaaaaaaacccacggattatagaattccagtgctatctttaaataattctataagaccctgtctcaaaaaaagacaaaaacaaaaccaaaaaaaaccacggattatagaattccagtgctatctttaaataattctatagaatgaatatatagtgggtgttggggtgtgtgtgtgtgtgtgtgtgtgtgtgtgtgtgtgtgtgtgtgtcctacagtagacattgttatagtaggatatctagttatttcttttttctttttttttttttgagacggagtctcgctctgtcgcccaggctggagtgcagtggcacgatctcggctcactgcaagctccacctcccgggttcacgccattctcccgcctcagactcctgagtagctgagactacaggcgactgccaccaagccaagctaattttttgtatttttagtagaggcagggtttcatcatgttggccaggatggtctccatctcctgacctcgtgatccgcccaccttgacctcccaaagtgctgggattacaggtgtgagccaccgcacccggcctttctagttatttcttaaagatctactcaaacaaaatactttttcttcaggatataccttatatatttattaataatagtcaaatgaaactgtagcttaaactcaatcactaataatgtctttgttcatttatttatttattgaaaaaaaactttagtgcctaaatgtacctgacagcttgactgacattgtaccaagtgctactgacaccactcactattgcacatggctattagcctcaataacttactgtttaattattgttgtcagtaaaaagtgttttggaaaaggtagttttgacagaaaatattcattaatataactttttaagaaatagccatgcattccccattcgtttcatctactgaaatagctgaggattgtgttccgtcccacatgtttccagttagaaataactttcagatcttaaaagtaggatgttaggtgtaataataatggattttgccaggcggcgtggctcactactataattccagcactttgggaggccaaggcaggaggatggatcgagcccaggaatttgagaccaacctgagcaacatgacaaaaccctgtctctacaaaatatacaaaaaattagccaggcgtggtggcatgcacctgtagtcctagctactcaggatgcagaggtgggaggatcacttcagcccagagaggtcaaggctgcatgagccatgagtgccactgcactccagcctgggtgctgggagtgagaccctgtctcaaaaatatatatataatcataatagactgtattcgtaaagaggtaaggaaaaatctgtggtcattaaagtacactagcacatagcagctttgtcatattcattctcccgatatttcttgaaaacccgttctgtagcaggcgctgttatgtgagaacaaagcagtaaaccactcagatgaagtacctgctctaactgagcttcccaactcatgagtggagagaggcagtcaacaagaaatatgtcaggttgcgatgagacttatcaaaaaataataaagcaggggacagtggatagaggtatgatcttacatagtatagtttgagaaaatctcttcaataaggtgacatttcagcacaaactttaagaaagtaaaagaataagccctgaaaatagaaggggattcttggcttgttcaaggagtggcaaaaaggacagcaggcacagctggagtgaaggcggcagtgaataaatcacaagccattggagaccatggcaaagataactctttgagaattggaagccattgaaggtgtttaagcagagcaatgacagtcactgatttcctcctttaaggaatttctatgctgagaatatcctatattgggcaagggtggaaacaaggaggccagttaggaggcaacctcagttgtccacaggagaaattatggtggcttggacaaaagtctttggaggtagaagcagacatggaagagtggagtccagggaagaggttgaaactaaagaggtaaatttgggagtcattcgcatataaatataaagcataaacctagggagggagcacagatagagactacaagaggtgagccagaaaggtctaggataacaaaaagtcaaaaaggctgacaggcaaagatgttgcaatagcaacacctcagggattcattgtaaaatggtcaagccaactttgagctgaaacttttaagaagttcattgtaacctcaatcaatttaatacttcctccccaggcccatcttgcaggaactctaaacttcgtagtcagtcctaaaatagactttacctagagtcagtatctgtctgtaggtgccaaatttctagcaaactaggacattaaaatgggtttcagatagtcaacaattccatgaatacatggagtcttttctccattcgttcattcattcattcatgcggtaggcaaatatttcataaaaatttactgagagcctactatgtacaaggtactttactaagataaaaagaagaagacgtgcatcctgccattctaaatgcgataaagattttaatgaagaatgatacaagttcaaaggagaggtcaattcctaagtaagccaaagaaggaatcactgaggagtttgggctgaaacaaggattaggctggagagggaggaaagcacgtttcagattgaagatgtgtaagcaacagtggagtggcaaaaacaagtcatgttgtagaggggacaatggggaaggaggcagaagatgaccccagggccagctgatgaatggccctgagaagcaatctagtggagaccttgaattccttaggtgatgcggaaccaagaccccagtggagttttttcagcatttctctaaagttaactcaagtggcaaaacgcacttgaaagaagcgcagaagatattgatagaaaagagaaatgagtgaacaggctgttcttgtgaagtgtatatccatgcgtatccagggctcagatggagagggcctcgcaatcacaatggtagtggaaatgaagaagagggaacacattagacagggattggaagatagaattggcaggacatggttcctaaccgaatgtttaacgggatcaggaataggatttaaagctcacgcagctggcaagagtaggcctgatggtttattttcccactttggctggatttacctttcctactaatgcaaaataacatggtcaagttaaattacatcagagaaacacatgctttaatgaacaaaattacagatattaaaatcaagtacaacacatgatattttgaaatagagaggcagcttctggaaggtcacaggaaatacatataatattcgtaagagagtcccttactcatggaaaacctgtcaaatgtatcggaaattattttgaaaataagaggaagcaaatgatgggctttagggttaaatcacatgttatcagggtcattctggagtcacagaatctatttttcaaattaactccttgatatttcactgattatgggagaacaatgagttatctttaaaccattcaccctaacaacctacagtcttacaaaagtaccctcaatcttaaatttaatggtttccctgggtctaaaaagtttctatatgtttgtaaactattttgcttaagaccgttttgtggctgaattcagtcagcatgtttgaaggaaaactccaatggtaataaattcgtgtatctacattagaaatgcctcttactgtactgtactgtaccacatcgcgtccctcttcatgccaacactgactgacaggccagaatggaagcttccttcgtccattcattcatgctgcttccaactgtgtgattgtttatattgaagctgacagctccaccctcagtacaaggggtcttggagggttttactgaagttattaaagtttggaggtggcagatagacatcatctttaactgttctatgtggaggtggtggggaaaggggaaacattgctgaacactgaatcactattctaagatctttccaacatgaaaaggcagccctttctgtctgaatagtgaatcttgatagggcaatataaggaagcctttgagagtactgtttaattcttcgtggagaaagtagtgagttcctggtgcacgttcttgaacacagatagccttgcacttacagcctatgtagaaagcctatgaagagctgttcttattcaccaaactaacaggagcattggtaaagagaatctgaactctttagaaaaattgtgtatgctgcctaaaatacatttttcaaaataagtaatgttttggcataatgtattttgcatttcttaatataaatattgtcagcatacactgactggtaatctatggggttaagagtataattttttttaatttgtaaaggagataattcttatgcacataattatattcatttttacagtccagtttcaaataaaaaagtgtgaattgatatgttctatgtgcatttaataacatattagttgctctctaggataaattgtatggagctttaaaatattagctaatttaccatcatatcaaaaatccatggtaagttggagctcaatctttaattatgacaatgtgctattattacattacctctcaacatggatatggaatctgctacaatctaacccaaacgattgggtgttttttgttatccttactgtctttataggctgtgaccagccagctgatgaggctataggtactggtttagtccctaaatgagccagctggcacaggccagatctttggcctagactgcatccctgttctgagctaaccatcttacaaatgtctgctctaattctccagggtgatggggtgaaagatgggttagtgagaatccactgtgactactgcactaacaagtcagtgcatgtcagcctgatggagcagtcacagtgtttcccgtatgaagagtagcacccgaggtatgattaactcagaataaatgacaggaggcttttaggaagagacatttgggctggcagcagagttatttttaattattgaataagataacagctcaaatgcatatttgtgaatagtgattcttttgtgttttattttagttgctctaaagcagctaaaataagcacattgtctttgtgagtaagtaaactaagacacagagagtcactattcacaaatatagtgaatatgtgctacataaatatattttatctaatcgtcatacgtgatcacagtttgaaacttctgctttattcaaacttaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttggtaagttccatataaatctttgctgcagtgaagtttttctcaaagccagaactatcataaattaattgtaacccagggaagtcagtggataaacagaatataaagagaataaggttgtcctagggatattataccttggctggtttagatctaccgtgggaaaaggaatgtactccatgtggcaagaagaagaaaatatcagccttttctggctgaaattatgttgtagaggaattctgtgaatgaggtttcagcttgtcacatcctttctccccccatgtttctttccttattttgtccctttctttttccattttcttcttctctttataactttacctccctggatttccttatttgtttttgttttctgtgtctaacactaatgtagtttcagtgcatactgatgtttaacaggatagcagacatttgtgtccatgaattacatcagctgttttcactagaacggccggttcattcaatgaaaggataatcaaaccagttgttttattgaatgactgaacagtgcaatcaaagtgtgacatgttgagagacagacagagagaaagagaataggtatatagtatagcttcaagctcaagctcagaacataaaaaactaaagaatgatatgtttttgttttaattagtatttaccttaaaatagaacattgtactctgaaattaataggtaatttggatttgaattagttcaaatcaatccagtaattgccacttctcctttcattttttctcaattttaaattccctgtttcattgtgaactctggaaagcttttcatctgtggtttattcatattactgctagtttgtttatttctgataataatatgtcagcataatgtcataatctggctagcttttttgttccattgaaccttacttatcataaatattttccataatttaacactcttgagtgaaaactaaagagttctaattattcagatggcaaacgttatttttagttgttatctaatcactgtttgagactgactgatctaattacttaaccggctgcccaatctggactttattttgtgctgtgaacccctcatgaaggggtggtatggggaaaaaaacactcattttctattaaatcagtggaaaataatatttggagatctttttttaaaaaaaaatctttggtgaaatcttcttaaattaaaaaataaactgctcataaataagtggaaatacagtctcagaacacagatgtgaaaaaggcagttttttccaagtaagaaaataaattgcatttcccccagtcgttggaaagatgagctgtgatttgtttggattccagtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtaagctcttgttcatagataactgatgttgtaatgtattgttcagagatagctaatgttgcccactttccaactcatgagattgtagcaacattttatgctatccatgctgtaggattagaaatggcagaaaaaaaataaaggtgaatttttaaagattataaaagcctaaagtgggaactgtataatactttcttaatatactttaaaatgttcatgaattgatcgccaaaatgattttcccattagaatgtgaaagactgactttggtgttgtaatggaagatctctgagtgggagtcgtcagcacagattcacctagagtgtctcattctacagtgagtcagtgagtgtgagccaaagtactttagaaaggtttaccaaaaatggagggaggggggatttgttttttaaaataaagaaaaaaaaatcatgtgacttcaccaaaatatttttagtagattttaattctcgggtaattattctgagtatctagatttttttttttcagttcttctcagactattagggaaataaagcattctgccactcaaatggggtcacatatattgttacttgacttggtgaatattaggggaaaaaatgaataatctgagaaaaaagcaagaatcaaaagcgttcctaggagtagacctgataatgtcctagtgaatatgctctgaagaaacatgtttcaaatgccgcagaccaaaagaggagtatttgcaaaatatgaccagcttaatctcatcaagaatattatttatatgaaacacaattctgttgtctagactgtgtttccaacattttgcccacatgctagctgcatctcagacaacctgaagggtgctttgctggaaaagcaggaccgtaagttaatctattatactttagcatcctgtcctacaccatatcatactagtactctacttttactgatagccagagaaaaaagtcacagtctcagcaaaataatctaactcttgactttgcagaggtttttggaaggttcagaatattgacttgaccatgtactacaattaaatgtttatagctaatggtcagtttttcatattaatgttgcttcagtgttcattcctgcttgaaacaatttttttgtgtgtgagtgtcagagagggtgcattttaaccttccaaatatatacagaataaagtagttttaagaccattacttgaaaatgctcgtgctgggcctgatgcagtggcttatgcctgtaatctcagcacttcaggaggccaaggcaggtggatcacttgacgtcaggagtttgagaccagcctggccaacatgataaaaccctgtctctacaaaatacacaaaaattagccatgtgtggtgatacgcacctgtagtcccagcaactcgggaggctgaggtgggagaatctctggaacccaggaggcagaggttccagtgagctaagatcgtgccactgcactccagcctgagtgacagagtgagactccgtctcaaaaaacaaaaaaggaagaaaatgctagtgccttccctccaggaaataatagtctgagaaaaccagtagtaaggaaaaacaaacaaaaaagcagaaaaacccttccctgcttcactattttatagcagtatattaagctctacaccccttccagttacgtcctggacatcaggatgcagttcagtttgcaccccgaattaaacagagcggataactagtgccacatgcagcacacattgaaaaggtgggactcctgactaagcaggggactccagtgttctctcagagcctctcttaactcatcagtggtgtctgaagcagtagtagtttcattctgttatattagtagcacaaggttcaatcatggtcttttaaaatgcgaagccatatggcaaacatgctagtagctgctcttgatgaaattgtgtaaaattatatttcacacagtttgaacatatttctgtattccttcagaaaccctctaaaaacaaaactaggggaaacgtctctagatgccatttagttatgatgagagtatagggtaaagttcataaccagttagctacaggatttcactcaagagattacgaatcaataggaaaactacaggcatctctgtagctccgaaaaagcccatgcctctgtaattcaccattgtatgatacaacacacgatattatattcaggaggattcagaaatatgtagatgttctgtatatgtataatataaatacacacatattctaaaccagaataacatatgggtaacttctattaaaataccagggcagatgtaaaaaccgaactttccaaaatgctgtcctcaaaaaaaaatgttctaaattataaaatatatttaggccgagcacggtggctcacacctgtaatcccagcactttgggaggctgaggtgggcagatcatttgagatcaggagttccagaccagcctggcaacatggtggaaccccgtgtctactaaaaatacaaaaattagccaggcttagtagtgggcacctgtaatcccagctactcaggaggctggggcaggagaatcacttgagccagggagacggaggttgcagtgagccaagattgtgccactgcactccagcctgggtgacagagcaagactccatctcaaaaataaataaataaaagaaaatatgtgttatttttaaatgtgagataacctcagccacagggtgaacagattgcagtttagaattttatccaagaacattttgacaagtagtggctttccaaagtgacatgtgtctaattgaataaacaaagtgatttgtagtcatgacaaggtggatgagctatagaaagacatgaaggaagaagagaatacggaaacgtagatgctgacagttattcgtgcgggcgccctgaaacatggaaataaatattctcatgttcatctttctgttctgtcatcatagagaagaagcaggaagggccaatcgttcaaagtaatgactgaataaatcagatgttgtagagcggtagtctgacttgtaggattcttctgatgaaaattacacaactggctcttataggaaattatagctccataattatcaactaacgtaatcacagaaagaagaatcttagatatcactaatgcattctttgaatattcaaggcaaaatgcatttcacctcttgttatgatccagccttatttagcttatttttcttaaatttgaataaacctgttttattttccctgatttctttatgtaaatttgctatgattattacatcacccaaatagcaaagcattaaagaagtaatcacagaatgcacctaaaatgtgctgagttataaggagaacataattattctaatttcttcttcactttaaaattatcccgaagtggggggaaaaagcactttctcaagtttcctgattgtactttcgtgggattattctttcaacagtgtatctgctaagaagtagggccattatctctgagaacttctttggaacatagaacattcaataaatagaatatatgccgctctaaagtcaaagcagcaggtggtgtatacagatgataacacattgagaagtgtcataaactgtgcatggaacaatagcagctgactaccccgtgtgcatcacgccaaactggaggcactgatctgtatagagcaatggcaaaagcaataaaattacaatctcaactcaaatctaatttctaaccatgaaaatatttaatattcatttggaagcttttctcagattttcactgaagaccataaaagagcagactggcattttgtcttgataaaattattggcacttccatgccttaaagcagaattcactgtaaataatacattggccttctacaacagttttgttatgttcgacattttgaataaccgcatgtatatgcattctcctattggatgagagtgtacgcaggaatagtctttgacaggataggtagagttaaaataagcctgtattatcgttacagctttggagtttgatgtctattttctacctttgttttccacaaagtttgttaactttaaagaaaattataaattcaaaagaaatttgtattcctggttcacatttttattgactgaatattttcaatattgattaacaatgaggcaaacttgttattccctaaagaacattatgtagagcctgttctcaaacctggttgcacgttaagatcatctggagagtttttctaaatttcagggctaaggctgcacctcagacaaattaaaccaccatctctctgggtgagaaccaagcattaatattttttggcaactccccaggccattccagtgtatagccatgactgatcatcactgatgttgagaattggggttttaattcttctcaggcttttgttcctttcaccagacatgatttcagttcacagtagacagcactgttggtatatatcctatggactttatcgtgtaatattttacactaggtagttgaatacaattcattccaatggagcttcaaataagaatgtcttaatccagacctgacaggcattgaattatagttaaaacaatcatgaacatgtttgcttttcatctttacactttttcatcataagaaaaacaatgcactttatttcttctaggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaaggtacgtctttcctaaatttgggcttttaaccaaagctaaacgtgcctctttaaaaaaaaggttgagtctgatgtactgatttattcatagaaaaataccatcctaaggtttaaaatttcccccagaaagaagtcaaattcttgcttaaagttaagagaagcataacacatataaattgtcccataagtgtattaaagagcataaagtcacccaatatatcaaatatcttactgatttcagtgaattttctgtgctctaaaaggctagagctatgattcttaaatctctttcgctttctttagaataaccctgtgacataggtgtagctcttttatttcatagtggttgaaattaaggcataaaatattttcctgtgatttcaggacctgatattaaatggactaaggctacaacttttaactagaatattggatcttcaggttgggttaatccattagccataatgccaatagtaaaagtaacatattgtctttgctttgttcatttaagtgtgactttcaaatcattctattctgtaagttatttggtaagccctagactacagaattcatttccagtatcatttctgccaagttggcaattttccatacaaataattaaaatctcagaattcaactcattatattttagaaggcttttctaactgtgctttctttttttttttttttttttttttacctttttttatctgcttccaccaagaaataaagattttagacataggtaagcatcttaccttaaggttattgtatattttcaaatatcctttttacatttcaatgtgaccctctgaaattgttttctaagaatatttcatcatgagagaggaaactcagtatcacacatcatcgaaggaattaaaagtgcttaattgaacaattattatacaatatattgcgagttatttacgtgatataatttgagaaatctttctcagttggttcataaaataaatttcattacaaaaaagtataaggaatatctctctataacaaaattatttccaagcattagttactgaccgacacaatctaagccatgttgaacagcatgaaacctgaagcacagtaaggaggtttgagaaggcctgcctggttccaagaaaacccctgacaggttgggttttattggagactgtttaagaaaaagaatctagaaatattttaccttggcaaattttttaaaacatacgattatgtgaacatgtggcttggcagagtgagaggccccaaaactgaagcttaattattagcttcccgtaaattcctctttgcctatagtttatattttcctaagttgggagaattactagatttaagaagtaatgttttcattgccattattatggaggaaatgactttcttcaaagtgaaggacgaatatagttgaagcaaatatatagactcagaagtgtttcatgtctgctttctgtgtacacgtagctgcagaagatacaataaagacttgtatggacacatttgattgaaaaactttgctcgggatagaaaaaaaaaggcggaggaaaccaatgttttaaagtaaagctggcaaaaagctagacaggttagacatgctagatctagtttggtcattaaaatatctaatgaaatgatatcagatagaaatattaataatattttatgtgaggtcttttagatgaataagtcaacataacccatttaaactgttgtgtagtgattagcaaacaaaaaccaaactagcaaacaaaaaccaaagttctactgaaagatggatagctgtcgcatatcagggtgaccaaacctggccccatgatcttttcctgagatcccctattgatcttaaacttgcagctaatagctcagtcacatgctaaaatcaacacttcatctccccaggatactgagcgtgcaaagctctgctattagaaaccacaatagaatttcaaaaacttgctggtcttgttttcttggtagctgtggagaaaagaggaaagacagacaggttgcacaccaagtaaatgtgaaaatgctggaggcaatacagaaaaaactatcaaagcagctaccttttaacaagcgggcctattccatgccgggcatggtgccagatattttatatctgttattgcagatccacacagcaacccctcagggttataagtgacgtagtagaggctccaggagattatgtatcttccccaaaatacatatctaagaaatgggtagcagacagttaaaccactctaaaaatatgttctttccacggcaccacacagccggtttttctgtgtcccagtggccaagattctaggggctcattccctgggtatgcaaaaagcaagacttatttcacaatcattttacctgttatttaaagccataatctctccctctggaaaaaaaaaaatctatgaggttagagttacgtctttattaacagtagaaattcattttgtactaactcctggtgtttggcagtgatactattgtaatccctctctcatgatcctccataatccttctcctctgtccatcatcctaactacatttgtgcttctgcatttcctttatgtgccatgcatgaagagtacactttttgggttttatatggatatttaattacatgaaatcaatcagcgttaactgatcacttaccgtgtgttaggcactttgaaaaataataatataagacaaaatacctcctctcagaactcacaatctagcagaggagacaaggtatatatgtgacaccttaaataacattatcagtatcattctttgacacttaatcatacccgtggtccgtggtttcaaatgtgagaatagttctgtaaaggaagagattactgggagatggcactacggtaaggaaacgttttctggaagggctgatatttgagctaggtctaaaaatgaagtctgcttaaatagaacagcaagaagaaaagagggcagtcatgaagaaatagagaaagcaagtaaagttactggagactgggggagagctgagcaagacatgttctgagagtaatcagacccacctgaatggaacagggggttcatggtggtaatcacgagagatacaggcagaaaggcaggggagggtcagattgcttggggccttgagggctctaaggaattattctctcctataggatacctgagacagtggggacccattttaggatcctgaacaagtggcacactcaaagtggccttttaggaagagtaatttggtgtcagagttcaaaatgattgaacatcagatcaattagaaagctgttgcagcttgagatgctagatacctaaaacaggatggttagcagtgaagaaagccaaacgataaaataaacggaaggagagaatggagagtatttgtctaagtgataagaaagaggaagatgtagagaatgtgtaaggtctttgagcccaaatcatcaaacatgatcatgtcattgataaaatagggattccatttgcttagtaagtaataaaattgacctagcaaagtcaacatattttagttcattggaacttcttcttttagcttaaaaaattaaagttcttttcagatgcttcttcctgtgtacctgcctatcgttaccttccctttcctggttaataagatccttcctggcgtgctccttatcctcgctttcttgggcagcatgagtcatgagaggcttaggaacaggtcataggaagaaaaagaaatggaaaagtgtgtctaaatctacaaaaggaatggtattgccagttgttaatgattaaaatataaaaatgcaaactttttatcctcttctatatttcatatactgtaaacagtctcgttagttggactaatgggggaataataaaaatattgaataaaaattagtataaaaacacattgtcttattttaaaattcagagagtgttctgttatatcaaactaataagcaccaccaggatattacctgaaataaaaattcttagctatactttagtgaataggtataaatgttactgatcaacatattaaactttttacatacatagaagctgctacaattctttaaaaatgtctttcttttagatgtaccaaacatttccttctctgatgtttatagtattagtttgctaaggaacccctttaatatgtagtaagttttacctcatccttgttccaattctcacacattgcaaaatttaaaaattacattaattaactaataccagccaaagggcacttaaacatgtagaactaaaaatcaactttgtgaattttatattaccaattaaaggatcaaagaaagtgtcaatcataagtctgtgaatttgaatccattaaagtgtagataccaaattataaaaattttattcagtaccccttattgacttaatatttaaaaatcaagcaggcatggaaatatcacaccccaagtccctgcttgcaatattctaaacagtcttttggttaccataaaagaagctgttttacttttatatgtgaatatagtttgttatgcttcttcaaatgtcttgtgttctaaaggctgtgacacagtttccaactcagaagatagaagtgctaataatatctgttctctggcttgttctttgtgaatatttctctagtctaagaaggttgaattatgacaaaataaatgagcaaatccagcctgcacttaccactggatctgtgtctaattgaatgagactagagaagatgtcttgataattgtgatgatctaggcaattcaggatgagttaagaatcaaggtgtaatatactaaaggttcttaacttgatctcagtttccttggttttgctattagtcaaaattgtaatatttcaaacctttctgaaatagtgaaatctcaaccaatcacatgagaatgctgctgtgcttccgctcagcagagatttcccaaaaccaagcattttgaaaatccctgtgctccagctgctggctgcagccggttccgtcgtggtagcctcacgttttcacagtagatagattactgacctaaaaattcaccactcgttgtacccacacacccgcctcttcagtgctttggcttttcagaaagttggaaagcaagcacgagctcacactgtcaactctctatgctcaaattaggtgaccttgaatcccagtcctatggcatatgattcagagcttcactgccaccagtctgtcaactagaaatatccagactcactttttttccttttagtacttccatgctgatccctcttttcatttaggagagaccagcatctaacaaccagctctaatttgccatcctagcctgcgctgctgggaatttgtcaagttctcatttcctaccatcctgtgggaatatttccagaggctaattctcttctctagggccacgtagactcccccacatttgttcttctggacaatagagttgtgtccaaaagtacagctttcatttatcagacatttttaaagccattgacatttgttgcttgatggagaaatttctatgtcttctaggaaggagatgcttcaggacaggaaataagcaaatataagcaccactttgggcattctctctttacttccccactaggataaaactgatgacaataaaggcaaagcttatcacttgaatgtccattcgtttttgcaccaagaaaactcacgtcccatagctaaagaggatgccaccaccactgaagctgccacctcaataatctgtttgtttgttttttctcaaaatgagggcatcctgaggaagtgtgcatgattcatttaccatgaatgaatcatcattgttcatcattactctctaaacaatttaaagtgggtatattgagtcttcattattttaatagtttaggatattataaactgctgttataacagcagaagtaaaaaaacaaatttaaacctaaccaagtttaggtttaacaaacctaaacctaaaccaagtttaaacctaatcagtttttttcttttaatattttcagaaacaactcatactttagttaattattgtattcctgcactttctaaggttataaggcaaaagacattgcactgtaggaagagacaggacaaaagcgagtataaggacggttaattcttagtgagtatgtagtatgcgctaggccctgttctaaggatcttacatatatagttcgtgtaatcctcccagcatcctgtgaaatatgtattattatcaccacctttacaggtaaggaacctgaggcacagataagttaggcagcatgcccagatcatacatttagtgttagtaatgaagttaggacttaaacccaggcaatcgggtacagagttcatactcaaaagatgtacaactgagaagaaaaaaaagtatgtgtgttatgtatacacatgagtgtatgcataccatgtacacagctagtcacagttaactgtataatcagggaggtaggaaagactagaggggcctctccaatgtcatgtctttcaaagtagactcagcttggtggagttgcaactctgtcaccaattatatatacctgaaagaccagctgtgtcaacattagactgtttatagaaaggaaaaaaaaaaaacctctaaaattgctctgaatgttatattgatttgtaactcttcacttcttacaaagtaataagctgccacattaagggatgcaatatgtgttgctgcattaagattgtaggcatcagcttaggaaaatgatatcataacacttagcacagcaagttgatcacttggcataacccagttgttctgaaatgtttttcttgcacaatgacttgcatctttctgagttcatcttactttttaccatttcacacacatttacacactctaagatgtcttgccctagtctgtcttttgtcactcaaaggctggaaaggagatcccaaagctgaaggacatacaaagctcaagcctttgtatgtctttgtatttctctgtatactaacatcacagcctaagagctcttcagagctccacaaggcctctacagactccatgtgtgatctgctggcctcctctaacaacatgagaaacacttaaacaattttaagaatagaatctcttacaggaatgataaagtacagctattcagcacttagacggaaaatcatcaagtagtgaaaattgttttattagaacctaacctcattggtaatgaggagactactgcatcactattagaataaaaatattcatataggtagatttattataaatattttagatgttcacaaataaaataaatggaaacaagcatgtaactgtgtgtgtgtgtgtgttcgtggctgtatgtggaaagagggagaggaagagagggaatgagaattaattaatataactaagttcgtcatcaaaagatacatggagtttgatagattcccatcatgttgacgtcttggttgggacaccaaatcatttaaattatttttcaggtttttgttcagaagacaatctttgcacatgtacaagattacattaattttaagaatgtggcattgagtgtctgtaaggatattaactttttaattccaatgatacgtcataatttgtcccctccttaacagtgttgggcttaccattttttacaagtaatgggacataaaatgttttacatttgcatttctttatatttataaaactgaggcactacattttgtatgtcactacattcatagacaggtttcagagcagctcagtatacaaactttggaaagaaaactgaaggatccagcatcctagctcactgccacaggccaccaactaagactcccccgtagacttgaatgacctcattttaatatttaaccccataggacagacactggcacttttctggattatgatagagcaaccaagacagatacagtggtacatttcttcagggggagggtttttagtttgaaaggataataccctatggtgaggtatgagcggaatcagtagtatattgtacttcactggagaatttgatggagacatgcttcccctggaataaactttatgtccctcattcaggggcagttttttaatggctttgcattgagcacaaaagatttagacaatttgcttctttgttttagggtagacacatactgccttttaaaggtaatattttttaagatgactgttagtaaattgttgaatcctcagcgtcaggcaaggaaggcaaacagtaatatcagagaaatgctacctgtgagcacattcttttgagtcattattaaatagacagtactattcatgtctaatctttgatcatggattccagactataatcagtttctcatgatctgttttattttgcttttaatttccctctgtgtattaggagtaactccctttgatgtttatctatgatccttttcacagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggtaccggcagttggcgatttgaggatttctttttatttattaaaaaaaaaaaaaaaggggttgaaaatccatttagtgcctagtcatgtttaatgctgagtctaactttttacctttgacagtgttctggaaagctgtttcacatctagggtttttaaaagccatgtagcatgaaactgctagcatcctaacttggttttacagtaaatactaggttcttggcattttttattatcataccattttatcagctcttcaaagaatgaagcaactaactactctatataattcaggccacatcctgttcaacttcaaggaagtatccaaattctttcatagtcctggaatttctttgtcatgaatgagtcccaggcttctttaaaacccatcactaagcaaccctgtgagccctcaccctctttggagagctgtgaaacttttgtttctatgccatgggaaaaaatccttgctgagaggaattttgggaggtaacagggctaaaaaaattctacgtgataaaggcttttaaaccaggcaggaatgattccctgctcatgtattatggcactgaatacaatgtttttggtttggggcctttatttttttcatggtagctgctgactattatgtgaacaaggactggaaaaaagtatctgtactgaattattcataatagaaaatttcattgtaacggggtcaacaaaacactaaccttggcttagatctatttttgttagaaggatatggttactgtaagggagctggaatggaatttgaaactggttctgtaatttatagaccacaacattatataatcattgtaatttatatttgaaacattcaggtattacctgtgtgatacatatactcacaggagattctgacaaaattggattatttccttactgaattttttttttttttttttttttgagacggagtctcactctgtcgcccaggctggagagcaatggtgcgatctcggctcactgcaacctccgcctcccgggttcaagccattcttctgcctcagcctcccgaatagctgggactacaggctcacactgccacacccagtttttttgtgtgttttttagtagagacagggtttcaccgtgttgcccaggctggtctcgaactcctgagctcaggcagtccgcctgcctcggcctcgcaaagtgctaggattgcaggcgtgagccaccatgccctgcctccttactgaatttttaatttatttgtattataaatgcctgtgttggttttttctaacgtgtttgcaatctgcagtcctacctgctacctgtcacccgtgttgtcactggggttaaataactgagtttaataatgggcctaatagttaatcaaaagtaaccatttttgaaaaattagtaatacttgcttctctcaaatacaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtagttaaatactaagcggacttgtttgtttttcctctaggtgacttgacttattcagtcggtagactatgatggcaccatattaaactgcatatatcatgtgttgcagtggttctgatagggcagttccatttacatgtatcacaggagctaataaaaagttattttcttctataattctacatttgatgaattcagtgagatacagaacaattatcactaagaaatgctaagcatttgtaataaaataccagtaaagtaggagcatgcaggtattctaaaaagaaccaaacaactgaaatctctaatcttttgattgcatgagctccttaagtagtagagagaacccactatgattagtgccaagggacttatatttagaaatagaaactttactgttggcctgattgaaaacacaatagaatactaatctattcataacctagaaagccccaacatttggtggttattgctgccataaggaacatgtgtgttcatagctcatcgatatctgttgactcactacgtagaggcctatttgctatttgcctgtaactagcaaatctttctgtgagctgaattttaaaataaagtgttatttcctgtatctatcttcattcattactttttggtttattttactgaggctattgaaaaaactattatcagacagtttatctcagattaatgccaatttccctgaatggtctaatttactcttctggcgaattaactgtagtgcagtaacttactaaccaggccatttctttttttattaaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgagtaagtatatgaaaattctactctgattataaaatactgtgatataataatatcatctataataacaatataatcttaagagctggaggattccatgtttttgagagtctagagcttctgtaatttttggatcccggctgggcacggtggctcattcccgtagtctcagctcctggggaggctgagacgggaggattgcttgagcccaggacttcgaggccacagtgagctatgattgtgccactgcactccaggctgagtgacagagccagaacgtatctctaaagaaaaaaaaatggccgggcgcagtggctcacgcctgtaatcccagcactttgggaggccgaggcgggcggatcacgaggtcagaagatcgagaccatcctggataacacggtgaaacccccgtctctactaaaaatacaaaaaaaatagccgggcgtggtggcgggcgcctgtagtcccagctactcgggaggctgaggcaggagaatggcgtgaacccgggaggcgcagcttgcagtgagccgagatcgcgccactgcactccagtctctgggcgacagagcgagactccgcctcaaaaaaaaaaagatacctctttctgagaaagaagacaaaattgcaagatacaagatgtagggccttggaaagggaagggactcgtgtaagggagaagcccaaagcttaagtttcagttggcttcatggtaaatttacctgtacttaaggattaacatcttgcttccaatagacctagcatcttagcaaaccttctgagaagcatcccgcagctgtggtttggggcataaagcctttggctctaggtttgcccacctgataaagctgactgtctcaggaacttgcattgaagaaaaacttcaaaaacatttacagtgaactttgctgattacgtagaagggcttaagtttttgtaatcgttaccagagaagctacactgtgcctcaaagaaccttacaactaaatgcaagtcaggaattgcagtttgttgcctgaaagcatgtgaagaggtaggaggctcattcagccagggtgttccaagagatagcatggagtggtggcccgggcactgtgctgtctgaacagtcacatcttgggagtcactgagaatgaaaggagaatcagctgttgagtatgttagggcatgtataaatgcattctcaattgcttgttcacttgactcggttgtacaagccatgaggggaaatgagatatgcagagatggcatgttgacaaacgcaaaatagtctttgaaatgaatcctgagttccttagtgtggttttcacaatgatacggtgaagcaaaggtacttctttctgtaggagcacacctctgaaattatcataaaagtcagtagaaaaaatgactcaatatacaaatattttctgtatagcttttctggaatgtgtcttatacataaagcttagttctcctgtagcttgaattgcttttcttttttgacagattcccttttaataaaatgaatgttagccagcagcatgattttgtcagaggaacaaaccttttcaattgaattacattaaaattctgttcttagcattccttttgctcattttagtatcgcaataggaaaggaataaattggaagttaatggaaagcacttcctttgcactgttttcaaagtgatcgcaggctagattgccaacgaagcaaaaaagagcacaagaaaagtgctgccatcagatgagactgggcaggagagctgctctgattctaagatcttcaggaggccgggcgcggtggctcacacctgtaatcccagcactttgggaggccgaggcaggcggatcacgaggtcaggagatcaagaccatcctggctaacacggtgaaaccctgtctctactaaaaatacaaaaaattcgccaggcgtggtggcaggtgcctatagtgccagctagttgggaggctgaggcagaagaatggcatgaacccgggaggtggaggttgcagtgagctgagatggtgccactgcactccagcctgggtgacagagtgagactccgtctcaaaaaaaaaaaaaaaaaaaaaaaaaagatcttcaggagatggtggcggcattggtagggtttcagtttagttgaaagtgggggaaacatagagaaataagtttttagtatagtctggtactcaagccctgctctccgggccatttttgaatatgtccttactcgttcccaggagttcattgtatggattagtgctgacacttgaacttcctacagcagatacagtggtttgcttatggcctacaaatgcattttaatcaagtttggaaaattagagaaatttcactggtggagctgatgtgggatagtataaaccaatttggattttttaccttttaaagaaatgatagtgcaaaaaagaagatatatttctctagtaacaaataacctccaagaatttcagacttaggaatcggcagactggctgaagtagaggttgggttggcaagccaatcttgtatataatgggaaaacattattttaaagaatgaaagattttaattaattaaaatacagcaaaatcacattttcaccaatacttattacatgtcatatttaaagtatatctattaaatcttataactagataaattgctgtaagggcaactacactattccaaaaagcattattaaaatatcttacaaaatatcaccctcacaattttatatatatccatatatataaaagaatatcatagtttaacaaaccagtgtttaaaaatgacttttctaataaaattagcagaaagactgcttttaaaaaccagcgttttgttaattttcctcataagctggctacagcaaagacgactaaaaaatgtctaagaaacctttatgcattttgcaaaataatgtgttaaagaagagcacttaacccaaggaattcagaatcatcgtgtcagaatgacaaatgatcattttttttcttcccatacattcttgtaatttggctgtgaaagagcaaaggccgcctcttctaagggtcagaaactttaaaacacattcaaaaggaaatgcacaaaaagaaaagggtggggggaggtgtcattatcaggccgcccctccagaagcactgtctgtgttcagacacagcagcacgtattgtctgtgtaagtttgagatggttaatgggcaaactcaacccctgtcgctactcatcagagccttgacaacagagtttctgctgcttgtctcccgacctgggtgtgcggcgggatgtgagcatcctaatagaggcagcggggggcttctgaatccccgtcggaatgcctttgtttttgtagttattggtgaactggccgactcccagaatattagtacgtgtctgtaatatttcccttcatttttagagtaccatgtgtctatgtgtctactttagaccttacaaagggcagcctgtaagttcacaaagaagggatttgacaggtttgacaatggccagagtgtcaccaaaaccacaacgagattgtgaaaaaaaattgccatcccccactgaaaaacacctgctttctgtgacttccatgacaccagtcccttgagctctgataacaggctctataatcatcttcctgcacaaatacctcgcacagaaaagttaaacttttcagctcaaattcccatttgtgtatggccagctttctgactatcctggtgtctaaaaagccttgagattaaagcttttgtaggatagaaacagatggaagaagatctggaatcaataaatttgcctactgataaaaatacacttgtcatagttccttccaaagaaattttaaaagagaattagttgcaattacttaccttacatgtttttcttggtacaaacttgagtgtaccattaacatgtcacagtattggtataagtacaaaatgaaatgtaaaagtatttcataaaatgcaaactcccattatctttgtggctcccaccactcctggaatgttgctgtgggtatagaactctcccaacagctatttgttgaatgaagaaatagaaaaataaatcagagatgtagacaggtcagtgtttatttgcagagaagagtctggtaaaaccagaagctggcatttgccaacgctccactgagagaacacctataaatgctcttttgcgttctaagttagttcacacctccgtaccaatactgaatgttgaaaatgttaacgttgcccatttttgttactgatttttaaaaatatttacccaatattgcatgtttgctcactgtattttgctttataaaataaggacttcctcagttgatcttcttattccaataattaaacaaaataataacttcctattgatagcactttcttctgaaatgttggtgttaaacacagaaaacttttcccatgcaaatacagttaaaggatattattgtatctggtatcaggaagaattctaggagaagaaagcctgattcccaataaggtttttatcaatcaccaataaagtaagtagggtgattcttcggggtacacagatggggtttctttagcatggtaactgtcatttcgaaaactagagatatcatctgcttcttggcggcagtttctctccatgttacttgtaattattatgtccctattgtgattcattagagaagtggccaatatatttagacatgctactggatggtatggtgggaagactacattaggtatcagatggtttataactcagctttgaaatcactgagttagactaatatgtttcacgagctaaataattattcattacggactgagtaaaccatcttggctctgacctcctcttccattgacttgctgggctgtagaaaggaccccaactagctaacagggtccccttgtatgaagacactgtgtcttcagtgagtattagggaccgcttcatgctgctcttcacaccacttaaaaacagtggccacacgcgatcattccttagccagagtaattccaaggaaaccaaaaagatctcacctgctaaatatttattatttaaaaagtttatgcctgaaaagaaaccgcggttcttacactcgaatgcacaaagaagtgaaatccagtgtattgaattggggaacagaatacgttatttaatagtaaatggcatttcacagttctctgcttgcttacccacatcaaatacaaaccgtttgggcatatctagaggctcttctgtctggttaaagaagacaacatgaaaaactatgaattctggccaatatgtacatgcacaccagcaggttagcgacatttttttaaatcttgggactttgaatatttggagctctgtatttgtggagctgactctgtgatcttttgtgagctatattcagattcacagagcaaataaatgagtttcagcttttacacattatgtaggtatatatgggtctccggcttctcatttgggtggtttattgtccctcattcaagcttttcaatttcagaatgagcttctgaaccatttctttataatgaacttaactcagtgcccatggcaaacccacgactcccactgacatcagttctcatgctgtaggagtgcctcagagaagggatccccgaagaggaaagacaggcaatgtgaacagcgcatgtgctacgcctaagcctatttcaagttcaaaactgtataccaaaagcacaaataatgcaggaaaacgcaatgataattattcattaattagaaaagatatcattaattagaaaagttatgcccattcttgttgacactgactcctattatttaaacagcctggctgcagtgccatgctgtgttctccttacaaaagtgaccactgcaatcgcttctaatgttagaagaattatagaggttatcggctgggcacggcggctcacatctgtaatcccagcactttgggaggctgaggtgggcggatcacatgaggtcaggagttcaagaccagcctggccaacatggtgaaaccctgtctctactagaaatacaaaaattagccgggcgtggtggcactcacctataatcccagctactcgggaggctgaggcaggagaatcgcttgaacccgggaggcagatgttgcagtgagccaagatcacgccactgcactccagcctgggtgaaaagagtgaggctccatcccaaaaaaaagaagaagaattagagaggtgtcttccacaggacaaaactgagaggatatcctttcctttgataagcatctgccatccaaccctaaaaactgaaacactgaaccttgcatcattgttatttctgccaaaaactgcattaaaaactgagcagcccactttataagtatatatgtatacacacacacacacttatacacacacacatatatatcttaaaatggtgctcagccacctgctttattttccttttcctttttctttcttcatgaaagaaaacatttaggagtttaagaatgatttgcaagagagtttatcagcagatcacttaaaatcatgggaaaattctatttttgatagaattttaaatatttgatttagtagaatcaaatagtttatttctatttttgatgttttgtttaattgcttaataatttttgctttaaattattaaccaaaacgtgtatttccagggacatcaataaaaaaatgcataggcaagtttctaaagtgactgctgtacatttcaagcattaacctgaacactatgaaggcaatacttttattaatacttgatctattccaattaccttctgcagtctagtttttaaaaatcattagttctgcccaggtttcaaaggagaaaaggaactggggaaagagtatgttgttcagattactcaaaaaattgcacaaaaaataaaaacagattagtcagattttctcagttcatcggctgtgtccctggagtgtgttgatagttgcaaggttgaattaactctttcagggtgttccatttggcaagtcaatattccggatgtgctaacttgttccataacggttcaagagtaaatgcagcttccacaagtgtccagtttcctctttaaactcgttctgcaactgtctagattagatgatttgatggcctcatatctgtgtgcatcatcagcttcccttacacggtgattgtcagatatttaccctaacactaagctgtgtacaccagccatttaaaacgattgataataaagcaataagtttacacatggacgatcagtgcaagagaacttttcatgttttacaatcacagaactgaagattgacaaatgagtgttttctggagactttgcagcatctgtggctcattcctctgacaataaaataaaagcaatgccagcagctctcactcctggatcccgtaactcctcagcctcccaggaaggtgttcagcacagagaaagtccctggcctatgtttcaggatcctagagtggtgtcagaatatcttgaggctgcaaatgcagaaccagtgtggacactgcacttctctttggagctctctctgggttggggaaggcagtctatgaaggagatagataggatggttggggatactatcatctacatgcttcaagtcaccctaactcctcacttagctacaccgccctcccctaccccatcatcaccactaccacttctcgtaaacacacgtactgatgatatacttcaaaaaagatttcctagacttcaagttcatcccaaagtttggtgaagccatggttcttcaagagagaccccccacaacttctagaaaatattgatgtaaagaaatactcctttgtagcgctctctaaaaactactttttgttctctttaagtgtattttaagagtgtaggtccgatataacttaagattttcccatgactgggctttttaataaaaaactgtataaaaagcaaaggctgaaaaacttatagtgtattttaaagtagttaattgattaagcatttaaagaatgtaagtcaagcatcagctagaagaaagatgtcattctgtttcaaactcaagaaaagatgggggcgggcgcggtggctcacacctgtaatcccaacaacactttgggaggctgaggcgggcggatcacgacgtcaggagatcgagaccatcctagctaacacggtgaaaccccatctctactaaaaatacaaaaaattagctgggcgtggtggcgggcatctgtagtcccagctactcgggaggctgaggcaggagaatggcgtgaacccaggagttggagcttgcagtgagcccagatcgtgccagcctgggcgacagagtgagactccgtctcaaaaaaaaaaagaaacgatggaaccaagttctaataaaggcaagcataagccttgccaaaattagaagaaagtactcatttatagaggatgatgtttttaagctaggtcagttagcgttatagtaataaaagaaaggttacaggaaccttatatctggaggagcagaatgtgagtgtctaaatgcatcagactattcctagagaagtcaaaaaatattcaggatgactaaacctcaaacctttaaaccctcaaggaaggtcagaatgggtttatgcagtggttatttataatttagagctagtgagaaatgttatgcccaggaatttatctttatgttcatatcggtgtatccatatccaatgaaagattagctcattcaccccttactaatttaataaagatttctagttttttaacttaatgtttaaagtgtaccccattctccttaacacaaacaattaaccacaagcataggtaatcccatatgggactggtccaggcaacaccagcctctgaggaagcacagtttccaaaagcagctatgccacctaaaagaaaatgaaagtcttttccatgctacattgcaaaggcaaacagattgacaaattattaaattatttcaaacctcttaggttttgataaggtgggaagttttctgtgctttttgatcatcaagcatttcctgtttagcccgtaatttcctggcattcattcattcactcatgtgctcattcattcagtaagaatttattatgtgccagctactggccttaggtgctggaggatgcagagctagatgacacattccctgctctcaaggagctcagagtccactgggagagaaagacaagtaaacagtgataagaatggtaagtgctaagatagttgttcgacaggccgtggaggtacagaggaggatcatctaaatccgattgagaactggggacaggatgaggcaagaaaaacttaccaagggaggtaatttttaagatcagtgttgcaagttgtgaataaaggctacccagaagagagagaaagagactgctaggccagaggaaagcatttacccaggagcagaacgtggcaggctttggaaagaacacacagctcagaatgacaggagcatcgaatgtgtgtggggaggagggagataagatgaaaccagggagggagatggtgcctctgcgcaagtagggcttgcaccgctacgtgaagagctggactgcgtggatcttccctccggggtaggcgggactctgttcaaggagtttaacagggacagcaacatagccaatctggtgacaatgtaaggatagatttaaggtagaaaagtaggttaggaaaggaaaggtaggaggcagtagaggtcagtcagtcattaggacatgaaatgtaacttgctgtctgaatgtaagaggtaagggcaaaagaggatcaaggatgagtttcctttttcccaacttaggtgactagtggacacggagatacggggaagaattgtaggttgatcaacaaaagatgagttccgattcgtaaattatgactttgagagtaccatggcacagtctagcatgtgattaaaaaaaaatgtctgattggaacttagaggacaattccaaagatgtggacacgagagctattgagagagccgaagctataagtgtgaataaaatcatattgaaagggaacatagaagatctggtgacaagtggaaaaaaagaaggtgcaaatatgtgagtttacagactggagtttcctgtggcttcataataaaagacaacagctgtgttaatactgaaggatccactttctcctactggatactctatccctaattttttgaaatcttcaaatctgtgtcttcccttgtattttgcatcactttctgtatttgatcttctttctttgctcccttttgctccttaactgcccaaatgtggccattcctctgcctccccttacttcttgcactttgctcaatgttcattttctctcttaaagcttgtgagtaggtaacatcttagtctccatattctctcatcttaggctttttttccttacccttcctccttactcacctccgtttcccaagtcattgacactcatgagatgaaactaaaaacctgggttccggtcgcgattgtgtcgcttactcctaactgcatgactgtgagagtcagagcccctgtctggattttcctgtcctcacctgtaacatgaaaggctccttagtaattaaaaatcacttcctattcacaagaaaatatgtgatttttaccatttccttccaacttctcataggcccctgtcaaggtgtattccaaaagaaataacacttaacaaaagttaccaaatttcctctgctaaaacagttatgcatattgcatattgcatttcggtcaaactagtatcttatatgttatgttggtggtagaaatagcaatttatagtaataaatagaattttctctttccaaatgtgccacctactttttaaaaatctttcccacttactagaagcctggcacagccctccttgtcctcgctcagtgccagggtgtggggtctgtgtacggctgaacaggcaccaggatacaaggagaacaaaagagaaggaggggtttgtcctctgagcacttccagacccatggaataaatccaggaggatgagggcatgcacagttctgttttacagattctttggagcaaaaattttcctcgccatcagctgtctaggaggtctccatttcaagaccagatagctaaacaaataagctgtatcctacccatgtcagccttcctcactcgataaacaatttaaaaaagaaaaaaaaaagacagactgtcttaaacatgattcttctcttaatgatggctaacccagaatccttcgaatccctaagggaactaattctggaatgccctgacttggatggctttgtctcaaggcctgtgaatttcagagctgggcattatcactttgtcagttctccctgatgtggtaatgactatgaaaggaaagaggcattgggtcactatttttgaatttgattcttgaagaaaatgtcatttctgtgaccatctatcactatgctcagcgttcaaaagggctggaccagagaggagtgggggaggctctgcccttgtctacatgcctctgaactcatgttagctggggggtgtttgaaaaaaaaaagaatagcagcttgactgcagactgctaccctttctggttttatggagcaaagcacgggtcagaatttgccccatcagcaagacctcctaattaaatgcagcagcaacaaagacattcgcattggggttaccaacacccaccccatacaattctcacccctttctcatcaggatccccttagcaccaagaccaaactcacgtaaaataatactttcttttgtcttccttcttttgcattttccctgccatttttgataataggtaggtagcaggcaggggagtatcaggtggtgccatgatgtgggcgtaggcgactgctctgtttcccttggtgatagaagcattttctatccagaacctgatttttgaggatttcttactaccttgctacaaattatgatttgtctttgagatgataattgttaaaatacataaaccataggttccttctcagaagacttacatgtaaaatctttcgctgttgctgttgcaaatcacattattgccattaagattccgcatcagcccgccgttccgggttcgctgtttgtgcacaagtccctcctcaggaaggacgatcaaggagtgatttatgcctacatgtttagtcatgacggggttagtagttgtgttccacttcacctcaacaacagatacgaggctgttacaaattagcaatgtgggaaaagtcttgcggtaaccggtgacaagatggaggggattgtttgtttttgttgttgttggccgttaaactatggaaggaaatttgagcctacgcaactctgttagatggaagaaaagattctccctctgtataaaatgtgtgtgtgtgtttctgggtgggtgtgtgtgtatattacatacacacgtatatacactacgtatactatatatacacatcacacacatacacattatagtgaaagtgggagaaagatgggttaattaagtccttcatgtgagttcttactgggatccaagtctgaaagcaaacccgtgtaacccacgaagcagctctcaaaagcaggctagctctgggatggccctgaggaagacccgaggaaggcccactcatgaggaaacttgaacatttatcccatctggaggccttcagaatgaacccaaaccaacatctgctgctgtcttgcctgcccagaacaggcttggttttgaccggagaaagcagtcacatttcagtgactctcactccggcttccctaggtgaaaatgacagaggtgtggggagggcattgccgccagtatatacgtaacgacatatgctggtctcgtgtttgagtcgggccagttcagggtcaggctgaattctggactgacaatccacagaagggataaagagcacgtcactccgcaaaagagcccacctccagagttagaatgacttctctgccctggtgtatgcgcttctctaaagctgtgctctcatttacacgtacttttctcaaaagcagaagataattttaaaaacataacctttggttaaagaagccattttatggggaagcaccaaagacgataaatactcctgttgtcaagttgtaaagaaagttttcgagaactgcaaattgtttccacttgaataaatttgcaacatcaataggctgttgacattgggttggtaacagtctaaatcacttgattttactctcagatgagcatctactgaagatgtttaagtagaaaggtattataatcatggtgtttcagattgatttggtatcagtgaatatgggaagaggcagatagacccattttaaaagtctagggaagctctgggaatagaaagataaatatctgagagacattaccaaggaaaaggagaaagttaggagcttcacgtcaggttgaatatagcattctcagctgagaatgactgaggctgtgattctccgaggcatttgtcgataatcccactacttaggaaactttaaaaagagatttaaaaatataccacaaaagctaaaacagcaactaggcaaacatgcaatccaaattaaagaccaacaaacagataaacatcaaataagggcatctcatcagtggaagagcggtaggtcacggagagcctgaggaagtttgtcctttccagcgagagtcctttgtaaagaggggtcaggcaggagcaggaaggaatgtgctgtgttatgaatttgaaaccatgaggctaaggccagaggaatgcaatggggggcatgaagttgatgttctattcaaattccctggagcctattgcattgtacattcaaaaagctaataaaggaaaactacctctcaaatctataagctgggcagggctagttcaccactaaggccaagcaacgttcagttgagtcacacagttgcaaataagcaagagaatctgaatccgcccagaggcatatctagttgttggaaaggtctttttaagacctggagtcagagtatttcagaggctagctggacattcgtgggtgcattggttttcttcttttgtggaggtaaagaagagttagcctgatgtttatggaagtacctgagagtcgtctttgaagacattttctttcactcccttagtcagagtccccgggtcatttttctgatgtctttccttcatctcgttttcatttctgttgacataggtgctaatctgtgaaaaagtttttactcgtccgcactgaaatgaaaaaaaaaaaaatgatgtggagaatgttttcatcataaagctttattcattgcttttaaagagcagtcctaggccgggcgtggtggctcacgcctgtaatcccagcactttgggaggccgaggcgggaggatcacgaggtcaggagtttgagaccagtctggccaagatggtgaaaccccgtctctactaaaaatacacaaaaaaattacagaaacagtggcaggcgcctgtaatcctagctactcaggaggctgcggcaggagaatcgcttgaacttgggaggcggaggttgcagtgagccaagatcgcaccactgtactctagcctaggcaacagagcaagactctgtctcaaaaaataaataaatacataaataaagaacagtccttttggccgggcgtggtggctcactcctgtaatctcaacactttaggaggccgaggcaggtggatcacctgaggacaggagtttgagaccagcctgaccaatatggtgaaatcccgtatctactaaaaaatacaaaaattacctgggcgtggtggcgggggcctctaatcctagctactcaggaggctgagggaggaggattgcttgaacccaggaggcggaggttgcagtgagccgagatcatgccactgcattccagtctgggcgacagagtgagacttgtctcgaaaaaaaaaaaaaaaaacagttcttttgaaagaactcaccctacaggtaggtcccgcctctctttgatatgtttaaatggccttatgaaacgatgggagtaacgggtagtagtttttaatttaaaaaccctgtgttgatccctgatttttttcatggtttgtaaaattggcaagtcagggagccactctcacccccaccttaggttcctcgttaaaaccccgctttctttaaaccttcttcagcacctcatgttctccagtgaggagatccacccaaggctcccttccagtatgactctgtgctggccactgtgcctcagccgggcccctgcaccccgacaccttcctccgcagccctcccagccccacccgggcccctgcctgactgcctgatcccacagtctagttcaccactaaggccaagcaacattcagttgagccacacagttgcaaataagcagagaatctgcccagaggcatatctagttctattccgggacctggccaggtccccacctgggtgcagctcttccccagctatgtcagcgtgaacacatctccccttctgctcactctggtgagtggtagcctcacaggacactcatttgtaatagttaaattgtcacgtatatgacctctgctcacccagacttctctgttttcacaatatcctcacgctttagcttgcacggaaaggctgttctgaaactgttgggtgccgggttagataggagctctgaggaccctgacaccggagcagccttccttgtgcaaacacttcagccctgttagtgcctgcacttagcttcagctactccttagaaggcacaaattcagaacttccagggctaaactgttaagctgggccgctaggatcccagcttaaccctctgtcattctaactgtactacctacaaaggttacttgtatttttatttcccaaagaaccaaaggctaataggtgagagtctgaactttcagcttcctgggctgtatctccctgtgccgaggatcctgtgatatagaatgcctgcccagcagggaatggaatgtgtggtaagccaatgaaagagcaaagtcagaggttgcagaaatgctttctacaggagaaaggtgaagtttctgcttcagattgaatggggctagaaaatataaaccagcaaaagggtcaaaaaagggcagaggagaatgaatcagcaagctgcttgcaggtggtacaatctatataaagctagagttcccagctttaaatcaggcactgtgatctacaggagggctagtgggcctggggtcagctgcacaaaagtcccagttatggtccagtcaagagatagcgtgagagccagatcaaatcagctaaccacgtcgtattttcattttccgtctctgaaatgggggggggggaaatagtacaatacagaattctcctatgtagaggcattcaaaagggcattaattttttttaacccgatagcacgttcttcacatcataccatgagatgtgtaatctgctgcaagacttatgccaaactgaacgacagaactttaggctggttttgtcaataattctgtaactctgcgctgcttgttcttaaataaaccagtgcgtgtttgtttcttcaagagcagtaatttcttcaaaaaagcgatcacagcaataaactctgttggatttctttcatttatgccttcctttgctaggggcgtttgggttggtggggaggacatcttcagctctgccttttgtgagtctaaacaatgattccacttaatggtgcattggcttcctctgtgtctccatccctggcttctccctcctgagtgcccgttcctgccgctggctgagcagcgtggcaggttgtcagatcatgtcagtcaaacccatgatctgaccgatactgtccccaccgaattaatgggatcagctcatcaccgggcacggaacagacctccgtccctcgccttcctcctctctttcttccctctctctactgtaacattgtcctggcggagtcttctctgtctttatcacctagaatcttctcctgatgaacaaccacatttttcaaaatgaatgtttcacgaaaaacccctatcatctcataaacaagtgaaattgaaaaaacaaacaaaacacctctatccttttattcccaaatatcactcaagtaccttttttactcctcactcctgtgtggccccgtgttttcacctacgattatgatcccctgtcactgttttcctgccctggtaacctgtctttctctaacagcattgtttctctgttagttctgtgtctgggcttacttcaagtaggatgttgattcaggtctccatctcactgggaaccttcgattagtgaagcagtcttagaatcaatctgaaatccaccctttagtatattgtggtcccaaggaaactcctaatttctcatccagatttttgcttttttttttttctttcttcagacgacaccatcatttttgaaattttctctggtgctgccacaaatagaaaagtcacaaaaattcaattcttcagtcaaatgttgtatctatgatgcatatttatgagcacagaacagcttttaaaatgtattttaacactcaaattataagttactcttgtatttgtctgctaaaaagagtaagtgtgtaaaaaaaaaacaaataatcattaaatgtcaggaaatattgcatctcatttcagtgaacacagtaaatcaccatgcaagatattccccattctttcaatatcactgtagacaagatgggttatcatcaccactgccagcattcaagctctaatttaccattatgaagtatgtcaatcactgagaaataagaaagtctttaaaaggttcttattttattaatttgttgaagatgtctgaagatactaaaaggattttttacatatgcaaatacatacatgcacgtaaacatactgtactgtactgccaccgagggagtaagtcagtaaatctttaagaactgatgtaacagtgaattaaatctactttgtagaaaatatgaaggaatactaaggaatttaatatcagcaaacatgttccctttgaaacagcaaattagatgtgcaggaggattttggtcacacttcaaagaatcatgtgctgagatggagagctggtctgtttactcgtgttctcaccggtgaggtttttctatgttaaacgggtttttgattacttcaaagcatgtttgaagtcttcactctgcatcgctcatccacgaagacaaatagtcctccaaatttgtgcaactaatattgctacacattatatttataagtcagaagaaactgcagtttcctatttaacaccaagttaatgcctcttgtatttagctatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaaggtaaacacgaaagcatcattttaaacaagtaccaccagcacccagacagaatgcggcaacacccactttccaaggtgaaccagaaaagggaaggtgaaaatgtaaacctctagaaatattggtgacataatctacagtgtacatgtaatatttatttacttgtatagacatattttaaaaccacatataagataatctgtcatccttggaatagtgtctgtttccattcccatgtattaaaacaacttcattccagcccttcacatgcatcatcaggcgatttttgcatcacctaagagttttccagagcaggtcttctgaccgccatctaagtacagtagtttgagacacagcactttttgaggccatatgtgatgcagtattttaatctgcatgtcatggaaattttatcccaaattccaactacacattcatgtaatgcctggagtgtccattttttcattccatctatagtcatatagatgccatatctccataatggaccctccttgccatattcctttctaaatttgaaaaagcctgtctacaatgacatttgtaattgtgagttcacaactctaagaataattactaaatctgtattcaactttttgactcattttttttacctgttccatgaagtaatctctaaccatctaaaactgctattgcttgaattcattccttccccaaatggtcctatattatttcaaaattttaaactgaggcagtagtctacaatatgagcttttttgtataaaatataaaatgtcttcctttattgaagtcaatttcggagggaacattgctttctatttttggtattcaagatatagatattaatcctttcaaaggatctttgacagaagatgcagggattgggtgcaggggagggaagtcttccaagaccttggaggtgtgtacaccgcgctcctgagagatcacatatgtgcctctttacaaaatatttacttagtgcacatcccatggaagctgagctctcatttcatcaggcaaatgagaaaaagaagtctattaaactgcagaaggacttcaaattcccctaaagtttgcctttaatatttagccaaacctctgacagcatgaaatgccaaggatcaaagttgttttgtttctttctaaaaggacatcatcaggtactccttattcctagtcaacttttagaaatttagaacctatctcacggcacaaccggccaagtatttaatccatatctaatagttcatgttttgtgcttcttgttctttagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggtacgtacgtgttgtggagcaggagatagctgcagccctctgatctgtgcagatcatcctgagggcaggttgcgtctcctgctcacccccctatgtctacactgagtatgagcacctcgctcagtgtggttccaatcccacatgggcctgttctggcaggtgcagctggggaggctggagggaggtcaggtcgtgagagggctgagaagaaaaagcaataggacactagagggaaaaggagatcaggagtgaaggtaaagccatgaccatgaaaaccagctccagacatcttccaggtcactttcacagagctatggtccattcccaaagcggactccagctgctgctctttgttctgctgagccccagacactgccgccacctgcatccccgtttgctgcctctactcactgctgcttcccagggcccctgctgccttgggccactgcaaacgcaaggctagttcacaggcctcctcttgctcagctgtcctgaagcaggggtcacatgcacgtgtgcacacagcgtcacacctgttctcagatgcaggacttcatcaaaagacacaaagacatggatgacagctgtgcccctctctctgcataccaaagacacagcacctaactagggttcaaaaaattatgggttccagatgaggctctactttttgctaatagtaaaccttatgggagaatcagaacatctctgaatctgtttccttatctatatcatggtatccatattatgatatagattacacattatctaaataccataacaagatagataggagatatgtagatgatagatagatagatagatagattatatatatatagatagataggagatatatatagataggagatatatatatagctatattgcagataaatgaaatttaccctatactacctctgttttacacagttgttacaagaatcaaatgagataatgtgaaagtactttgaaaataggctgggcgttggtggttcacgcctgtaatcccaacactttgggaggccaaggtaggcggaccacttgaggtcaggagttcgagaccagcctaggcaacatggtgaaacccatctctactaaaaatacaaaaatcagccaggcgtggaggtgggtccctgtaatcccagcttctcaggaggctaaggcaggaggattgcttgaacactcgaggcggaggttgcagtgagtcgagatcgcgccactacactccagcctaggagacaaagcaagattctgtctcgaaacaagaaaagaaaaggcatggttatatattccctgaccctaacgcagatagcctcttctactcacacaccagatggataggaaagggctgttgagcttgctggatagtaaaatttcactggaaagagggaggagggggaaatactttgtccagaaactgaccacataaccataacatattgcctgctgttcttggagacaagttataagtaagtgtgcactttttttttctttgtaatactgctttgcaagacataaaaggaacttaggcagatgagagggaaagagaggaaacccagtctgaagtccctggttctctgcctaatcctaaatgaagaaaatacctcacttgaggaaggaagaggccagtgcacacaggcatgggtgttactttctttctaaatggcagagccacaatgcctcagcaagacgttttagaaaatacgctatttaaaatggcctgtgccatcccactgaaaggagatttccagctgatatgtttgattgctctcggagagacaatgccaagatcacaagggagggcttcttactttcaagataagattggatgtgccagctctgactgctaatttcattcctctgtggattctaagggagaaattctagggagaaagtgatgatatgaaaatctggtttaaggactgagcctggagtctgccaaaatagagaagaggggagagaaggggaagacctgagcccaccaagacagtgagaatcagcccaaagagccacccatttctcttccactctttcctgagacagaggatgccacctctcttaccttgcattatttcctagcagaatgtcctgttcatttttaagttgttgacctaaatttagctatgtgcctgtcacatggtggacactcaaatatttatccaataaatgaaagaatgaggaaagccagcctcacaatatgaattctctctgtgccattgcacctagatcttcccaagagaggggctatgtgaacacatccttgcaaatgtttgactgctataaatctaacactagaaataataggttaaatggagataatagagatatcattctctctgtctatacataatgtgtttatgtgtgtgtgtgtgtgtgtgtgtgtgtgtgtatttcttttttttttttttttttttttttttttgagatggagtttcactctgttgcccaggctggagtgcagtggtgtgatcttggctcactgcaacctccacctcccgggttcaatcaactctcatacctcagcccaccaagtagctaggactacagacacacgccaccatgcccggctaatttttgtatttttagtagagacggagttttaccatgttggccaggctggtcttgaactcgggacctcaagtcatctgcccgcctcggcctcccaaagtgctaggaatacagcatatatatatatatgctgttatatatatatatatatatgtttaaaaagtaaaaaaggcagggagtagaaatggaaaaatcatataagaaaacagcaatgtaaaaagcatttctgtgaaacagtacattaggggacaggctggacacagcagaaaataacaagcacaggaaactgtgatagagatgtaaggacgcagaataaagacaaccattctgtacttacttgtttgcagctcatttttttaaaaagacacatagatagcagttgcttacctgtgctttataatatttactaaatattcctaggttttatcagggctggattgtagaacctgccttcagtcaattacaaaaaattgtcatggtgttctaataataaaattcatcccctaaagctgcccagattcagaggcttagagaaaaaaaaatcgtagtgaatcattttaaaaaagaaaatctcaaaatttgaaagccaaacgtgtgtttaaaggcatgcataaatatgatagtgtatttaaatctcattatgccagtcacatttgcgtagtggcctatttctcactttaatctgagcggcacggcctagcgtgggacggcacaatgcacttggcacctgctgatggagcaggcacacaaaacaacctgtagcaagttgatgctctaccagggacaaaagagagtcttgatatcgccacccagtgtactggggaatgagcctgcccttccttacttccccccatgacatcttggctaagtgagtgtaattccatctgctggtatcactccctgggaaaattgtgtagcgtcatattcttttcaagcatattccagagggaagattatagctgcctgctcccaacatcaaagtgatgttgtgattaattacaatcatgctggacatgatctttgaaaatggagatttttttccatgcttacttaaaggaagtatacatcacaaaggaattcatggtgatctcattcatacacaacaaatggattcattttcatatagctggaggtgtagcagcgatctgagataaggtttcacttttagattgttatttaagtgtgtgtgtgtatgtgtgtgtgtgtataaatatatatttttttctttttttttttaatgtcttgaagaattgttagtacttttagttttattttagagacagattttgttactggttttactaagaacaatgtgttctttttttttttccttttcttttttttttttattatactttaagttttagggtacatgtgcacattgtgtaggttagttacatatgtatacatgtgccatgctggtacactgcacccactaactcgtcatctagcattaggtgtatctcccaatgctatccctccccgctccccccaccccacaacagtccccagagtgtgatattccccttcctgtgtccatgtgatctcattgttcaattcccacctatgagtgagaatatacggtgtttggtttttttgtacttgcgatagtttactgagaatgatgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttatagtcctttacccagtaatggggtaatgggatggctgggtcaaatggtatttccagttctagaaccctgaggaatcgccacactgacttccacaatggttgaactagtttacagtcccaccaacagtgtaaaagtgttcctatttctccacatcctctccagcacctgttgtttcctgactttttaatgattgccattctaactagtgtgagatggtatctcattgtggttttgatgtgcatttctctgatgtccagtgatgatgagcattttttcatgtgttttttggctgcataaatgtcttcttttggaaagtgtctgttcgtgtccttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcgcatgcctatgtcctgaatggtgatgcctaggttttcttctagggcttttatggttttaggtctaacgtttaagtctttaatccatcttgaattgatttttgtataaggtgtaaggaagggatccagtttcagctttctacatatggctagccagttttcccagcaccatttattaaatggggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgaccagtggtttgtagttctccttgaagaagtccttcacatcccttgtaagttggattcctaggtattttattctgtttgaagcaattgtgaatgggagttcactcctgatttggctctctgtttgtctgttgttggtgtataagaatgcttgtgatttttgtagattgattttgtatcctgagactttgctgaagttgcttatgagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcgtccctgtcttgtgccagttgtcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattcttttttgttgtgtctctgcctggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgtgtagaggtgtttgtagtattctctgatggtactttgtatttctgtgggatcggtggtgatatcccctttatcattttttattgcatctattagattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggaacaggttgttcagtttccatgtagttgagcggttttgagtgagattcttaatcctgagttctagtttgattgcactgtggtctgagagatagtttgttataatttctgttcttttacatttgcagaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaaccccggcctttttttgttttccattggcttggtagatcttcctccatccttttattttgagcctatgtgtgtctctgcacgtgagatggatttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgactttgcagcagctggtactggttgttcctttccatgtttagtgcttccttcaggagctcttttagggcaggcctggtggtgacaaaatctctcagcatttgcttgtctgcaaagtattttatttctccttcgcttatgaagcttagtttggctggatatgaaattctgggttgaaaattcttttctttaagaatgttgaatattggcccccactctcttctggcttgtagggtttctgctgagagatccgctattagtctgatgggcttccctttgagggtaactcgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatacggtcttttcacatagtcccatgtttcttgggggctttgctcatttctttgtattcgtttttctctaaacttcccttctcgcttcatttcattcatttcatcttccatcgctgataccctttcttccagttgatcgcatcggctcctgaggcttctgcattcttcacgtagttctcgagccttggttttcagctccatcagctcctttcagcacttctctgtattggttattctagttatacattcttctaaatttttttcaaagctttcaacttctttgcctttggtttgaatgtcctcccgtagctcagagtaatttgatcgtctgacgccttctactctcagctcgtcagtcattctccatccagctttgttctgttgctggtgaggaactgcattcctttggaggaggagaggcgctctgctttttagagtttccagtttttctgttctgttttttccccatctttgtggttttatctacttttggtctttgatgacggtgatgtacagatgggtttttggtgtggatgtcctttctgtttgttagttttccttctaacagagaggaccctcagctgcaggtctgttggaataccctgccgtgtgaggtgtcagtgtgcccctgctggggggtgcctcccagttaggctgctcaggggtcaggggtcagggacccacttgaggaggcactctgccagttttcagatctccagctgcgtgctgggagaaccactgctctcttcaaagctgtcagacatggacatttaagtctgcagaggttactgctgtctttttgtttgtctgtgccctgcccccagaggtggagcctacagaggcaggcaggcctccttgagctgtggtgggctccacccagttcgagctccccggctgctttgtttacctaagcaagcctgggcaatggcgggcgcccctccccaagcctcgctgccgccttgcagtttgatctcagactgctgtgctagcaatcagcgagactccgtgggcgtaggaccctcccagccaggtgcgggatataatctcctggtgtgccgttttttaagcccgtcggaaaagcgcagtattcgggtgggagtgacccgattttccaggtgctgtccgtcacccctttctttgactgggaaagggaactccctgaccccttgcacttcccaagtgaggcaatgcctcgccctgcttcggctcgcgcacggtgcgcgcacccactgacctgcgcccactgtctggcactccctagtgggatgaacccggtacctcagatggaaatgcagaaatcaccgtcttcggcgtctctcatgctgggagctgtagaccggagctgttcctattcggccatcttggctcctcccccatattttttttcttgagacagggtcttgctgggacgcccaggctggagtgcagtagtgtgatcttggctcactgcagccttgacttcacaggctcaagtgatcctcccaccccaggctcccaagtagctgggactacaggcacctccacacctggctaatttttgtatttttctacagacaggatttcaccatgttgcccaggctggtctcaaactgctgaccttaagtgatctgcctgcctcagcctcccaaaatcttggaattacagacatgagccacccctcccggtcttaacctgatatttttaataataattaaaaatatttattaaaaggctaccagaagaccagacgcagtggtttacacctgtagtcccagcactttgggaggctgaggcgggtggatcacctaagcccaggagtttgagaccagccagggcaacatggggagaccctgtctctactaaaaatacaaaaattagccaggcgtggtggcgcacgcctctcgtctcagctactcacggggctgaggtgggaggatcacttgagcccagacagtcgaggctgcagtgagccaagatcacactattgctctccagcctaggtgtcccagccagaccctgtctcaagataaaaaaaaaaaaaaaaaaaaagccactgaagcctggaataatgctggtactttatgactgtaacaaaaaaaaaaaaaagacttgaaaagttgccctgacatcataaagatgtggtgaagcaagaccatgtcctggaacgcaggtgccccttgtctgttcttttgttcacaacacccaaaggagaaggtccaggcatggtaagggggtgaaaaacatgagagctcttagtatcttttgaaatgttccgtactgaataacagagagcggtgtctggaaacagtaagaatggttaaagccttggcttgtgttgggaatttgggaaaaaacatagccacattctaactcattcctcattactttggtttgaggatacaagaaaggcacggcatccagtatttgtctggataaaagaaaaatcataccttctgtccagatgctgggtctcactgcttccaggtgcttgtccaaggcacgcacagtgatggcatcatctgacttgcatctgggtgtttcggtgtcgcctagccacactcacaaaccaaaggtgcaaatcggaagccagggctgggcacggtggctcacgcctgcaatcccagcactttgggaagcggaggcgggtggatcacctgaggtcaggagttcaagaccagcctggccaacatggtgagacccccgtctctactaaaaatacaaaaattagcaaggtgtggtggcacatgattgtaatcccagctactcaggaggctgaggcaggagaattgcttgaacctggaggaggaggttgcagtgagccaagattgcaccactgcactccagcctgggtgacagagtgagaccccgtcttaaaaaaaaaaaaaaaaaagaaatcagatgcccgagcagcatggggttccatgcctgtctccctacagcagcacgtcatatccactctgtggtccagatttcccatactccaaccaggggaaataccgcagagatgaaggagggtccaggaagcagtaaagaattaatacaaattaaaatgaatgccaaggaaaatgcaaacacatgggcaataataacatggcagcactgtccctggaagctacagtcagtcttctgtagttcctccaaagcccgggataatctaaggaagaaaaaaagggcaaccttaaacattcagggtattttttcctttcaaaacacaatcacaggcgctcaagagccctaagaaaaccatttaaattgtgcaaaacctcttcttgaggcatccaaaattagagtgcaggtataagctgaagaacttgattctgccatttatcactttgatacaaatatttctacagactttaaaatatatatatgtaactagccggtagcttctttccaaggtacacaaagtattctacaaagctcaactcataaagtttcacaaaattcacataaggcagggagcaactgatatgcagacagttccgcatggaagctcagaaagcctccagctggctggtcagaatcgaataaaactcactgaaagacagagcctaagggatctaggccaacctctttatttacagatggacaaaacagactcagaggggttgaaagccaaggtcaggctgcttcaggtctggagatcaggcttcggactcttgggttcctcccccaaccaccactccggactatctgctgtgacacggtgttgtggggtttttgcccacatcagctgatagaactgaaaagttaagatgtaatttctaggccaggctcggtggctcgtgcctgtaatcccagcactttgggaggccaaggtgggtggatcacctgaggtcaggagttcgagaccagcctggccaacatggtgaaaccccatctctaccaaaaatacaaaaattagctgggtatggtggcaggcgcctgtaatcccagctactcgggaggctgaggcaggagaatggcttgaaccccgggaggcggaggctgcagtgagccgagatcgcaccactgtactccagcctgggcgacaagggcaaaactccacctcaaaaaaaaaaaaaaaaaaaaaaaaaaagatgtgatttctctccagggctctgcctccttatattttgtaaatcagctctctgggtgcttcccaccctcaacatcattgctttttagcttatcgagctgccattccacggacttcaccatactccccttgaacagccaataggaaaagtttaagcttaaggattatttttgcatgggacatgtttaatgtgaatgatagaatgcaaaaggcagttttattccaaattttacaaatatatatgatgtatgtatatacacatatatttatatataaacgtgagtggttgtgtgtgtgtgtaaaattggtcagctggatctgtccactttgaaggttctagctagaatatggttatgtaaaattaagatgttcccatttaatttttaacaatcaaaacagttaatgagcattttggaatgtacaagccacccctcccacaaaggtgctgtagaagaccagagaatgaataggccatggtctctgcccttcagaggttcacagcctgcaaacactggagactattggtaaagcagaatttaatcgggaccacatttctattgcaataatgaaggctgggttgtgtatgcctcggatggcagacggtaacagccagatttagtccaaggctctggacgtggcacctagccacagagactctatgacaacacatggtgctgaatttgtcagataagtacaatattcggatcatgtgtatgtgttagtaaaggactctgaagtccctgccagttaaccagatcttctccaaagaaagacgccttctcaaaaaactgtgacgttgcagcactgggccaaaagcaatgatcttgtttataacctgctgctattgaaactcattaataatttacagtaatgtgggttccaacttctacttaactgctcttcaaagggccagagtcacattaaccgctgtgttttatttaatgtagccatgattaatttactaagcaattattttccagtgtcttttgggggaggagcttggagtcatatgaacaggtgtcatgtttatcacctttagagctcctgaacaaactttaagacacatacattttggtatttttcttatcagttgctttagtttacaaaatttaattgaaatggttttgaacaaatgccaggctgtctttctgcttaataaaacattttaaaagagcagttaatctactgccttgcacttgtacccaagaagttgctaagttaatttactgacaaagagaatcaatcatcgtaaatggtgtttaaacaatactggggactccggtgttggaataacatgatttattttatcatcttgttggtgttgtaacaggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaaggtatgcctgcaaactaagctcaacaatagggaaaggataattcacatttttcagcaatcatccagagcactaaggggaaaaaaaacagtggcacatgactgagttccatttgttattcgaagtatcaatacggaagtcacattggcacagcagtgatgaatttctgcattagcaaagtagtttctccttagttaagttctactgtctgagacccttttaagtgatttatgatgtaaacaaataagcattaacgttgtccacctgccaagcttacacattgacaacattcacaaattagaccttgagcgtgtaagtcgcttgtaaataattttcgtgctagctcttccatttaagagagagccttacattagcacagttaaagctgtcagctttgtgttattcctggcagagcttcaacataatcataaaaagcatgtagatcctagttacgcattattaaccaaaagaggcgattttcttagaaagccacactttcgggtactctgtggcatctttcctttcttctacatataaaaggtaagcctcctagattaggctgttttccattcttgagaactatgcatagtatcaaaaatggagacttagaattacacgtgtgcaaaatgctaagttgtatgctgtgcggcttggggtattgactggggtcagaggaaatgaaagtaaaagaaagggaagaaaaaggaaagaacaatctccatgtaattcctttcttaagaaatatccaccgaaaagcatattcatggaatgtttcatttgcctttgagacaaaagttcgccctagaaaatgattctgttttgagttccggtagctctcagaccccagagcatggcaccaccagttacccagcagcgcgtgctacacactactcggcagttactgttccacccctcctgactgaaacgttgcacagaggaactcttgtcacccaaagaaatcacatcacatccatgttgtcactgtgctcccctcacacaatcttgttctttaccagaggtgccctggggaatggctcagtctaaacctaaccccctgaaccctgagccatcccaactaattccagccggcgcctgcacaggctactcttcctgagaaccagtttcagttccaaagctcactgtaggatgctacctctcttacggcagccccccacctctgggatgcgtccagctaggaccctcatggccaatccgtcctcttgcaaactcacctgtccgctctcatcagaagagactcacccttgagacaatgaaccacacctgttagatgacaagcccctaacgcaatgtttctaagtgggagaggatcatggcttcgttctggagcagttttcccaatttaaattcagtgcattacagagaagaataacagaaacatacaagcacaacccttaaaatgtatagtagtgatcataatggcactgggaaatgtttagagggagcccaggagcatatcattgagaagagccgctgtcacagaatgacaaaggcagtgaccaggatcacctgcatgcatccaggaggatcagaaaagacaacagacagatctttctcatcgtctctcccaaaacccatcaaatccacccagactatttcgatgttcttactgggataggtgcactaagccaaaacttactcatagcaaaacaagtaatattttacagaccaccatcaaatatgacttcagatgattccaaaagtaggtattcatgtgaattcggcaaagtccaagctttccttggaacaatgcaaactattaggaacaattctcaggacatttactacacaacctgcatgcaaaaattgcccctgggtctgcccaaagaggagattctacagaagctgaagtcaggcaaaggagaagtcccagcagggctcccaagctccacatcctccctgtgccaatgatgttccatttggcccagcgggttagaggaagcttcctcagagggaagagtcacccacagccctgtgttactgctgagcttgacttaaccagcctgggatgaccttctctcacatttgttggcctagtaactgtcatttgtctttcggcagtggctcatgaaatagagttcacttttaatacatttactcatttcataatttagcaccaaagcagtatgtagtccagaaaccatccttattgctcctgagatacaaatcggatttggtatccacagaaagaaaaggagattttattgtcagtacggatgccttgtaacaatttgcctgtatgtgtatatataatatttctattaagggcatttatagctctcattcaccatgtgattaatttcacaatattttttggtgtcgatgctttgtatacactttatccatttttggctaattttatgtctttatacaataatattgtgactgctttgcccctcccccaagtacactagaaattaaacatgatttgagtggttcttcactcagatgagggggggaaagccaccttactaaataattgctaattatggatagaactgcattccccatatgctcttttctcctcaaaatattgtctgtaaagcagctttgatcatgcctgtattatgactaatccagatccattgacaaatctgctggttggctatgaatgtctgggaaaataatggtactgtcgtgacaggcagcacattgtgaatctcgagccactaattgcagaacccctcacaattaagcatccaagcaaattaggcagagaaacgttaacaacacgcaaggtcaaggataactcaattaaaatgaaaatcattttctctagtggaatgtttctgtgcatctgtggtcactaaatctgcttttgcatctcccgttcacaaacactgagtaacagtatgttctctctttacagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacaggtaagcattttgattccttcccaagagctggaggactaccatcattagattaatacacaaaataactggaaatgcttttttaaaaaactttatactttactcaggcaaaggcaaatggctaaccttttaaatgtgtttatttctttatggaaccatagagaaatcacaaagggaaaatgagacatatttacttcctattctgcctgccattgcccaaggccacaagtttttgaaatgacatgtactcagtcatttaaagaaggggaacatgggggaccaaaaaacatgatgaacacagagtcccaaaattggagtcccaatcccagctcctctcccacaagttgtgtagctctgtaagcaagccatatgttttttgagtttccattcccttaactataaaattgggataataatggctaacttagggcacaaatataatacatgaaattctgcaacagatagtaactaccttacgaatgtgtcatgttgggtttttttaatacatgtgtgaagttctcatggagataattaaggtgaaacacaatacaaggtgacaccatttcatccctgggaggtgtttaattcctgcctcaccaccattgcctcaggacagtcacgaagccatttctcccatcagttgcttagacaatggatcctgtgtctggactcacttctgtcttcttacatcactgtcttcattgccagtgcagttcttgcatggtgacaatactaataggcatactaatttttccacgaatgtgggataattttcagggtacagatttaagatctttccaagtttagtgcatgctacctttttagttatgcaagatgtagaacatcagatcccacttctgccaccatggaacaaccagcatgtgaaacagacaaggtccttgcaagcattactctagttccctttagtgagctgacttcttcactcaacctctactccaagaattctgaatcctgctgctcctaccttccattcctgatatacagcaccatcattaacccctctaccacatttatatttccaggaggaaggttctttcctgttgtcttttttttttgggcttgatttaaggtattttggttttgttttggcttgtgttagatgctcctttaggctgcctcttttctagctcaatatttgaggcatactgagatgtctgttctctcagttctcaaaacagctctcaacaggttgccccctgttcatttcacatctgcttcctacctttccagactgtctaaagcatttcatatctcttccatgtgaaccagctgaaagtccctcctttctgcctcctgattcagcagcacccttattctcattcagggtttttcaatacacatctgccttcaaaccccattattttggcagtacttttcaatacttacggtcctctgattttcactgttatgcagacattgttcagagtaacagaatttttgcccccaatactccaacatttgggagaattttctcccaaaataaggccctcccacccccaaactcatatacactcttacatacacacaaattgtgtcactttgcatcctgtgtgaaccacttaggatttatgtctccccaccaccactactaccaccccatttcaaataaaaagaataccactggttttatagccatatgatgcctggacgaatgacctgccagcctggcaatgaggtgagagtctgtgccctagagaaggaaatgggaatcaagtggctctccatcattctgacaggcagtttaccactggttatttaaggggtgttgacaggggctgactgaaagtctggaaagcccacagctcctgaattcatcctctcctagcaacgtggactgcagggaatgccatagcagcattttctgaaaaacatcaaaagagagatggaacagcataaaatatattaggtgaaatgcaatttcaaattttccagcaatgtgcttaatatataaaataatctacacccaaccgttctcataaagctgcaagcctgctgagtagttctgtaacattataacctccagaatagaataaaagccttattctgagctgaatggcttttggagtcacatggcaatattttaaaataccaccttaaaggtttccgggttctctccccaaaaagtttgtctccacctgtgcacagtgagcctttgaagtcacaactgatggtaatcaggacttctgggcccttggccagttttgccagcttgcagcattcatctttgattaagaatcaactgttgattttaatactctcaatttaggggttttattaatagaaaatgggttgtggaagtccgcatatccttgggcaatcgctttggagagctaataacacacaacttctatttgagaccagccttgaccaactacaaaataaatttcgtttcttttctacaagtatgtctctctcctgctgctgtgcattgttcttacctttgctagcactgttactagcacaggctgcaacttagcaggactgatggcttacccagtctgtctgagcatctattactcgcatttttcgtagcatttgccatagttctgctgtgaaggttaccgtcttcatgtctaaaaacagtaggtttagatttgtaggacgaaagcaaacaggtgctctttttcagattattaattgtgaaattggattttctttttaaggtaagaatttaaatttatgaaaggacaaaacaaactccaacacctttcattctgaacattcttctcctagatgttaacagctggctggtgacatttggtttccatctgcacaatgctattcctggattccctgttcccaaatttgatttaacagaaccttcttacgaacttgtgaagagtcagcagtgggatgatataccggtaagaaacaaaaagacctacggaaaggtgataagtagcttgtgtcttatctacccatatctaatcaaactacccttgtgaaaactgtaccaaagacagtttttaactttttgactgttttagggaaaaaaaacaacacttcctctgcatttgtgttcaacaaaccagaggcctcttaaacaggcttaaatatgttttcagcaatgctaatgaaaacatagaaatgcagaagctcactttcgagtgctgggtttctaaaaagaaccccaagaaagcgtggacctgaaggcaaaaatacaataaacaaaagggcagggaactcatattacaaattagcaaaccacaaacaatgccacaaggttcaacttctttaaaaattaacagtgttttggccgagtgagggggctcacgcctgtaatcccagcactttgggaggccgaggaggtcggatcacctgaggtcgggagttcgagaccagcctgaccaacatggagaaaccccatctctactaaaaatacaaaattagcccggcatggtggggcatgcctgttatcccagctactcaggaggctgaggcaggagaatcacttgaacctgggaggcggaggttgcagtgacccgagatcacgccattgtactccagcctgagcaacaagagcgaaactccgtctcaaaaaaaaaataattaattaattaatagtgtttcataggaaaagattaaaaataaaaataaatgtcctctggtaaggctccacctacaaccaggaaggtttatggaattttcctgagaatagcagatcaagaggcctgtaaccattataagaaataaagaaatataatagaaaattgcaaagtcaaagctgccgcttcagaaagtggtacttctaatccccaccagagaccagaaaggaatgcacagcaaaacaccagaatttccagcttacagtaagaataattagagatggagaaactgggtgactccatgatcataaggagaagacagtgcagactttcttaggacaattaattcccaaccaccccttgagcaatttcctatcatttcaatgaaaacaaagagaagaggcagccatggttaacacacacacaggctatctacagtaccagtacctgttttttgttgtttcatacctaatataaaagcaattcctttttcataagttacaaatatagtcgtgtgtgtgcaacattttggtcaatgacagaccttgtataaggtggtgatcacataagattacaatatcatatatatttttttttaattgaaatggggtctcactgtgtcacccaggctggagtgcagccttgacctcctgggctcaagcgatcctcccacctcaggctcccaagtatctgggactacaggcacgtgccaccacacccagctaattttttattttttgtagagataagagtctccctgcgtagcacaggctggtcttgaactcctggtctcaagcgttcctcctgcctccacctactgaagggctaggattacaggcatgagccaccgggctctgccaacactgtgtttttactgtacctcttctatgtttagatacacaagtacttaccatggtgttacagttgcctgcaatattcagtacagtcacaccgtatacaggtttgcagcctagaagccataggccatcccatacagcctacgtgtgcagtaggctacaccatctaggtttgtgtaagtgcccgctatgatgttcacacaaggacgaaatggcctaatgccacatttctcagaatgcctccctgcggttaagcagtgcatgactgtctacactgatacagtggcatgaagacataccgaagtttcctaatgcatttgaacatgcacttcctaattgtgtatgactttccaacatgcctgaaaacacctacatctaactgtacaaatggacttgccagctcttttcctaagcagccttttaaatatggttcaagttctctgtcaaaagaagtgcaccataaggacagcataggaaatcgtgggcaaagacactgaggctgccccaagtacagaaaaacaactgtttctttcattgccgcaaatgaaacagatgttttcatttgggaaacaatggccagacaaacatctggtggtataagaaatggctgagttaagatgcccccaatttaaaacatttgccagtctagacggtccactgtccctaagtctgagaaaaataattgttttcctaaagtaacaaatatcgtctccagctgccccaccttccactcatccctgtacatttcagttctgcggttacactcaccatcttcagctgaaaactctgccaggagaggggacagagttgacttaaatacaagcatttcaaagcatacgaagcggggccctgtgatcggcactaagtatccccagccgttcagatccctctctgtgtttggtggcttctcagcctcctgtggagaaagctacgagcatgcagatccggatgagctgggttccccacgtggggtgggagtgggaaaagagcatctagaaactgtaagagaaaagcaagaaacaggactatttttcccatgttagaaacgaagaaagctttaaagtgatccacgatgagtgagccatttgggggttccagagcatcgggatcaccttgagggggagggatctcgagtgctccctccacccgggctgtcagccttctggtcagggaaggaccccggggcttccatgcatgccccggcgctgcccccagagtcccgtgtgtgggtcaggagtggggaggctcccggccgcctctgacgcgccccctcttttgtttcgcccgcagcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgtttttatattttttcaagtcttgggctagccagcattgcttttgtgtttaacgtggaggacgcaaatagatgcagttgttggggaattgattcatctgcaacccagttggtagtatcttttttttttttttttttgtccattggccagactgctggctcagcagagtgaacttcacaggggactctcccatggcctactttagaaaaacagtaaacacacccccacaaagccaaacacgctaactgtaaagaagagtttacaaaaataccacccattactacttgagagcaggcctcattcctgtgatcctggcaataagtgtgcttaattaaaacacttgattagaataatcagtttgggcctggtaggcttgcagcctcctggagatgtctaaatctacatatagaccggctgattagaagatgcttagttcagcaattctggccggcaggccagggctttgattttagtcggaagaggcagacttcatcacacttgctttctagtgacaacctcaactgcataacgtgttgatccagcaagaatcaggtcattccacttggcaaactggtctgttttcttctcctcgaattagactttaacatgatcaaaacggaattccagaaaaacaggcgaagtactgctttccttctctacagtcttttccttaaaagtaatgtctgaacaaatgcaaataaaaatggtgccggtaaaaattataccttagaaaaaataatctgaatatgggatatgctgctgccacatcccgtgaaatttgtctttacattcaccacacatatcctaacagttgcatggggttctaactgccagaccgcaacagaagggcagcacctgactgtaagtacttcaaaatcaggaccagtcctcaagcgcttgaaaagatgaggagaggagctggaggttacaacgagctatgatcgcagcactgctctccggcctgagcgacacaagacccagtctcttaaaaaaaaaaaaaaaaaaagttttttaatgaaagaatgccgttgatgctttccctatccgtgcccactcttcactccgttcaccatcttttctttctccttttgccctgggctactcctgaatgcagttgtttctctcgcctgctgacagcaaatcagctgtccgaggtgcttttggaaaggagggattcaagagaggaagccagaaggcactgatccacatcatgttctgtctgggtaaaaccacccgggcagtgctcacagccgctcgcttgctgttgtacagaggaggacaaggtccacctggaccaagaactgccaccacccatctggccggggcggggtgggtatcatttgatctccagcagagtggggtgagtctgcccctgggaagcctcgaagggcaacatattaagatctcacccttccatagatacccaaatttcctcccactttccttcaaggagtgatctgattccagcatcccagtccacaaaatgcatccccattccagaagctggaggtggaatggaattacagaaatgagttgtccaagttcacagaagtggcttaagttaaggtgagcagagattccctttgctagtaccctccactacatcacagcctcctcataacgctccccgggaagataccgcaaatactccttaccgccccccttcccatgggcacttgatctttccaaagctgccatcatttacagccaggactagcatttttcattctataacgatccgccgacactaaacaaaacagatgccttgagtgccccctctgcctgccagtatttctagctcctcacgcccttctgtgtaggtaagccaagtttgactctccatcatttccaaaagaaagaccattgggctgtttacctagattttccataagttattcatctggctttgaacatcctactagacccatgaaaaaataaaataaaaatgagttataactcattatcacccattttaaccacagagttaagccagagtaccaaacaggtactgataagccatttgaattttctaccttctcatttaagccacataatgaatgtcctctgtttgccagacttctcatttgctgttcaccacccctgcaagcaatggtctcttgatgttagttaattactaataacttttaggtaaattgagtaaaccttttcatttatgaaccgacttagaatcctgtcgtggaggaatacgggattcctagagtcccgtggatagagaatttactatcaaccgattctaagcctagagtaacatcattattcagtttagagttaatgggttcctcaaagcaaatttaataaatccttctgggatctaagctcaggaaaattaaaattagaagcataaattgtcacttttagggcaagagactggcttggtaacagtccccctgcttacagggtgaattgtgagctacgcttagccctggccacaggcattcatcctgtattatgcagggaaatctcgttcttccacctgtgtgcagagatttcctgaattccagccacagcggccatttctctatggcatagctcgctgcacacaactgtcaggatttacaagcggtccgctgggtcaaaatgaatttttaaaaatgttcacaagtgaactctatcaggggagagtgcggggagcataaatgcccaaggacttaaaatgacaaattctcgggcgtgactgaaaggctgaaaatggggcgctcagtggaggtcggtgaggaggctcaccaggctctcttcaacctggagttcttctgcaccgtggttaatgaccgtaggctggagactgccccatcccacaccttcctcccacacgaacactagggaaagtctagtctgcctgttccagagaaaattctgcaaaaatcgtccccagaactatctttgcatccacgatgctcgctctctctctctctctctctcgctctctctcgttgcaatgggtcaggttgaatctaaccctctctgtcctttaaggcttggaaggaatgccatagggctccctcggtgggccagggcgacgttgatgactcaggatctcaaaaggacctagagccagtctgtcatccccagtttcttaatttattgacaaaaggtaacgaacaagcagattgtaaaatatctttattcagctatgacatgatttccaagctcaaaaaaaaaaaaaaaaaaaaaaaatcaagcctggcgtttaacttcagtctggagcattgacaggtgacaggtcactgcagaacacagaggtgacccaaggcagagaacgggaggtagcgagaggaagacgacacccttccctgagtcctccctcatctggggcttccctctggccttcccctggggttcctgggactcggcttctgcggacatggaaaagccgtcccaacatccggcggccccgtgggcaggggtcctgggacgccccctcctgcatccccgggcgggccctgcaggggatggcggcgatttcaggaagggctccggcgccccctagtgacgcgcggctgtggtagggaaagtcctgcacgccaaaagggcagttcccgggccagaaaccgaggtgaaaccgaagagaaggcgccgccgctcgccgctcgccactctccaccccaaccgcggcggggccggctctctgaccctctcttccccacctctgctctgccctccgagtttcacacttaaagcggagacttctgcttcagcaccgccgcaccgaggcctgggccctgccaaagtggctcgggtaagatttccctgcacgtcgagcagacactgtcatgccgcgttgctctcactcacagatcgaaataaggcccttcctcccgggaatcgtccgcgggctgagttccgcagcgcctgaaaacagtgatttctgaactatcatattgtttcccttttacttttcatgttaacagtcctgtcgctggaaagaatgtcccggaagaacggatcacttaaattcagagtggcatttttatttctgagggagctgggctctcacggaacgtgctggagtgacagcctggaagagcgaaagccgccccccctcccgcttccccgcagctccccagccgcctcggcctggcctccctgcagcggtgacatccagtctccctcctctacccaagcctgcggcagccacgaaagccaccgcggcgcagaagtggggagggattcaaccttttgcccctgggttgtcgcccagagaagccaatggatgctaatctcatatagcagcctgtttgctggtgtcctgccttcagaaaccggccgtgagtgagcccgctggcattttgggaggccaatatataggccctttttcctacccgggttctcgctgaaatgagtaaggccggagatggctcaggaaagccaaaatatcacctagataaaggccgggttgggaagcagcaggcacagctgcatgggaaatcccaaagggccactaacgggacaccaagatagatcagccaggcgctggcagcagtggcaggatgacgggagaggccctgctccctgagctggagcccagcgtgcccatgcccagttcgttcctccccactcaccaggagggcaaagcgctcccctgcccactgggagccgggatgaccaggaggcccggagtgagatatctgtctctctctctctctctgtcacacacacacacacacacagacacacacacacacacacacacacacacacatatatcaccaaggaggctgtgggctgtggcactaggagaaatattgcaccaggtctggagccccgggtttgcggatgctgcccccaccgcctgtggccttcagccaggttgcttcccgccctgggcctctgccgaagccagaggcaggggctctccaccggcagcagcgagcgcctcgcctgctgtgacaactctgtctggctctggggctgctcgggaacccggtcctaaacacaagttcttgggtcgtaagcacaggctggcagtcccagatcgggaggccccatgcatctgctcccgacctgagtccctcgccctggctcccactccgccaccccatggcgctgcctgcgagaggcgccggagccaggctctggccttttccgaggcggctgcctgccggttcctctcgcgcctgttacacggcggacggcaggctcccgggctcttgtaaatcaaagggcaacaggactcgcctcgccaccactcaggctctttctgcggcctctgccaattagtgctccagttaatcacacttagcaactccctggagaagcagcgaagccgggaggagcccagcgtgggagaccccctcaggctggctctgccgagacggagatgaccactggcctctgcgccttggtttccccatctttacagtgaacccagaccttggtccccagccgcccctccccacttcccgtgccaagacgctgcatgtgtgtgcacacacacacgcatctgtgtacgcatgtgtgcatgtgtgtgtgcatgtgcgtgtgtgcctgcaagtgcgtgtatgtgtgcatttctgtgtgtgtgtgcgtgtgcatatgtgtggggtgtgtgcacgtgtgtgagtatatgcatgtgagtgtgcacacgtgtatgtgtgcctttgtgtatgtgtgtgtgcacgcacatgtgggtgggtgtgtgcgtgtggatgtgagtacgtaatgtgcgcgcacatgtgtgagtgtatgcatgtgagtgtgcacgtatgtgtatgtgtgtttgcgtatgtgtgcacgtgtgcatgtgggggtgtgcgtgtgtggatgtgtgtacataacgtgtgtgtgcatgtgtgagtgtatgcatgtgagtgtgcacgtatgtgtatgtgtgtgtttgcatatgtgtgcacgtgctgtgggtgtgtgcatgtgcacgcatgtgtgtgcatgtgcgtgtgtgcaggcatgtgtgcatgtgtgcatgtgcgtgtgtgtgcatgtgtgtttgtgcatgtgtgtgtgcatgtgtatgtgtgtggacagaaaaagctagaagaaagagcccatggtgatatcaaggctaccacccagacgtctttcaccatctcctgggaaagtccccgagctgcgggaaccccagccacaaagctcagccacatgaagaggccccaggacgggaagggggttgctctccctgcagcccccacccaccagggagggaagtggcgagcagggctccctggcacctcctcacacttcctgcaggacagagcctagtagctgccctgtccccaccccagagctcactgctcgccgtttgaagatgatgcagcctgactctcgggcgtgagtatttgtaaccgcacaggaaatgacacggagcatggcaacctgcaaacacagccctgccagcatcccatgctttgccctgctccagaaaaggaaactcgaggaggaaggaagtgggcagaggagacagcacagggtccctgggtccatgcctgatggtgcccaatgttgtccccctttttctggcagccttaaaggctagaactggactgaaccccaagggcacgcctcaccagttctccctcctgggccctgcctggtccctggcggcatcaggcctcgctggtcatcaagttcaagaccctggcagtgagggtgcccaaaatggtggccccctgaaaacaggccaagtccagtgccaaggcaagtgaaagggttctgcctcacagtaaaaaccaccccatattggtggttttgccctgccatttcatagtcccccagccccacaaaaagacaaggatcctttctacttctgcccacagtcacttgtgagagccagggccatgacccaaccctgagtctgtcaccacccccacaccttcccagggatcctgggcagggacaggtggaatgcaggcagggcaggagcatccccgagagggccctccagggggagcactgcttactttacaccctcaccatacacactcacaccacacacacacacaccaccacacacaccacatacacacacaccacatacacacatatcagatacacaccacacacaccatcacatacacacacacactctcaccacacaacacacacgccctcacaacacacacacacatcactacacacacctcctcaccacacacatacaccacacacacacagaccccacacaaatatgcacaacacacatgcacaccacacaatcacacaccatctcaccacacacttaccaacacataccatcaccacacacacaccatacaaacacacacacacaccatacaaacacacatacaccacacacatatgctatcacaacacacatacacaccctcaccacacacaccaacacacagcacacacacataccatcactacacagacacaccctcaccacatacataccacacacacacaccctcaccacatacatacgacacacgcacacaccatcaccacacacaaatacactcaccatgcacactccctatcaccacacccaccacacaccctcaccacatacacacacaacacatacacactcaccacacacacactgtattagttcgttctcatattgctgtaaggaaatacccaagactggataatttataaaggaaagaggcttaattgactcacagttccacatggcttcagaggcctcagaaaacttaaaatcatggtggaaagggaagaggcatgtttgacatggcgacaggagagagagagaatgcatacatagaaggaactgtcaaacacttataaaaccatcagatcttgtgagaactcactcactttcatgagagcagcatgggggaaaccacccccatgatccagtcacttcccaccaggtccctccctcaaaacctggggattatggggattacaattcaagatgagatttgggtggggacacagagccaaaccatatcattccacccctggcctctcccaaatctcatgttctcacatttcaaaacaaacaggccttcccaacagtcccttaaagtcttaactcattccagcattaactcaaaagtccaactccaaagtctcatctgagacaaggcaagtcccttctgcctgtgagcctataaaatcaaaaacaagttagttacttcctagatacaatgggggtacagacatgggataaatacatccattccaaattggagaaattgcccagaatgaaggggctacaggccccatatgagtctgaaatccagcagggcagtaaatcttaaagctctgaaatgatctcctttgactccatgtctcacatccaggtcactctgatgcaatgggtgggcttccacagctttgggcagctccacccctgtggttctgcagggtacatgcccctctggctgctttcatgggctggtattgagtgtctgcagcttttccaggtgcatggtgcaagctgtcggtagatctaccattctggggtctggaggatggcagccctctactcacagctcctctaggcaatgcccagtggggactctgtgtgggggctctgaccccacatttcacttctgcactaacctagcagaggttctccatgaaggctctacccctgcagcaaacttctgcctggacatccaggcatttccatacatcctctgaaatctaggtggaggttcccaaacctcaattcttgatttctgtgcaacttcaggcccaataccacgtgtaagctgccaagtcttggggcttgcaccctttgaagcaatggcctgagctgtacatcagccccttttagccacagctgggatgcagggcaccaagtcctgagactgcacaaagcagcaagcccagcccacaaaaccatttttatctcctagacctccaggcctgtgatgggaggggctgctgtgaagacctcttacatgccctggagacatgttccccattgtcttggcgattaacatttggcttttcattacttatgcaagtttctgcagccagcttgaattcacctcagaaaatgtgtttttcttttctatcacatcgtcaggctgccaattttccaaatttttatgctctgcttcccttttaaacattagttccaattcccaaccatctctttgtgaatgtatacaaccgaatgcctttaagagcacccaagtcatctcttgaatgctttactgcttagaaatttcttccaccagataccctaaatcatctctctcaagctcaaagttccacataattctagagcaggggcaaaatgccaccagtctctttgctaaagcagaacaagaatcatctttattccagttcccaaaaagttcctcatctccatctgagaccacctcagcctggatttcattgtccatatcactatcagcattttggtcaaagccattcaacaaatctctagcaagtttcaaactttcccacattttccttccttcttctgaatcttccaaattgttccaacctctgcctgttacccagttctaaagtcacttccacattttcaggtatctttatagcagcacaccactctctgtggtaccaatttactgcattagtccctttgcatactgctataaagtgttggctggccgggcatggtggctcacacctgtaatcccagcactttgggaggccaaggcaggcagatcatgaggtcaggagatcgagactatcctggcgaccacggtgaaatcctgtctctactaaagatacaaaaagattcaccgggcatggtggcaggcgcctgtagtcccagctactcgggaggctgaggcaggagaatggcgttaacctgggaggcggagcttgcagtgagccgagatcgcgccactgcactccagcctgggcgacagagagagactccgtctcaaaaaaaaaaaaaaaaagtattggccaagatggggtaatttataaaggaaagaggtttaatttacttacagttcggcatggctgggaggcctcagggaacttacaatcatggcagaaggggatgggaaagcaaggcaccttcttcacagggtggca

SEQ ID NO: 334 - DNA, 202545 bp, Homo sapiens
cctcccagatccctaacccctgacaacatctgatatgttctctgttgctaaaattttatcatttcaaaaatgttacataagtgaaatcatattgtatatagccttttggcacaggctttttttctcagtgtaatttcctggaaattcatcctagttgttgcatatatcaatagtttgtttctttttattgctgagtagtattctatttaaggatttcccacagtttgtttaaccattcacccatttaaggatatctgggctgctcccagcttttgactttcataaataaaactgctgctgatattcttgtataggtttttatatcaacataagttcatttttctggaataatgcccaatagtgcattcattgggccatacagtaaactatatgttagttttataagaaactgccaaactgttttccggaatggctgtatcattttacattccctcagaaatgtatgagagatttagtgtctccatatctttaccaacatttggtggtgtcactgtttttattttagttattctgtcaggtgtgtggtagtatcttagtatggcttaaagttgcatttgcctgatagctaataatgttgttttttttttcatgctttttgtacttattttcattcttctggggtttgcattattagtgattaaaataataaaaatgaacttgattaaaaaaatccatcctcatcttctctcttccattgagattgtagttcctcttgactaaatttctaatcccaaccccagggaatcatcactaaattttcttattcaaaacatcactaaattttcctattcaaaactgtaattatcataaatatgctataatggatattgcatttatatctttcttttgaaaacccttctaatatgatgaatttcaaacatacagtaaagaagagcataattaactttcatgtacctgtcacccccagctttacccaaattttgccaatattacttcatcgatttttctataattgtcattatcatcattacttgacagagtatttttaagcaaatcttcatgtccgatcatttcacccacaaattaatacttttcctgacaaggtcaagtcatgagattcccgagattaagggacataagttggttgtggagtaaagtttcaacatgctttctatttttattattaaattagtgcttacaaactatgacctatttggcagatgaacttcttatgctgttttagtaattttttaaaacatatttgctctttttctggactggacttataggttgtatacatattggtagattgatagatctttttgtgctatggtcttgttaaatgaaaaaaaaaatttccttattaattggatagccattattgagataaacaaatggatgtattccaggtatagaacaggtttgtaaatgattttatgttttcatttttcccttctaacaatataaagtagttttatgtttatgccagagttaacttttataaatatgttcgactttaacaccagctcagatgtccttggaatatttctgcttctccatgatattacagatgacaatgaggtcatttcacaattccttcttctctgaaaaacacagctggctcagtttggttagcagcattctcattgctgcatttcctcagtcaccagagtatttcaattgaccccttcaggacagattgtatctatgtaatatccttccacgataaaacatctataatcaaatgactacaacaaccactgagtggtatggctttcaccctgggccagaatcattctatttcatatccttttaataactctattatttcactgaaactgtaaagttcagattttctcaaatcaagcacaagtgatgtttgatttttgtcctctaaccacttttaccagagttctgccttgtggctgaattctttttgtaatttttcacagatgttaagttacttgatctccatattgttttgagggattttttttttttttggttggttggttggttggtttttattgtcaagagtcactttagctttttacacatgctttcacattttattgaagaacctgtggcaaatgtaaggatgtgctgaacagaggcaagtaagaaatattaatataacttcaagatcctttaaaataacctctcatggcactcatactttttcttcataaaaagaaaactcaacacagttataagttaactcttaagggtgattatgtgattaagagctatttctctccactagaatctaagctccatgagggtgagacaatatgctttcttattgccatatccctagcatctagtacactgctggctcatagcaggtaattatgtcagttagcatcttgctgacttctggctccaaatccagctttcgttgctttgtccaagataatacagatgaagcctgcaaatatgacttctttgccaactggcactatattaagctttgtcaatagaaggtgctagagagacactggaggaggaagagctttatcctcctagttctggtgtgcttctctttccagggtcctgcagcacacatagcttccccagtacccaacaatcacagcaaaactggcttttcccattcatggctcctgcagtatgtggcagcctgtgggactcagcagccagctacatcccccagcaggtgtctgtgcagtggaatgccccagatgagacagctccctgttaacagacttccctagcacctcttcgggtggctttgtggcaccaggagaagcatggctgcatctctgtgacagcttcctgttgcaccccagaggcagatttcgagaaagttctgttggcatagcatcacattgacttctctgccatccagtgagccacagccatgcacttttgaacaaggtctggatctcagccctggaggcctgttccttggatgctctatttcaactcaaagtgtagtggttgctccttatagctgttaatctcgtgttgcttagaatttgctttacttcttactagtcaattatgcattcctccaatttcctgttatagttaacaattctttattttaaactttccctgttcaactcaccatgtactttctgtctcctgattggactctgactgataagagtgcttaatacatatctcttaaaaggaagaaagaaaggagaggggggaaagagatagtgacagagagagaccttaactatccctggtatctctgggccagttttgcttgtttgctgttattatttggagttagaaatttaaaaagacaaactgaattttgtctaaatatgatcctgtgccactgaattatttattagttcatattctcttcactcactctttcactaaaaatttattgagcatctattgtttgccaagcatatacaaataggtgtttttggataatgagagaattaatacgtttataaagagaatccagactgtaaagccagtagaaatttccttgaatgccagattttaggaatgctagattccagaactgtctccaaattagactacccaacacctctcctctctctccctttctctctctccccctcaattcctaccagtaaataaatgaacatcatggtgtataccttaaatatatgcaataaaatttaaaataaatgaatgaataaataggtcatttaattcctgtttcttaaaatctcattgtcatgaaatgctggttagtgtctaaattaaattccacaccctcttcttcttctttccctttgggcctgggcattctttagttataaacagcagttttctaaattcttgttaaatcactcttttaacgtctcttctgcaagttaaatattccatggcattttattctttctccatagttgtattatttttaattatttgttttcctatgctttctccaatttgatcacactcatcctaaatggcattgttcacttcaacaatctcatatggagtttcatactactgacttaatagaagtaactcctcagatgcatggccttctatacttgcttatatatttgagtatctataccatgttaaatatctttaattacaacattaaaaatttttctttttatttttttttttgagacagggtctcactttgtcacccatgctggagtgcagtggtgcaatctcagctcactgtggccttgacctcctggactcaagcgatcctcccacctcaacccctcaagtagctgggactacaggtgagtgtcatcatgcccagctaatttttttgtatttttggtagagatgaggtttcaccatgtcttgcccaacctggtttcaaactcctgagctcaagctatccacctgcctcggcctcccaaagtgctgggattacaggcatgagccactgcacccaccccagtattcaaactttttcacagataaacttttctttttttgagttggagtttcactctttttgcctaggcttgagtgcaatggcacgatctcagctcactgcaacctctgcctcccaggttcaagcgattctcctgccttagcctcccaagtagctgggattacaggcatgacccacgcccagctaattttgtatttttagtagagatggggttttgccatgttggtaaggctggtctcaaactcctgacctcaagtgatccacctgcctcagcctcccaaagtgctgggattacaggcaaaacttttatatacctgaaacagaaattgtgtgtatagaaaagatgggtgtgagaggaaaaggttaggaggacacagagacaaacctggaaggcaaatcatgatggaaagtttccataatgaacacttggattgctgggggaaccatttttaagcacttatttacatacacactaatataattaccaactcttatttgtgaaagaggtccttagggattatttcctatgcaatcagtgctgtatgtaatagaatgtaatgacaagatgtgtctttaaaatattcgtaaatcaaacattatgccaattcagaaaggcctgagaggactccctgcaattcactgattttagcaaagataaacaattttccacattttatcacctctgaaattgagatgcatctcacaaatggtggcacactacaattgtcttggcacccttggcctctggttgcactactgttccagagggggagctgaggcaggcaccagctccccacacctccacccttctcctgacctgatccccaccctgaccctgtccctttgaccatttgacccctcttgtcagtgataaactcctggattgcaaatgcacagacttcaagactggtcaattttcttgggtcattaactgcttgcaatgcctatcagctgcacaaggcatccattaatgactcttctttgccttaaacaggcagggactaattggtgaactcatctgggactgaggagaagtctaaaaaatcttagtatctacacaataaaatttctaagtgataagaaagtaaacaaaatcatagtgcattttaaaattgatgctgtcttaacatttaaagaaaatacgataataacacttaaatgtttcatataaagtgtgtcttgctgaaccctaatgccttcttactccaaccccaaccccaaccccactccacaggctccagtgccatgaccagttttcttctttccatggatcctgtctttcctgttggaggaaactattagatctcactgagcattcctctatgtcacctgtaacatttactttcaggatacaaatattgagatggagcagggacccctctttgaggcctgatgggcccacagagcatagaaataaaagaaaacctggagtcccttcaaggaaaatcccaggcacctagctatccttgagaagtggctagctagccttatgagcaacctgttaagcaaaaaggtaaatatagcttaaaacagccaaagaagtgagagcaacgaaatatttggttccctatagaaactcaagagaacatctttatttatgcctctgagttgtttttcagaaacccagatccccaacacatggaaaatgctctttgctggcacacagacctcagatactagggaactgagggctgaactctgaccaatgttcctcattctgaatttcttcctgaggggcctggaggaagtcatgcccacaggccagagcttaacactttttttctactgaccccaagtttttaagcaaagcttaaccaagggcaaatcagaaaatctttgaatccacctatgacctatgggccctgcttcaagatgtcctgcctttttaggctacaccaatgtacagcctccatgtattgacttatgacttcacctgtaacctctgtcatcttgtctttaaaaacccttacatttaagccattgaagagtatgggtcctaggcatgagctgcctaattctccttgcttgctgccctgcaataaatacctcacgttttcttgctgcatatcccaatatcagtgtttggctttgctgtgtcaagcaggtaacccatgttcagtttggtaacaatcttagctttatttctgggactcaactgaattagtcttaactacaactctgactttgaacgtgggtaaaggttaattgcaaacaaacaatttcagaaagttgctcagccacaaagacaaagcaaagtgtgtccgtccctctggttgatgtcaggtgagcatgcttacctacatagaacctttcatgtaagcacattgggtaattacaagtcttccatggggacattttgcctggtgggtggcatcatcgtttttacttgacaactacccatttccttataaactgggttgtgtataagagctgtgagggcagagggaacaaaatttgaatatttgttccattaggtttagagaatttggactctgttttatagcttaccaaagagccacaaatctagttctgttcaggggatttaattcacgtctcattaactaccttggcaaaatccaacattagccctgaaaagctaatttgattaaagaactgacagacattacttctttccaactaatcaagttaattttaatggaggtaataatgtctccctggcaggttattacgagaatcaaataagctagctagcatattttgggtactttataaattatcaagtgttaaacatgtgaccatcgcaggtctctttattcctgtgttatgccctccatattccacctcgtttctttttcttttcttacctcttcctaaggtcttacctaattattcagctgagggaactcctcagctaaatttgctgttttcaaccagcaaattgattcaataaatattaacgagcaattacagaaacagtttggagagttgagtactccaaccccaagaatgcaaaatgggagaagctaccttctatccccacattaagacagagggtcttccaagggaacaccaaggttttatatgccagcttctggaactgtctgatttcctcttaaaaactttaaagggcaagagatagaatacctggtgtttaggagtgagccaaaaacaaaaaaatggctgtgttgggcatctggcatcctgtagtttgtcagcagaaataggtgtgtttccaacatacacactgtgggccatgcaagagtcaaggtagagttgcctgaggccctttccaacaggaccatccagagtggctccccatgaggggtgataatgactacaatcaaacatatttgtttccctagacaaaggaattaccaattagttatctggagtgttgtaggcatcatgctcatggaagctgctgcgtgatccacaaggggtgtttggatgattttacacagatgtgtctaactttatagaggcaggatcttcaaatatgtcacataaatgtgcactcagatcacatacacttattggtatttatacttaaatccactttgatattcagtattgtctccagtgggaaggcagtgtagtcattaaataaaacgacaggaacaataaacaattctgtctccaaggtaatatgatggcacagcatttttaaaagatgtcagttttacagccagatattttaattacatcttatagaaccacagtggaaaacagtgtattctcccctattttaaagatggaggatctaaaaataagcttaagaaactcaagatcacaccctgagaaaaggaagtcagtgccaaagaaacccatttattgattaaatttttgcttatacttccattgaaataacatcccaaacttttgctgaatatactgagattggaagagaatgaacttctactcataacctccctactcactgtaaatacccagaaatgctcttgtgttctctgggactaggtacgagcagttttgctcatattctgcataacttctctaggagaccaggtccctctcagaactcaagaattatggcatgcatgttgggtcatgcctgtaatcccagcactatgggtgactgaggcaggaagatcacttgaggccaggagttccaggcaagcgtgggcagcatagtgacactccgtttctacaaaaaataaattagtcaagtgtggtagtgcatacctatagtctcaggtactcaggaagctaaagtggaagaatcacttgagcccaggaggctaaggctgcagtgagccgtgattgtgccactgcactccaacctaggtgacagagtgagacaccgtggcgaaaaagaattaccaaagctgtatgatttcactgtgcttacaggtgacaaaaactctgctcaagcaaaaagatttatgaactctatccaggcacggctggagggaagttggccttaggcacttccagaaccatctatccaaataccaccagaatgcccccactgacatacttcctatacagctccatgttttgtgtatcagtttctttctctccagctggagctcagctaggtatgtgcatgtgtgtagcagacatgtggggtattggtgtcagattcacattcttatggcttcatagcccgagaggagtaagaaagttgacttctcatctgttttttaaatgttggagaaataaactggtacatccttggtcatatgcacaactctgggtataaccactgtcgaccaaggacagctaccggaagtagcaaatcctggggacgtgcccacccctttgttaccagaggagcagcaaaacagatgctgagcagactaccactagagccacttcaaaatggaaataaactcacagcaccaggcaactaatgtgtacagtaaaggaaaatgttacacaaaaagtgaacaaggattcacacatgaagccttggataaatgatttttgtaaacatagcagcctctgacaaggagcaagttgtgaaactcaatgttcacttgatctttctagaagaacaatatcttttctctggtaagataaaaagaaaagcaacaacttgactagaagtggtgatgtgcgtatgtttattgtggcactattcacaatagcaaagacttggaaccaacccaaatgtccatcaatgatagactggatcaagaaaatgtggcacatatacaccatggaatactatgcagccataaaaaaggatgagtttatgtcctttgtagggacatggatgaagctggaaaccgtcattctcagcaaactattgcaaggacaaacaaccaaacaccgcacgttctcactcataggtgggaactgaacaatgagaacccttggacacaggaaggggaacatcacacaccggggcctgtcatggggtgggggaaggggggagggatagcattagaagatatacctaatgtaaatgacgagttaatggcacaccattagcatgttggcacaccaacatggcacatgtatacatatgtaacaaacttgcacattgtgcacatgtaccctagaacttaaagtataatttaaaaaaaaggaaaaaaaaaagaagtggtgatgtgtgctgactttattgttagctaccctgacaatctgttgcattattcccacatttagcaatgccattcccaagtgaaataaaggacagtcacactgatctacatcactttagaatatttattgtattccttaatgcatttcttaacatgtatagcactcttcaatcaagaatataaagtcatctacttagaatcacattatcttaaagatgcatactggaatgataagtttgaagatgtaactatcaacaattcttttcaaaatcatatcaatatattactctcatggaacttgcacattctaagaagggtcattttttccccccagtactgggaaggtatgcatttaaccatgtggtcagccagaaaggctgttttatatatggtgtgtgttactcataaaaagcctgtcctttctctaatattgtacattacacaattgtagctacacctgaaaagaagtgagtttcaatgaccatcatcacctaaaaacatgaataagtttgtatatttaggaccagaggaatgatatatcgtactgtactatgcctacctctgtccagaggccagctgtctcacctgttcttcagggtgcctagactttttacccatctattatccgggatgcttctgaagtcattcccatgggcccctgtcaggtattgagaataaatacctctaaggaagtttttttcaaacctaatctacccaccatgtttattccctgacactaaaagttcactgactcttcaaatcctagacttgtccaacattattttccctagttggataaggctgaattaaaggcacttcgttaaaggaagtagccttggcagaagaaaaaccgttgttctgtagaagtgtcattcaatatttaaaatctcctctgaaccaaaacaagagcctgaaagtaaaacaccttttattttttaactctgctgtcattgctactaaggattcatggtaaattatcccacagcccttcttggcttgagaggaggtacagtacaagtagcccacagggtctcaataacagaagtattctcaaggacccttgaggatacaaaggaatactgggctgttttaaaatgagaaaactgagaagaatcagttaggtttctagccctcttcctataatacgccttagtctttgcaaagcatagatagatagttggtttgaactagttatttctccctgccctcccccacaagaggcattcctgcttgccttcttgggcatctgtttaaaagcagtatgggaggaagggggatgttctagggggacaagatgtaatcataaaatctgaagccccaaaagaaaagtcagaggaggctgaagaaaaaacaatcatgacagcaactctcctaaccacaaaaatcacatatgttatctttctttcaggactaataattaatatttaagaggaaagccacatcaatttctagggcccttcttggggaaaggttcatataatttagcatacataccatattcagtgaaaatgcattcaatataattacctattataaaaacaaccttctcagccttaacaaatgagataattataaatgctccttttgctttttattaaaatgtcacagcatgcctagagaacagtttatatggctgcataaagtctgaaacacaagaaaactaataaaaaaccacctgttaaatacacaattatgattattgatgtcctttcaattaaatcttgtgtgtttaaaatgaaaaacacgcagcctggtacaaatatccatatttcaatttgcgatctgctgcattggcatgagttttggtgaaacctggtaaaagaggaaaaaaaaatcaaattatgaaaaactgcatgatataaatctctctccttttaatttccaaatttcaatcatgtaggcaacaagcagccttgccatggacattccctggagtttccatatgattttccatcctgaaacattgagacagaacagttctgtttacattttgggtattttgtagttctcaaccttcttgtattagctcctaaattaaggatgaacaaggctggcaacaaggagcaggtggaagaggagcagaggaaaacaaaggatcccaataaccaagccccctgtcagatggatcactgatctccgagactgatgcctctgagacttcacttaagacgcagtacaaaccccaagtctccaaaacctcaaaatagatccagccaattcataattttgttgaaagatgctttatgtaatctttggattacctaaatacatattaatgaagagacgtatgatcaatgataaatcttatcggaaatttcataatcagaatagaaatgatacaaaggcaataagaggattccaagttattaaaatatggaagtaatagcattaaaacaattaaatgttgattataattatgttcagtgtataaaacagtcaatgctttcctgcgaatctgcaagcagagaaaagtgacaatgaatgtatatttaaggtagagccggttgcaggagaaccataaatataagtggtcagtttaactgagacagatttttcaaagtgtggtaccaggttcagattccttaattcaacatggcaaatattgattgggttctagttagtaacagtccccatgggaagcaggaaataccaaaaattgggtgctttttgaaattctgaaagatgtggcaatcaaaatgagcccaattagcattttaccttccagaataaacaatattttcttaaattgataaatgaacaaatgaatgaataagtagataattatataagtttcaaagaactagaagggaggttcctaatagaggttaaatcatcagtattaaaaactgaaagaacaggcagtcatttggctttcataaggttaaatagttttagttcatttataaatgtctgcattagctcttcacaattaactcttcatagtatcaagagttaatgtcttgtcttccatttttgtactaaaatattaaaccagaatggcaaaaatgtctactaaaagaataaataagaataaacaataataataaagttcagcatgatttggtatatagcttatggtaaatgagaacgcattatgacttatttctaagagtagacatacagacaaaataaacagaataagtagacaaaaagtaacatcacacatacgcacagattttcaactctactaataataacatttagtatttagataagtatatctcacagttcattttctttcttttttttaaacaacagagcatctgtggaaataatttagtgaaactttttttttttttttttttgagacggagttttgctcttgttgcccaggctggagtgcaatggcgcgatcttggctcaccgcaacctccgcctcctgggttcaagcgattctcctgccttagcctcccaagtagctgggattacaggcatgtgccaccatgaccagctaatttttgtatatttagtagagacggggtttctccatgttggtaaggctggtcttgaactcccgacctcaggtgatccacctgcctcagcctcccaaagtgctgggattacaggcgtaagccaccgtgcctggcccaatttagtgaaacttttttactacaaatcattttctatagatgcttcatagcacttcctttaaaaagaaactggacacattaatttttttaactaaacatctgatccttttccttgtcatgtcagccctattttgagctcttaatgtcatttacattctcaatgtgaaaaatgacatcaaaaataagataacgctttatatagactgactttgcctgctttttaatgaaaaacatctactaaaccaccatttctcattctgttctcccagtctcatcaacgttgtaaattcatgcaagccaaaggagcttattctgccaacgtgatctgcaggctaagcacaaggtgacatgatttagctatagaagacaagccaatgatttgtcttcccagtgcattaatatcccaaaagtatattgcttgactctggtagaatgccagttcatagtagatactgagagtataaatttattcaattaggcaaggaatgtctgcagcttctttcagattccactgcaaacatatcaacaaacattgcttttactagttttttatttgtttgtttgttttgccactggtggtttaggtatattcctgcctggagaataaagccaaggctcttgggagcaagaaccataaattggttctattttattcatattttacagctcaatatggaacatacattgggtgtatgactagtgacatctggaagtttattctaacacataatgtttaaatatggaatacatttttaattttttaagttaagaagataaaatcaaagaaatattgtttcaaaagaggtccacagacatatggtttataaaaacacctattttacatagcttaagcattcatcagaaaagaaacaacccaaataaccaattgaaagccgttattttcaatggcaaaaccatttattaaaccacaattacttttgcatcaacctaatactttcgcccatcaagtaactggcatactgcatgctgttaagtatagccaaaaaataaagaaatttgacatactcattagcttgtcaagctttaatacgacatcattttgattctttaaatatttgagagacagacttctttcaaaatctgaggacaatgggagaaaaataagccaaaggattccttagttgtgaaaatgttgggccctagtagcataaaagacagacagaagactatatcgaacttaaaaacttccatgtgtcaaagaaaacagtgaaaaagcaacctatgaaatggaaaagaacattcaaaaatcatctgataagagattagcatccagaatatatgagaaactttgagaacatcaccagataaatgcaaatcaaaaccacaatgagatatcacctcacagccattagaatggccactattaaacagaagataactgttggcaaagatatggagaaattagaacccctgtgcaccaacagtgggaatgtaaaacggggcaaacattgtgaaacagtatggcagttccacaaaaaattaaaaatagaattatcatatgatccagcaatccaaattctgaattatatatctaaaaaatttcaaagcagaatgtcaaagagatatttgcacatccatgttctttgcagcactattcacagtagccaagtggtggaagcaacccaaatgtctaccaacagatgagtgggtcatgaaagtgtggtatatatgcacaatgaaatattatacagccttaaaaagaagataatcctgtcatacatgctacaacacagatgaaccctgaatacattatgctaagcaaaataagccagtcacaaaagggcaaatactgtataactccactcatatgaggtatctagaatagtcaaaatgatagaaacagaaagcaaaaacagtggttgccaaaggctgtggaattagtgtttaatgagtagtttcagagctgcaagttataaaagttctagagatctgttgtataacaatgtgaatacacttaatattactgcattgtacacttaaacatggttaagatggtaaatttttttaaagtttttaccagttatttaaaaataggaaagcattactgaacagcatcacaagcatttgtagagcatgaacatacatacaaggctctaccaatagcgctggggacaggggagcctttattccccacttctcatattccattccatgtggaaggacacctatctattcatgtaactaccctgacctccggtgtgtcccttattgatgtaattaaatgattatttgggcagaggaaccttaacatgtgaaactcagcatgactcttcctcttcattgaggtcttcacctagaaagcaatgctctgttttgctctcagccatgtggatggaagctcagcaatgaaggctacccttgtgggaggcctgggtttctctggtgctgcctacactggggagccaaagcctctgtatctgtggggttcacaactgaaaagcctgctgtggctgtacacctaggccacatccctcactctagcctgtataatagtaatacttttacctctacctgttcagctcctttctctcaagggattcagcactcaatccccaagaaacagcaaagtccctatcgtcatagcatctacattttaagggagagtaatcatatggttggcttctctagctgtaaacagctcctgaccagaatcttattttgggtgtgtgaaccttcaggttccagaaatataatcaatatttgcatttctacaacaaaatttccacagcctctaccaagttccagacatatatgaccttcaagatactgccctccgatggaaaactccaactttcagttgatacaaaatcatgaacaaaactgtgacagtcattacaggttttttaaagttatgtttcatgtgattaaaaatcatattttttccacttttttattatggctaataacactatgatatatatgaaaaagtcttagtaattcttttttttaacagtgcccaaatatttcactatcattcttttttgatatcctaaaaccaaaattttgtcacgtcctgttatctgatgctgtcatatttagtcttttactttggaattcccagtattttcccaaccagctaatatccacataatgtagcttttgcccattcacttgcccatatccttagggatacaggacttttaccaacacattttaaattgttttgcactaggattttacctttttttctttatgaggcaacactggccaatcattcccttctagaatgttgactgccagttgaaggctgagttctagggacttttctcaaacagaacttgagcaactagtgtatagtcacatatggagtacaatgctagctatgcagtgataaccacagggaatattttctaaattaggacatggaatgtcttctgaattgtcaagaaagaaatgctatcttcaatgtacttttgtaattaaatgtatccttattgataatccaggtattaagtagaacattttattaattagggcactccagctctagccttacagaaaacaacctgttatatgtgatttcatctgtcagagtgtaaagagatgccattgatcgtcagatgctcaaaagctagtcctctggatggttccattgataccataccttttcattctcaggacaacattgacatacaaattaacatttcatctcaacatcctaatttggagaaaacaagattacatatccctgtgaaaagaagagatggtactgaaattgagagggtctacagagatattttccattggaacagcaccttttattggaaaacaaagcaagaacagtaaaaactcatattttcattccttatttacccacatgaataaaaaaagaactagataaccaggtcttcctttgtacattctcttttgctgcaaaaaaaaactgaacattctgtggatcttgaaaatgttatctgatgaagaggttaattcttccacatagaaaaaaataatacagattgtttgcttttctcactggagtgagaaatcctaaatagttaaagtataagcatatccttccccttgaggttattgaaaggctaattaaagatgtgcttttcatgaaaggtattactgggagacttctttttccaaagggacattcaaaaaaagttaatagacaaagaccttggtagagtaccaggaacagttattatatggataatgaactatgaaacaaaaatcgtttttagagaaatgtgtaggccgggcacggtggctcacgcctgtaatcccagcactttgggaggccgaggcgggcagatcacaaggtcaggagatcgagaccatcctggctagcacggtgaaaccccatctctactaaaaatacaaaaaattagccgggcgtggcggcatgtgcctgtagtcccagctgctggggaggctgaggcaggagaatggtgtgaacctgggaggcggagcttgcaatgagccaagatcgcgccactgcactccagcctgggcaacagaacaagactccgtcttaaaaaaaaaatgtgttatgcactgataggtacaagcaaagcatgtagtacacaagaaagacatacatacaatatatgtatgacttatcaaataacttttgttaaattagtttctccaagatgtgtagctgtaacattaacatattttcttctcattataaatatatttcattttaattagattggttcttaaataggtatgagaataatatccctttctgatatggtttggctgtgtccccacccaaatctcatcttgatttggagctcccataatccccttgtgtcacgggagggacctggtgggaggtaactgaatcatgggggtgggtttttcacatgctgttcttgtgatagtgagtaagtctttgatctgatggttttataaagggcagtttccctgcacacactctcttgcttgctgccacataagacgtgcctttgcttctccttcaccttctgccatgattgtgaggcctccccagccatgtggacctgagtccatcaaacctctttttctctataaactacccaatcttatgctgtctttgttagctctgtgagaatggactaatacactttccttcatttcttcagagacattttagttttacttttggttaacttcaaatagactgagccatgctttcaatgccattagctaggtgattgatttatgaataagcacttatattaaagagcaattatttatattctcagtaatattctgttttaaaaagggatttggaggtttcttaaacggatactcccctgacgtatttatctgctttgtaagtctgttttatgtacttatcttcaaatacagggcatgtctgttttgtgatgactaacctggtgatgtcagaggcccaacattttaatattttcaacggatgaaatatggcatagaatttagagaaagtcataagtcatagatgggtttaaaaataaggaagtatcatttctccatatgtggctaacatttttcagttaatcaagttcaagcacagctgccatataaccaaagaacaggggattacaagggccttcaaaacataaagtagcttagagctcaagctcaaccttgtttctagcagctcctggtggtgtgtccccttcctgcttctgagtcctaagccaaaccttggccagtgagtcagagcacagctctgttcccacctgctctcatctagaggcacccttccttctactcctgttcactgtaaaggtcaactccaaaaatgatcacaaattaatggttcatgtcctgcaaacacccattaatcaagcctataatataagacaagtgtctggatttgttcacagaaatacttactgcaaaatcacacccagtactcttctgtacgtcatccactgtcaggccttcccagagctcaatcagagtcaaccctttcttcttgtccacatcaaacacagcctgtcagagtgggaagaaaaaggacaatgacaatttccatcaaaataattattatatggcacaaaacagaaataacctcgcaagttcgacgaggtcgggtgtggtggctcaggcctataatcccagcattttggtaggcttaggtgggtggatcacaaggtcaggagatcgagaccatcctggctaacacggtgaaaccccgtctctactaaaaatacaaaaaaaaaaaattagctgggcatggtggcaggcacctgtagtcccagctacttgggaggctgaggcaggagaatggcgtgaacccgagaggcggagcttgcagtgagccgagatcacgccactgcactccagcctggacgacagagccagactctgtctcaaaaaaaaaaaaaaaaggaaacacaagacccaggacaaaagaaaaatcagcagtgaaaaaatgtcaactgtaactatgatattttggtgaggataaatgccaactccctaatcagcaattagttgtggaacagtgttgatgccagaaaataaatgagcattgaccatggatggcatttgttactactgcaaccagttttttaaaaactacctcccttttgttaagtctaacacttttggtcaaaggtcaattagtgattaataatgatttgaacaaagaaaggaatgaagaaagagggagagagaaagggaatatttggaaggtgaaagcacatgaatgacaggaaaaaagtttataaatgatattgggtaaagaattacaggaaacagaagaaggtgctctgaagtgtctaggagtaattataagaggatagctaccctggtcctgaaagacatgcaagtaactgtttaaaatattctccttaagtcctgtaaaacatatagtctcaaaaagagagcatgggaatctccctttgctatgcaaatcaaatgaagatgcttatatttagggcaagcaccagaaagccaatcttacctgaaacattccatcattctggtctgtaacatcaggtgttggtagtgccaattggtatggcttgacctcagcagatagaccccacctgttgtatctgatttagaacacatgctttcacacttagaaatataactcaagtggaagtgacctacgaggtcacttaatataaccttccacccaagaattcttcaaaacattcttctcagatagtcaatgaggttctgcttagatacttgcagtggcaggaggctcacttatttcaaggcagattgtttactgaagggaagctcaaaccttaagagctaaaactgcttctcctatggctttagctccatgctatagttaccctccagcatattaagcactgtaccctctttcagttctcatggttagtttcctctttctcagactaaaatgttatgcatcccagagctttcctctcctctacagttaacctaaattcaactattatttgcaggcctagaatcttttttttttttttttgagacagagtctcactctgtcacccaggctggagtgcaatggcccgatctctgctcactgcaacctctgcctccagggttcaagtgattctcttgcctcagcctcctgagtagctgggattacaggcatgccccaccacatccagctaattttttgtatttttagtagagatgaggttttaccatgttggtcaggctggtctcaaattcctgacctcaggtgatccacctgcctgcctcggcctcctttgggatgcaaggattacaggagtgagccaccgcttaaccaatttttcaattggcttggaagtcaaaccttgaattgtcatttttgaatacactcctaactaggagggtaatatcaagacacagcaacacgtagagaaaagaaccctggcctttgagctcagtgagaattccactctgctgcacaactgttatgcaacctttagtgaacctgtctttgcatctgtagacatatataataaaaatgtacttcccaagattgtgatacaggacaaatataagaaaacatactctgagcaccatccctgagacagtgggggcagcatacaagcagttttttcacttttcactccttagtagcttaacatctcacttatatgtgatgccagatcaaagccctggaatgattattgactccagctgattaatatttttccccagaaacacacatcgctgggaccagtgataactgcattattggtttgtctgaagaattcacagataacctggttgacattactggaaaagagggttgaaatgtaagacaaaatatttcagtaaactttccttttgcttgtacattttatgttccaaaaaagttttttggcagaaatgtgtgtttcaagaggaaaaaaataaatggataatttaggaatgtttgtatactcattagcttgcttcattccaaaatgacaattaaatttttttaaaatgaacactttctttgcagaaaatgtatctggagcactattcatatgatttgctttttcttgcattctgaacaactgtcaatttataaaagaacaaataagaaaaaaagagcatctggattaagttattaagaacaggcatggaaatgatttagagagaagataactgtggtatcaaaaatttaaggcttcagtaatcagggagagtaaatctatggcaaattgacattgcttttaaaaaaaccttattaacacatttatcaaatcttaattagatatattagaaaaccaagtatctataatttaaaaaaggaaacttacttttgaaatatttaggaaactttccatttagtgatataaggtgcaaacaaaaaattgacaaaaatggagactaaaacctaaaagtcacaataaattgttcaactatccagaatactgaaagtactttgtctaagagataaatgttaattactttatcaccgtgacaaaagcttacattatgggtaacagtgaatcacagcccaggtgctggtgaggaatgcatctttcttttattttactttatttttttattacactttaagttttagggtacacgtgcacaacgtgcaggtttgttacatatgtatgcatgtgccatgttggtgtgctgcacccattaactcttcatttaacattaggtatatctcctaatgctatcccttcccctgccccccaccccacaacaggccccagtgtgtgatgttccccaccctgtgtccaagtgttctcattgttcaattctcacctatgagaacatgcagtgtttggttttctgtccttgtgacagtttgatcagaatgatggtgtccagcttcatccatatccctacaaaggacatgaactcatccttttttatggctgcatagtattccatggtgtatatgtgccgcattttcttaatccagtctatcattgatgggcatttgggttggttccaagtctttgctattgtgaatagtgccacaataaacatacatgtgcatgtgtctttatagcagcatgatttataatcctttgggtatatacacagtaatgggatggctgggtcaaatggtatttctaattctagatccttgaggaatcaccacactgtcttccacaatggctgaactagtttacggtcccaccaacagtgtaaaagtgttcttatttctccacatcctctccagcacctgttgtttcctgactttttaatgattgccattctaactggtgtgagatggtatctcattgtggctttgatttgcatttctctgatggccagtgatgatgagcattttttcatgtgtctgttggctgcataaatgtcttcttttgagaagtgtctgttcatatcctttacccactttttgatggggttgtttgattttttcttgtaaatttgtttgggttctttgtagattctggatattagccctttgtcagatgggtagattgtaaaaattttctcccattctgtaggttgcctgttcactctgatggtagtttcttttgctgtgcagaaactctttagtttaattagatcccatttgtcaattttggcttttgttgccattgcttttggtgttttacacatgaagtcctcgcccatgcctatgtcctgaatggtgttgcctaggttttcttctagggtttttatggttttaggtctaacatttaactctttaatccatcttgaattaatttttgtataaggtgcaaggaagggatccagtttcagctttctacatatggctagccagttttcccagcaccatttattaaatagggaatcctttccccattgcttgtttttgtcaggtttgtcaaagatcagatagttgtacatatgtggcattatttctgagggctctgttctgttccattggtctatatctctgttttggtaccagtaccatgctgttttggttactgtagccttgtagtatagtttgaagtcaggtagcctgatgcctccagctttgttcttttagcttagtattgacttggaaatgcgagctcttttttggttccatatgaactttaaagtagtttgttccaatgctgtgaagaaagtcattggtagcttgatggggatagcattgaatctataaattaccttgggcagtatggccattttcacgatactgattcttcctacccatgagcatggaatgttcttccatttgtttgtatcctcttctatttcattgagcagtggtttgaagaggtccttcaggtcccttgtaagttggattcctaggtattttattctctttgaagcaattgtgaatgggagttcactcatgatttggctctctgtttgttattggtgtataagaatgcttgtgatttctgcacattcattttgtatcctgagactttgctgaagttgcttatcagcttaaggagattttgggctgagatgatagggttttctagatatacaatcatgtcatctgcaaacagggacaatttgacttcctcttttcctaattgaataccctttgtttccttctcctgcctgattgccctggccagaacttccaacactatgttgaataggagtggtgagagaaagcatccctgtcttgtgccagttttcaaaggggatgcttctagtttttgcccattcagtatgatattggctgtgggtttgtcatagatagctcttattattttgagatacgtcccatcaatacctaatttattgagagtttttagcatgaagtgttgtcgaattttgtcaaaggccttttctgcatctattgagataatcatgcggtttttgtcattggttctgacaaaaaaaggcaggggttgcaatcctagtctctgataaaacagactttaagccaacaaagatcaaaagagacaaagaaggccattacataatggtaaagggatcaattcaacaagaagagctaactatcctaaatatatatgcacccaatacaggagcacccagtccttagagacctacaaagagacttagactgccacacaataataatgggacattccactgtcaacattagacacatcaacgagacagaaaggtaacaacgctatccaggaactgaactcaactctgcaccaagcggacctaatagatactacagaactctccaccccaaatcaacagaatatacattattttcagcaccacaccacacctattccaaaactgatcacatagttggaagtaaagcactcctcagcaaatgtaaaaaaaaaacaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacatcctaacatcacgattaaaagaactagagaagcaagagcaaacacattcaaaagctagcagaaggcaagaaataactaagatcagagcagaactgaaggaaatagacacaaaaaacccttcaaaaaatcagtgaatccaggagctggttttttgaaaagatcaacaaaattgatagaccgctagcaagactaataaagaaggaaagagagaagaatcaaatagacgcaataaaaaatgataaaggggatatcaccaccgatcccacagaaatacaaactaccatcagagaatactataaacacctctacgcaaataaactagaaagtctagaagaaatggataaattcctcgacacatacaccctcccaagactaaaccaggaagaagttgaatctctgaatagaccaataacaggctctgaaattgaggcaataattaatggcttaccaaccaaaaaacgtccaggaccagatggattcacagccgaattctaccagaggtacaaagaggagctggtaccattccttccaaaactactcgaatcaatagaaaaagaaggaatcctccctaactcattttatgaggccagcattatcctgacaccaaagcctggcagagacacaacaaaaaaagagaattttagaccaacatccctgatgaacatcgatgcaaaaaatcctcaataaaatactggcaaaccgaatccagcagcacatcaaaaagcttatccaccatgatcaagtgggcttcatccctgggatgcaagcctggttcaacatatgcaaatcaataaatgtaatccagcatataaacagaaccaaggaacgcatctttcattacctcattccagcaggtcaaaactaggaaatcagggtcatagcatcctccaaattctctttcaaagggcaactgaatggaattttctctggatctgataatggcattctagtccactgttagtgagggctggagaccttcattgctcttaatggcactgcattctcattactcattcaacaagtatttattgagcacctactatgcacagagcatagcgataaacacacaaccttcctttctttaacgtaccaaaagttccagacgtagatgctcttctctttactcattcttgctatacatctataattaaggctccaattatccccatatgttaatgacacccgcaagtttattccaatactgacttctcttttgagctctagatccaaatctccaattgtttattgcaatatctgactgggtattcccaagaatatcacactgaggctgtccaaactgaacctattcatgtcttgtattatccttccccttctcctcctgcagtcctgggcttcctaaaggatacacaggtcaactattctctctagtcagaaaacttaggaatcacctctgtcttaccaacaatgtgcaattcatcaagttaggtcgagtccatctcctaaatctctttcaaatctctctatctgtcctatggtttagaattttgagattttttgcctaggtctatgaatcctcttaactggcttctgccttatctcttttctccccgctttacataaaagcttacagtgttttttctaatgcaaatctaatttattgtgtccccagccttaaaacaaaatcactgaagggttccttactgccttccttataagacccacagttcttagcaagacatctacatccctccattatttgacccctcactgccttttccacctcagccttcagaatccagccatgcccttgctccaaccagttccacttgcaggttataggacaagccatgttttcttcatacctctgtgactacatgttttcttccttttttccagaaggtccttgttggctttctaacttatgaaattcctactgctctttcgaggctcaccattcaatccagtttttcagcaagaaaagcataagtattcactgagtatgggttggcactgtgccaagtgttagataaacaatggtgagccagacaggcagagattagagtttatttcagtatagtggtttgtgctaagttaggataagtacaaagattcagagaagcacccagaaaatttggggagggatagggaagacttgctagattagctagattagggaagattagctagatggatggggtgggaagaatgttccagacagagaaggaggatgtgcaaagtctcaaaagaacatggtccagggaagaatggaatgtagttcacagcattttagcatggctcaagtagggagaaagttaaagcagagagaaataggctaaaggagaaaaggtacatactgtgaaatgcttcacaagatatgttaaaagcttgtatttaataacaccaaaaatctttccctgacacctctgcccacactgctgggcagcttttctctatgtccctagattagcatctggcgtgtgtctccatatggcctttatcatgtcaattactctgactgctggaaaggctggatgtttggtgtctcacccttcttccatgttgtcctttaggacagagactctgccttcctcctttctgtagcacactgttgggaacactctggttcaaaagtttttaaaatgatagtaaagttaaatatcaatgtaagttatagcataagaatacattagattatgagtgccaaaatgaacagtggaccactatgagaataaattgttgtgtgctatgatggtgcaaaacctcttcatcatgaagagggaaaatgcattaggtttaaaggacaggtagtatttggggaggctgaggatcaagtgggagctatgacaggtagaagaactgaactggtaagaacaagggcagggcacatgtggagatgaggagagggctgatggaaggaggagaggacccacaggaagaatgtttctggaattatctttagaaggactaccactttatttaaaaataaacaaacaaccaacagggtaaaagattgctttgcttttatctttaaagtaatggattcttttcaacaatccctgttcatagttttagggggattcaagaaatggtaaagattcagaatagatggtgggataaaatattctgcccctttatcttgttctttatatgttaccttcatggcattccacataagtagtcctggggaaggcatcatttaggacagaacctcccttaaaagtggcttctgggaataataagcctcctagcccacttcaaagcctgctttagggtgctcactgtcacacctcagtgaggttagcgagtcagattaatgccaagacactaatgctattgttcttggcaaatggaacagcactaaaagaacctgatatacataattctgttttgtggcttcttcaaggtactgaatcaagaaaacacaccctcccagctgacttaaaagcagtaagtcattccgacatactaggttcaaatctgagtcagaagggtgatgacagacagctgctggtgatgcttctctggtctgagcagctttcagttgtactactgaccaatatgttccatctagtaagaagaatctagagagtcactgtgtgttttgaaaccctactctataaaagagagcagaaagcatgcaagaaacagaatacatttcttggcttactgtggggcctatactacgatttgcactgaaacaattaaaaacccaacttacactgaatttcttaaaatccaaaaatttctacttgtgatttagaaaaggtagaaataatatattcataactttgcatatatcaccatccagcctgacactgtaatagtcaaaatataaagatcaataaaacttttctctgattatagcacactgtcaaagttaccaaggacagtgattcagttttgtttgcatgtttccaaagagttgcacataaagaattctacatttagaaacattaaattgatgagctttcctattcgttctgcccacagactaaattaatcctatgactactggtgtaatacactcttagaaggtaacaaaactttctaaaaatgcttacttaaaacatggtaatagtagaaaaagcactttttaccttttcagtaataatgcggttgacacattgctttccagtcaatggtaatgtacatttctccatgattttatgtgcatttccctgttttaaaaagaaaacatcaaaaagagtagttagggagcaatttttatttagaattggcataactataggataaacagaaactatcagagaaattgtctcctaagtaaagactctttcagaatttttgcacagttacattttttactctttttttggaggcagcttctgtacctgcaataatttagagaatgccagatgaatggccaaaggcagaaatgatttaattgggaaacatcctgccagaaatttgacttctcaagcctcagcccttgtatcatttgaagtgaaatgtcactaatatcctgattatttttcccttccaaggaatggtctcctttaaaaatgtgagcagatatctgcgcaggatgcaaagcacatacagaacacaaatgcgtaagtcctcttcttaaaaaatactttatctgttaaaaaagtaatatgtacatggaaaacagcagtgccttgcctcccttccccactcttagacttgctcttaactggaatccattctagtgtgttttttggtttttttttttttttttttttttttagcattttcttctaggtttctacacattttcttcttatatccacttttaaaatactatgtttaccatgctacttcttgattaatcaattttaaacagtatctattcatttcctattgtggcagaggaagacttaagaaaaactaaaagtggaaaaaatgttttcattcattgactccctcctccagcccctcctcccacctgcaatgtagaactggcctctgaggcatgtctgaggaacacagttgaaacattggctctgaggatctgatcttcagatcattttcttctgttcatgattaagctactttttaagagtcaagcaccaggagcctaaattactgtctcccttggggctgatagctactctaacatattctagatcttctccaaaaatgacaaaatgcttttattgctttcttttggatctaatgtaccacatgtgacgccactatcgtccttagccatctcaatgttttacctgcttaaatgcacacctactatctagtttatatctctcccaaaactggtgtcaggctaagtatatgggcagaggctatgaatttcagataggtggactccattaagatttcattccttgtgatagcctgccaactcagcaatgcactagtaattaaggggctttaatgtacttaagccagttcagggaataaaagacattcagtagtttttgaataaaggcatgtaagaatgaatgggaagagaaacagaggtaaattgggaatcttggatagatttttaaaaaaactattactttagttcagacaaaactggtgctaaatacatatgaagtaagttgacataacaccttttaaaacaattcatatgtttccagatcttactgtatatgaaaatttatagttgcagaaataaagcttcattttcacttcacttctaattatttttcttttaaaatttcaaattctgcacgacacagaagctaaattaattaaacagctgaaattaatgacaaatattcgaacttctacagttgtcaggtctccttacatttaatataaatcaaggcatgtcacaatgaattctgggcctgacttcaaacaaactgaactatctgccagccactgaagaacattttctgcaaggagctcttacttagttctcattatttgagcaagatctacatctggcatgagagcagccacttggattttaatgaacaatcaacttcattttaggaggaatcaaggatttcaactgacagaattggctgtgccctaccaatggagacctttttctagaccattctctgcatacacactatagcatagtggttaagtgcatgggctagagccaaaggacctgtgtgtaaaacctggccatgccccccactgtctctgtaagagccacatgcccatgcttctccatccaccctaccttgaaagattagataagttctacatgaaatgcaagggtccagcacttagtgcttaatgaatgttagctggtactgtttttaatacaatccataattaatatttctaaaacctgcgaggaaattaagttcctatatgaagtctgacagaggattatgtagaaaatggcctaaatacaattcctgagacacataaaactagtgaaaacacaacacaaatttgggggcaaaccatatggctctcctaagaaactggcaccaaatgtattcctgttagaacaatggagctagatgattccattcacatttatagtgccaggacataacacagatcaaggaaaaagaaaatgagatgcagaaagattttaaaatgtcacaatttcaatattcaataaaaggttagctatgaaaccaaaatatgactagctcccatgttagcactctattctaaatatgctgggctgagccctacagtatgctatggcagctgcatatattagtgactcacaaaggaggaacaagtgctgaggttttagcatttaaaaataaatcctagtaaaggaatgcagtatggtgtgggagcaaagagcactctactaggagtccaaagaccaggtttgtagtcttagttctgccatacaatttttgtggtcccttaaattctttgtgccatagttctctcttatcctttgctttatcctccttacctgatcattgtaggaatcaaatgaaatgttctgaaactgcaataaactagggtgggttgaatctaggtgcaaatatacagggttacgcggatctcattcatgcttatatattgcatttctttccttcctcatgaagggttgtcagaaaaggcagagaaatagatacaaagcatagcattaaaaatgctttgtgcatggtggcatgggtcacacctgtaatcccagcactttgggaagctgaggtgggaggatcacttgaggccagcagttctagaacaccccaggcaacatagcaagaccctatttctacaaaaattttaaaagttagccagttgtgtctgtgcgtgcctgtagttccagctactcaggaggccaaggtaggaggactgcttgagcccaggaggttgtagtaagctatgctcatgccattgcactccagcttgggcaacaaagagaactggtctcaaacaaacaaacaaaaacaaacaaaaaaaactgactagtcctgaggctcctgatttcaatatgcccttacttattaacttcatcacaacctttggtgaacatctaccttctttcctgcatcagcttccctaatctttctctttctccttcagcgcttacaggacttgagcaatacatagggtaattcaccattttcaagtgactaaacactctagtactttctattgcttgcttcttggtgatctctttaattctttagatgtctgaataaaatcctgggcctaagttctgcagtattaaacaactctagttaaatagtaataaatccctttgctatcataacaataagtttcatgttattgcaatgaacttaatcccaaatccaaataagctctttatcacaacagaatgatttcttgcatttcatgtcaatacattcacctgaaatctttaagactgtgctttatacaaaacctcatttcatgctcatcttttctgttaagtgcttgttaaatgtggctgcaatacacacacacacacacacatagacacacacacacacatagacacacacacacacacacacacagacacacacgtgtgcacgtattttttctctcagtactttctttggcaaagccctaatgatcaactacagagaaggcaagttctgggatttgcctgctcctaaaaagaccaagcctttcagcttttgttcatgctgcctgttagctggaacacataccaccacatacctcatcaccccagattcaaacggcaacacccttcctattcaggagttggctcagacaccatcttccctaggaaaaccttcatccagcatcctcatctggtgctgcagtcatgttcccatgggtgtccccagtgtgtggccctcctaggtgctcctgtgcttcctcctcccttcacatgttgacctcttgccaccacctccattagatgctgagctcactaagctaagactatttttcttcatatgtacagccatgagtagaacattaggcaaactacagtgatcaataaaggctgcatttctgattcaaggaactccagaggggagctataaaatgccatgtgactaatgtctatggaccactaggggctgcctttctagttctaagataggtactcgtacattcctagtatctctgagctcactagaagcagcacagctagcagaagcacatgacggggcttataagactttgggaagacagataaaggtgtgataaaaggaagcagcaaagacactttaggactgtagcccaaaacatacaaatgtgaaagttaagagagaaacagtgaattatagttattttacctcttccacctgctcccttctaaagcttaaaggcacttgccataatttgctgaaaagaaggactacaagggcttcttttaatttaatattcttggcaagagaatattaaatactttgtctggtagaacaaggaagccaatggcaggtctatctttgggcttgccaaaatatcatggatgaagcctgattatcaacacccttgctctttccttctcccacttaatctcaatgcttaaatcaagcataccacatacacacacaaatacaataatgggaaatgctgtattacaaaatacatgactgtcacatcactataactgatgtagctggattatttgtaacacaaaagatacatgcttgagaagatggataccccattctccacagtgtgattatttcacaccatatgcctatatcaaaacatctcatgtaccccataaatatattcacctattatgtgcccacaaaaattaaaaaatttaatttttttaaaaaaagaaaagaactggatttgctaaataaagaaaatcaaggtacacagaataaaaggaaagaatgagattactcacactgcatttgtcctcatgggatatgattgacctttatacagcgcctacactatagggtttccaacaatccactcaggacttcagtagagagactcagctaacttagaagcagagaacatttgctattacaaatgatatgtggaggtaatatatggaggtaataaaagtttgtggttacaggtatattctcaaggggaagactagccaaatgaaacagtagatacagcaagccatttgcctgaaaaacggtcttcagggttttgagatcttagaatagaaggccccttatacactgtatcatatacatttcttgtacactgtatcataaaaatcattatcatagacatacttattttttctaaaggttgcgtcctatgatctctaacctccagagggcagagcacagaagtcagcaggaattactttctcttttcattcatgaactgttgtggtaccttagaaagcctctgttagcattagttttcctttttattttagaaaatgtggagacttgtgcacataaatgcaaagctaaagaatttaaagtgataaggttaattaaattctgtaacacattttaaagagttttactagttgttggactgtgttctgctttttttctcccattttataacgtttttgcaggcatttctatcataaaggagaaataaaaaggcaaaaccatgtaaggatttatagtttttaaaggtgaattttttttccccaaacagaacctggctactgtatattctaattgaagctaggaaagaattatacgcttttataaatgagaaaaaaattaagctagctgaaactcttattaattatgaattctcctaagaaaagaatactttcattttgagctacttttcaatgttgctgaaaattatctgaaggatgtctcccaagaaagggttttccttaaaaagccttcatatttgttggcttttgataacacatttcatccaaaataagcaggattaataaactccatttaccttttataattcttctccacaaaaagtgaagtcaagataagatagctttcagctctatatgagacctgtgctatagacacagattaaaggctgaaatgaaaagatacttgactataatttgaatcaaggtgaagaaataaagaacagcaggaaaggtaaatataaaaggtcacctaaaagcaaatattggtacacataaaggtacatacataaatataacatttcctttacaagactgtaaacacagttgcataaaacaacaattataaatatgttctgatgggcagatgagtataaagatcgctacagtttatatgacaaaggcagcacaagccaggagagagtgagtgaagctatatgagtatactttttaacactaataagcttaaggtaatccaaattaaaaaacacaaggtttattctttcattcaccaggtttattctcaacttcataacaattattctttttatcccttcagaatccagacctcctattgtaatacaaaaatctaaacctgttttagtaatagagttctcattttgtctccaaaattaagaaaccaagctttgtttgttgccattaaatgacaacagtaactgaattcctttgtttttgtggtctgaaagttatacttaggaacacgtttcccgtacatgatattgagaacaaaacagattcttcatgttgttagtggtaatggtgcttgccagcagaaaagcttaacaaaaggaaaaggaagcccagaggcagaatgcatggactctgggcttggttttactttttattttattgggttacttaacctctatgaaattctgcctctagaaagaaaatatcaagaaccatctcatgagagggttataatgataaaatggagacagaagcatgtaacaacttggaaaagttagaagtgctttctatatgttcaaggtggattacttgaaaaattaattcaacaagtatgtattgagccatgatgtacataaggctctattctactcggtgcttataacagagcccctgtcttcatggagtttgcattctgctgaagaagggggagaaaggatcgtctgaagacggaagagttctgttgtatataataaggtagtcaaagaaagcttctctggtattttgagtctgagtgaagtgaggcagtgagccatgtggatagctaggaaaaagtattctaggcataaagaataacaaatgcaaaggtcccaaggcaagatattcttacgatgttctagaaactttcaggaagtgagtgagggtgaagttaagtgggcaagagagataacagattcagagaggcagttggggtggcaaagcagggggagtctacaaaccatggaagtcttggagacaatagtaaggactctggacttgaatctaagtgagatgggaagtcattgagggtttttgagctgccattgagggtttttgagccaacaaagaagtagcatgatcccatttacattttggcgaaaaaaatcactctggccactgtgtgtgtttaagtgtgagtatattttttcccactcaacctttctcgctttgttctttgactagagggacctaattataaatctcttaacatgcaccatcctcccacacaccagtgtctattcttttatttcctgcaacacttaatccctgtcaagctgccccatccctcagatctcctgcaaatactccatacatcccatgggaagcctctttgttgctccccaacaatggaactgggaatgagatgccaggttctgcaggctctgctttgctcacctttcatcttaagtactgatttccatgactctgcccccataagactgggctgcctgaaggaccatatcttttttcatttcctcagagcctatgatagtactttgtacatatcaagtcctcagtaaatattttatgtctgaataaacaagtaaattaacatactcagaaggtaattttaccaaaattcaagacaaaacatcaaagaatattcctttggtcattcacaatgtcgagaggacagaaggaactaaaccagcaaattcataaaacattggctcattcatctatgattttacagaggtaggaataagccagataaagagggagtgggcactgaatgtacaaacacctaagaatgggaaacaccatgatgcctttctgtagatcttagtagaccttaagttctgcgggcaaggatgagataggctgctggggagcgaatcgcaaaggcagatgggctaagtagaaccaagcagtgttgactatgtttacagattttaaatagcaacaacttcatctagctttagttttagactagtcaatctggcagtcgtgtgcttgattaccaggacgtaggggcagtcagcagtcagggacctttggaatgctgcagtagtgatctatgcagatgtaaagaaggccttaacagggataaacagagtagaaatacatagtggggagcagactacaagagtcacattgatgcaatatttatagtgcttggtgtacgtaggggtaggggcagagagggaccatggatgccctgccaaatgataactgggagatcatcacttctctagttgggccaaataagcagaacatatttagggggaatgatgatttagttggcaaaatttgttgcagatgaggtggctgtggaacaaccaggtggagttgtgtaataggaagttagaaatatagttctatggctgatcagaagattctagtgtggaaaaatgattaaggagccactgagtgaaaaatagtacttggtaccaaagattcagatggcaccttagaaggctgcagagcagagggcattataaagagttctggagggaacccataaaggaaggaatggggaatctatctatggatacaagtggtggagggagccactgagtgaaaaatagtagttggtaccaaagattcagatggcaccttagaaggctgcagagcagagggcattataaagagttctggagggaacccataaaggaaggaatggggaatctatctatggatacaagtggtggaggcagctctgcaacccgcagcacatggtttacaggtttgtacccaaggctgctgctgcagtcaaggcctttatcagacagagggggcatagaaaatttaatgcaattggctttaactttaaagacatacctcagaaattacatacatcataaatactcaaatcccactgacccaaacttggtagcatggatgtatctatgcacaggaaggctaggaaatgtagccagtcactgggtttatctgtgtgcccagataaaacagggaggagtctaatgcaaaaaggaagaaatggagataggtattagaagatataattagatttttggattattttcttttaaacatattgctgatgtaagtctcacctaagcaaagagagctttgtccagggaaaatgaaaaaaaaaaaaaaaaacctgaagcttcctgaaagggcagatgtgggtgggacgctggtgcagaggtagctttgtgaggatgtggcatggtgcagtatgaacacaggctgcaccacactgaatcaaattccagctctgtcactttcctggataagcttcttaatacccatatctcaaccttacttcagaggatcaatgagattaagcatatgcagtgccaagcacagcacctccacctggtaaggactcagattgttactcctttcctttcttcacatttttaaagggcagaagataagatatacctagaaatgaaaaagaagcttaagaagaaaggtggctggacaccaaaaaaaactttgcctacttcaaaactttgcctgtaactctgatgtctaggctcaaatgaaaatcaagttacaatgccagtctgacccgtgtgcctgacatacgttgcagaggtagtctgagggcaggtgttactccagagcagcacccgtaggtagccaggtctcaggttttagaagctgctggagtctgaactaaaggcagtaactggttgcaagagtttcctttgtcttattaaaacaacaacaaaaaacacatttttacaaagccaagcaatgctatatttataaacaacctgcaaattaactgtaaccctatcgataaggaaatagatagccctacccgaaaaccagttaatagctctatccacttacagaaaaaacaaaacaaaacaaacaaacaaaaaaaacagcaaaacagcagcacaagaatacaagactatatttctcaggttttaatccttctttgcaaactttactcccatgtcttacaaaactctagagattgctcccctaggctgttcacttaatcataaggcagcagaagttacctggcatatctaaaagaacagattcttaactgaagagattaccaggagtgaaaaaactctcttccctacctcttttccagctcttctcaacttttaaccaaagcaaaagatgcaaaaaagaaatagcaggttccctgtcttcccttgagctgggccagtaaccatgagtccaggtgaacaaaatagtagcagctacatattcgagagccacaagtaaaatgtgtgagaagagaaactgttgattatttttcaaaggttaactgtttactgtgaataattcattactattattttaatcataagtacattgttttattggtttgttgaaatgaaactatctacggaaaaatacctcattccaattctgttttaaaactcagtgctaatttccccactgagagaaggaaagaagtaaaaaatatgatctttcttctgtggaaagctttaataagatatttctagtctgaagttggtggcatcatttattttcctctatcagaaattccagctgaggagaaagaaaggacttgggtggaagaaaagaatttgcaaaatataggcctaatgttttgaaaacaaatacacaaaaataaactaaaataagttgaacttcagtgccttcgtgtgtcaatattaaggttcacaacaaaaagaaagtctgaaagagttttttccaaatagacattattttccagaaaagatttggatttgatttgcatgcttggcatcctcttgcctctgaaatgaagtattttggatgctttgcaaggcattctcagaagtcacctgtgctggtaccatttctattattccatatttatgcaccactgctcacctcccactgtttactcaatttatgataacacatatttatagctgttttcacaacaaaatcattttgtggcatacatttctctgtaaccaaactttcccaggggaagcaggtgggatgtgaatcttctagttccgtgctttaacataatgctgcatcactaaacaaaaagagggcaaatgaactgtcatttccactcagattagcaggtctcaaagtgagaagaggtagattttaaaactaagaatgataaagaataaaggaggatgaagagaaggcaaagaagatgaagaaagcattcaatatcaacttttaaaatcagtagaagccaatgggttcaggttaggaaggcaattaagctcagttcgtccaaagacactgagtcaggaacaaggaagaaacttacactgatagttccttggtgagacaactgggctttggaatcagagacaccaggtctaatcagagttctactagttctaacagaacttcgggcaagttacttaacctctctaaagctctgtttctggacatactaagagcacttatatcaagttcatgggcccatacatatacacagagcttggtgtattcttggcacacagtaaacactaaaaaatggtagctattattattgcaatgtgaaggaagaggaaaaagactgaatgtaagcttcatgagatcagtaatttttgtccagttttggtcactgccacatcctagcatgcctagcatgtaacaggcactcaaatatttaatgatttatcaaaataaaagtataatacctttcagagctatcacctagtccattattttgtaacatcttctggatacggcacctcacagctttgagggccatatggtccatttgaaaataactgttgttaagatgtatgttctgttgtggcttttcatttcacgcacagatagcaaccactataatcatcttaaaacctgaatcaatacatccatacagacatcttttcacttcctttggagatattaaagcttttacttttaatatgtatgcataaagcttttacttttaataggtatgcaggacaaatatttgaagaacatgctgatgtttggtttcactcaaagttaaccatttagctaaataaataataagtaactgtttttgtcatctttctctctcaaatgtaaatgctatcaccttgaatgagccagagaaaataaaatccacagttaggtgacctggtggtacactgggttttgatgtattgcaaatttccaaaagcagtatttggggagcacagtacatgttacctttgcagaatgctccatggtgaccaccactttggttttcgcactggacactaaatccatagcacctcccattcctttcaccatcttcccctgcaaaacaaaaaataaatagctctgtatctttcacttcttttgtatgtgacagaacaaaattaacttgcaaaaataagctactagaatcattaaaaactcattgtccttcattgcttagtgcttgaagttctataacctaatattctgtcactctattattctgtggttgaaggataaagttcaggataaacattacatcacttttattaagtgtggctaatatgattttcttgacattttagcaataagacaatcagtggattaaaaaaaattaaaaacctttccagaattctgggacattactattattacactatcagattgaaatccaaacacccctgacatccacttctttttaaacacaatcaactctactgagtcttcaattaagggcactttctaaagtactcttggatttcctgcagattaaaattccattatgtagtagtaggctgaggcatgaatggtgtttttctagtaatggctaatatgaaaggtggctctgtctttctaacacttggcatttatcttgcgcttagaaaaataaaataaaaaacattcttgctaagcaaaaacagaacacagaaacagagttcaggatcatttcaccattatcattctatttttgatcatctggccatcccttcattcattatacttttaccaaccaccttctatgtaccacatgctctgaaaaagtccatccgtctattctgtctcctgcttacagagttctggaaaaagcaagtgtttccagagatgataaaatgattcttactcaagtatattgaggagaaatgtctttgaactgaaacctccttaaaattttatttattttttagcccaagtcctcttgctgatttgccagtaaagtcttagagggctcttagctcctttctgataatgttagagctataaggagatcaagaaatgcacacaacatggctttaaaacacggtctcgaattccatgattttggagacattttacaggtcaatgaaacagaacatgaacatgaattagatgagcagtatgaagaaaagaagtagtcaccacatttttgtggtttggaatctgtcagtaaataagatagatggcagctggcaacagctgggggacaagggatgagggtggcaggggagagaatgcagagtacaaaatgagcctggtttcagaccgtttgaagcagaacataatgtggaaatgcatacttttaaacttctataagcaatgccttcattcttagctgcaaccctaataaactggggccaatttattaagttggtcataatatttctgtagagaacattgatatcgtacaaaatataaataagtcagagatggaagcaatcaatgcctatcaaattctaatgagaaagtttgagatttgtagagcaacaaaagacactaaagcaaccctatgataaaatgtgtcaatctgctatggtaagaacatccaggcagtctcagtttctatacatagtgtccttggcagactgagggggcgagcgctggaagaatgaaaaggcagcagccaaagaaaaccagaaaccaagctagagagttaacaactctttgaattaaaaaaaagtccctgaattagaatataccacaggcaaattctgtcccctgtgacaaaatggttacataggtaaaaacttatgacagcctctaacaagaaggaagcctgcccaatttagatgaatctgatttatacattttaaattactgtcaattagtttagaaatatgtatagaggccctgcagggtacaaaccagtgtgctggcaagaatataacacactatgaaacatggtagaccaagcatgtctgtttttgttaaaaacactcttgactcaatataagtgaatagccttcactcaaagagattcagctggcttgatgtctcatttccaaagcacatgttacaacctttaaagcactattttgattcttaaatttaatgcttgtttccaagagtgaaaaatgcacaagattagatgcagaacacctgagatctagcctgttaactatgagtcaatggcaaaacaccaaatctctctgaatttgtgttcattatctgtacaccaggaataagaatatctgtcctaccatagagctgtggtgagcactgtatgagatgatgtatgcaaacgtgtaataaatagagtttataaatgtattcacttatcttcaatcaattcaacttactgaatgtctagtataagtgttgctgtatactagggtgctagagtcagatcaaaacaaggtccttctcctggaaaagcttgttgcctatggaaggaaaagtatccatgaatactaaaagactcagactacacttccttcctctaaaaggaacattttcacctctctcttatcacaaagtacagataagtgtcttttccctaagcctttatactattcagtatgtaatgctatcacagtgaatttcaactgttctctttccctgccttccctctttctcttcttctctccattataaatatttggatgagtgagtggatgaatgaattaaaccaacaaaggtataacactgaggatgcaactgctaactgtggctgggaaagcaggcagggaaggaagtagctcagggagattcccaaatgaggggattcacacaagtagcccattaggtggtaagagcaatactgtgaaagataagagcagtatcttttaatagcatttctagcaggtcacaggaaaaccttcaaatatctggtttttctgcttttagtgtgttcactgtattggaaacagaaaataaaatgtttccctccatttcaattcccaaaggatttctgaaacagtccattactaaaaagaagaaaaggcgttctatttataccaggaggaaaataaaacagggttatacaaggcatactccctgacataagcgggaaatgcatcatcatccttcactccagcttagctaggcattcttttgggtccccaccacttgcatctcccagatctctattccagttaggggtggccatgtgcctgagttccagacaatggaaaaaatggaggtgacatctatgattttcagctctggcctacaaaaatctctttcatgcagttcatgttttttcacgttctgcaatctggacgctgacatccaaagcgactttggaagatggctgagtttccttcagccttggtccttaaaggaccatctgttgcacagcccacttctttggaactacattgcaccattcaaaatgagtaaaaaaataagtgcacagggtgctaagccactcaaactgaagggtttatttgttacagaagctagtatgactaatatattaaagtggtgcccaaattatatggaagggtgagaattcagtgtcaaattagaactgttatagctgcacaacagaaggggatctgagcaaagctcttaaggggacattttactactgctccctgagtgaggtgactatgtcagatgctgtcctaggcagagtaattcacctttctatccagatgtccaacacactgcttgacattttgcagaggtaaaacatgattgctgagtgaataaaatgagtgagtgaatgaatggatggaaagaattttgagaagatgagagcactacaagttaagtgaatagctgaacaggggaatatagagtccacccccatccctcatcttcatccccaaaattcaacatcctaattcaacatacagaacaagaagctgataaaatggggagattaaggagctaaaaatatatctttaaataagtcacagagggaaagtgatacttggggaaaataggcctataatgaagaagagcttctgggaatgattgaagcattgggccagcatgacacaaagtatggctttctttaaaatctcatcagcaaacatacatttcttaaaggatgcaactctagttctgaaatgcgttctggctagcataatggagagatgattgctggatgctcatttcatagccaactcatctttttgctgttaaggattgaccctgatagcaagtatggaaagattctgcaataaaatgagctagcaatgccgcatgctccatcacaacagttatacaacctttctaaagatactgattcaagtatcctcaattcacaagtatttactcagaatctattataaaccaggcaccaagataggaattagaaataaaagatgaatatgatgatccacttttttctagaaaatagatttaagctgaaatcaataatttcacctattttgatcctatttcctaatactagaattttaaagaaagtaagagaaaaactattataaattcagtaacattaaaaagtcaacacatcaaagtatcaatattacattgtactccaaaaaaaaaaaaaaacaacaacaacaacaggaattcaagttgtaaacatgatctttggtgatattttaaggattttacaaaaaggaaaaatgaatgcatttgaatggttctgtgaaatgctgtttaaaataaagtacaaaacacactgaaaatcattcttgccgttacctttatcattagtacataaacagtaatggctcatttccagatgttacctctaaatattctggtcttaagtgagaaacaatttataatatatagaaacaattttaaaagcattttaaagtaatgctatatgccatagtagaaagtgtgaatctattggaagtcaaagggaaagatcattgtagaatgatttattaataaaactagctcttactgctcaatattaaataccagaacattaagtacccacctcaatccaaatgtaagcctctttatatctgtcttccccattattaaaaaatgctctagaaaagaaatagtcctctaagcatgctcctagctaaagagtaggagagaggaaaactgagaaagataacattaatttaaacatatagtaacaggttataaacacctttctctaggaaaaataagagacttaaaatttgccttagtatagcagttatagcacagttacatgagaatatttctcttttctgtgttacactttcttttaaaaaaccaaaaaaagttattttcaaagattaatggcattttctaggacaggtgaattgattatgtaaaccaactaatatggaacgagaaatataattatattctctattgttaggttagcaaaattacttacaataaaaatcagttatcaatcattataagggcttttcaaaaaagcatgtcaaaagagcagtattctgataaactcaaatttttattttaataagctctcttgttcctgttctctcagggatgctctatgtcatcaattagccccattgctccagtttctccatcctctctccatggctcctctctgctaattccctggagagagaaaatcttgtttctgcttgactgtgcccttgaagtgagaactctactcagtcacgtctctaatagttaatcatctgattgagtagacaccttgtggtgtctactatatatctatctagtatctaatatatatgtgtgtgtatatatatatatatatatatatatatatagtgtctactatatatctgtctacattcctatatctatctactgcatatcacagtgtcttccattcactccttgaaatcctccacttaggggcttctatggtcctggttcctcctactgctattgaggctttcagttttctacctagcatcctttttcccagaacactttatatgttggccaaattaacagctctgtcctcagctcttgcctacttgttctccaagagtgactccatctagtttcatcatatgaactgcccctgtctctgatgagtcctaaaaccacatttccagctaaggtctttgctgcaagtttcagacttcgatatccaaaagtgtccctgtcaccctgtggcacatcctgttaactgattcccaaaattgttcctttattcctgagctcatagttaggctacattttccagccttccttgaagttacaattggtcacatggaataagttctggacaatggaaagtgaaagtgatgtatactacttccaggtctggaccataaaaccttgcaagaacaatcctccacattcttctaccttccgcaaactacaagttgaaaatggtggagctgtaggatggaaggaatctcaatccctgaattactgcacagaagagagctgcctgacaattagggatactcatttggttctaggtgaatgagaaataaaaacttctgttatattaatacatgcctcagctcaatatgatccaaactaaattaagtatcttcataaaggcaaatctcacccacctgcaaatttcctggctcagttaatggccaatcatccacctcaagatccaaatcagaaacctccttgtctcctgcctctccctcataacccacatccaatcagtcgctcaactactaagaactccacttctcccaacatttcttgagcttgaccttttctcatcctagctaagattcccatgatttctccctaaagagttatagtagtctccttactggtcaacatgtgtccagctttgtccctctctgtccaacttgcagccacaaaaaccgcctctctaaaatgcgcatctgaatacgttgctcctctgcataaaacccttcagcgcttcagggtaaagtccaagcacctcagcctggcattcaaggtctgtaataacctggaccctcccctcttcatttcctcacaccccagttcccatttccatgccaggaatagtgagttgcttgtacatagcatatggctcccacatgccttgaggtttctccttcatactatgaagtgagctccggcttattctttatgtatcaatcatgatgacttctctcaggaagtgttcacagacctctgtcccacgctatccacatgattattttaggaacctctcacagcatacttgcatattcccattttaaaatttaccacattatcagctttaagatcagggctgatgttgtagtggcaggtagtgacaaggccatacaagtagttatgatctctcccttatgagacacctcccttctctctaaccacccttccccccaaaatttaataattaaaaacacaatagggagcctccaagaccccatgcagctatgactaccagtgctcacatctgttctcaaatctgttctgatttctcacatctgttctgattaatcagtgcctgtgccttaccacctaatcaagaccacctgtcacagggccaggtgtggtagctcacacctgtaatctggacattttagaggctggggtaggaggatcacttaagcccgggagtttaagaccagcctgggcaatatagaaagaccctatctctaccaaaaaaaaaaaaaaaaaaagtcactagatgggatgatgtgtgcctgtggtcccagctactcgagaagctgaggcaggaaaatcacttgagcccagcaaatcaaggccatgctgagcagccactggactccaacctggtcgacagagagaaaccgtgactcaagtaaaaaaaaaatcacctatcacagatgtaggatatcatcttgcttattattattactattattatttttgagacagagtcttgctgtgttgcccaggttggggtacagtggcaggatctccgcctcctggattcaagtgattcttgtgcctgagcctcccaagtagctggggttacaggcacgcgcccaccatgccccactaatttttttatttttaatagagacggggtttcaccatgttggtcaggctggtctcgaactcctgacctcaggtgatccgcctgccttggcctcccaaagtgttgggattacaggcgtgagccaccacgcccagcccttgctcattagactatgagccctttgccttccctgttcaccttcaacccagtgcagttgctaatacatgatagcttgttttcactatgtatttaagtaaactgaattccatcttcaagtttgtttctaaaaaatacagaatcaaaaagatattaaggtgtactaatgagagtaatcaaagctagggacattacctacagagaaaatgatagcaagaagaaaaaaagaggtggctaaaataaaatgtaaaattaaaacttcacctcaggaagttgcaaagctatagagaagaaaatatggtgtccttcaaaattgaccctactaaggacattttttaaatatcttcttcagggctgaatgttaaataaatgttatttaatacatatctgaactacactgaatttgctttttcaagtggggagaaaaatcatttataagacacccaaggaaaagtcctaagaaactggataccccaactattaatcattaattaagcatctacttaatacctgttaggtgttctgtgcttttcactaagcatacaaaactcctgcttttaatagcttataggtcttgaatgccctctcaatgtttctgaggccaaattaaataaaaaatgcaaattctaaaatcctaaaactaccacttctgttttctttcaaatattcacaaagggtaaaatccatttttataaattccactataataaatataactaacagaaccactgatgtgtatcaattcaaaatgattttatgataattgtatacattagatttgataaatgtgctattttctgactccaggcagaatatttgaaaataaaaaattactttacagaaactatctatactagttcataccagaaactataccaaaaccacatcaagtttctctaacacattgtctattgcaaatgaacctgaacaaacaaaaatgtaagtgaaactcactttattaccatgatcagagtcttcattcatctattgtaagatagtccagacaaaccactttatgcaggttagaaaatgtcacaaatgtaataggtttgattcttaaagaaatcaattaacttcaaataagaaaaatgagttctgttcctagctattaattacaccaatttctctcattttgtaaaatgtaaataccattcaagagggtctccatagttcacttatgaaacctcattgctccaagaaaaaattccaatgcatacaaaattgtcattaattatacaaggtaattaactccatctctgtataagaaattaataagtatttattaagtgaacagttagaactatgaaaccaatgtattttctcttctcaaggtacaatcaatgtgtgacaaagttttttttgttgttattaaggcactttggattggttaagctctttgtataaggtcacatagactaacactctgatctatttgttagattttgaaaatggacagcaagagaaaaacgtactcctagctctgttctgaagctgcagttgcagttttcatagagtctattcataatactacagagatgaaaacaaacatcagacaatatggctaagtgaattcagcttgttttatcaggcctcttacagaaggcattgatggaaagagcatgaccaagtgtttcaggataaataaaaaggtactctaagttatttgagtttattgaatatagctaagcactggagcttctgggcctgtatactacccagaaacagaataaattacatatttaaaaatccagggataagttattttcttccttccactgaatcgctgagagaaatgcattagaatcatatgaaattgctcacataggagcatgtatgacctgcaaatacaggaatttcatatggttggttcaacctatgttctaatggtgaggtttaaatggtcacaattactatcacataattttttaaaggtttatacttttaggaggtctccaatagtcattacaaaataggaaactaaaatacaaatggaaaaacatcatttatgtgtctgcatgtactaaaatatattaatctcctcaacaactcgttcacatggaatatggaattattactatttattttgtcatcaggaaatacttgttctcagaaagtttattttctgattcctcaaagaggatgtgggttggttggggagaagggggagggaatgagaactagaaccatgggcagcacatacttgctccatcacctcctcccactgtctgcaaagctctaagagcacaattagacttaatgtaattacaccgccatcactgacaggtggatgagattaaaaaaaacaaaaaaaaaaagagagagagagtgactgaaagaacattaataaattgaaatcattaccagtgtttttttccacaatagaaaggatcagaaagtaacacagaagataaattttaaaggttaaaaaaaaagcagttaagagcaattgcaaaagatcatgctatgtataataaatgtacgtgccctattaagcaagtattataggactgggtggaagaatacaaagtattttgattctacattaaattaataactactgtttatctcaagatgtcctctggattcagttgatgaccccgtttaatgactgcttaagtacctactgggaattaatagctatgacattcacagcaaattgataactctgtgttggagtcttaatttgttctcctgtgcaagccttactctgtgaaataggaacccagtgcttttcatatgtggaggcaagtctaaccaccggtttgctaagaatgcacaccctactctcaggacaaggagaaccatgggcctcctaggtaacatcattccacacagactcagtgcatggaatgagtctcaggtctgagtcccaaaagggaaaagcacatcctccttgtgagaatgacccatctctggaggcaacagagaatgctgaagcacaatgtcactctgggagggtcctatcatcacaggcaggaaaaacacagtttctcctttcaacaccaaaaccagttaaaagaacgactttgggcgatttgccacaaagttaatatttttgaaagatataacaggagattcaaagagcattaatttctaccttatctttttaagtcaacagtgccaggcaatctataagatgggggaaaaaaagtgatgtgtctttagagcaaagtaatagtgaaacaaaagctttggtgaagaacttggtagtgcagaaatcaaactattgagaacagctgggcatggtggctcaagcctgcaatctcagcaatttgggaggccaaggcaggcagatcactgaagcccaggagttcaagactagcctgggcaacatggtaaaaccctgtctctacgaaaaaaaaaaaaaagaaaaaagaaaaaaaaattaattagctgggtgtggttgcatgcacctgtagtatgagctacttgggaggctgaagtgggaggatcacctgagcccaggaggtcaaggctgcactgagtcatgactgcaccaaccaacgcactccagcctgggctacagagtgagaccttatcccttcgcaacccgcccacccccacccctctgccaaaaaaaaatgaaaaactgagaatagaatagaaaattgttttcaaagtgaaatacaaagaaagatcagaagaggtaaaaagcatatataggaatatacaaactttaactcatttcttgataggccaatgtttcaactccctgaatttcataggagaccttttaaatttctgatcttgatggtttcagtaacgttgaccattcataatatcagatatgaatgttaaatgtgtgaaaaaacagtgttttaaaatccctgtgaataaaaaccctagttacttccatttcattttatagggacctaagttaaggtacatgttaaagctagtacattctcagatgagaagcaggagttacagtaagtgagaggactttattccttttacaacattactatatagctatatgacagatatgacctcagtcacattcatctggaactcaagtgtggcaaaatacttggtggtgaggtgtaattgctaaaatgtcactatttttaatcctaagaatgccattttctaggtctggtatttggaagaaaacacattctgttgataccaccttgagaccgttattcagtaaggagttacttttttcctctatccttaggaaaatggtctaaaatggaaagttgtttattatttaaaactgcatgagcatgggttaatatgtgtgcatatattacatagctctgtccattgagaagggctagaagcaatgatagcccagtagcaacaagcacacctagcacccagatcttggttttctatatgtcgttctcttattagagaattagcttttgaagaaaaagttgactctaggggcacaagaaatataagatgagcatcttgtagtagcagaaagtaaggaagtgctcaatgaaaaacaaaaagaatggaaggacaacaaaggggtagaccagcaaacctgaaagagctcccaatggctatggctggaacaatgtgagcataaaaataaacacagggccaggcacagtggctcatgcctgtaatcccagcactctgggaagtggaggcaggtggatcacgaggtcaggagatcgagagcatcctggctaacacggtaaaaccccatctctactcaaaatacaaaaaattagccgggcgtggcggcatgcacctgtagcccaggctactagggaggctgaggcaggagaatcgtttgaacccaggaggtggaggttgcagtgagccaagatcacgccactgcactccagcctgggtgacagagtgaaactctgtctcaaaaaataaaataaataaataagtgaataaataaataacataaacatggtattgtattacaaccaaaatataaaacatacttgagaacatattgatataaacatatgattaaataaatgggagagaagagacaaatcttctctccagaagaattgcaaaatacataatacttcttcaactgtttatactcaacacttctgacatcaaatatgtggggtttttccttacaccacccaattctgtaaccagctgagtgcccaacaattcaactcacttctgaccctaactacctggaattagcacaggacccacaagttaaggattcagtcttacaaaactgctccccatttcaaaccctgatagcaagtccaggccaccagtacctctgacgaaccagctataaagtcaagaggtttctacaacccccgctcagcttcaataatttgctataacagctcataggattcaggaaggcattttacttgctattattggtttattatgaaggatacaactaaggaatggcccaatggaagagatgtatagggcaaggtttgagggcaggagcacagagcttccatgctgtatgcaggtatgccactctcccagagccctgatgtgttcagcaacccagaagcacttagaatcctgtcgttcaggggtttttatggacatttcattacataggcatgattaagtcattggccattggtgactgaactcaatctccagaccctctctccttcctagagattgtgtgtggggctgaactttccaaccctctaatcatgtcttggtctgtctggcaaacagctccatattgaagctacttaagggcccactgagagtcacattagcgtaaattcaggtatggttgaaaggggcttattatgaataacaaaatgctcctatggccctatcgctcaggaaattccaaacattttagaagctcagtgtcaggaactggggatcaaagacaaaatatattccttatcacagtttccctccaagaggtagagcttaatccccctccagatctttgagggtggactaggtactaaattgcttccacagagaacgaagtagggaagggaaaaactagtaattttatatagtgagcaaacctggtaagcactaccttcaccaagtgataaagattatcatcatgagggatgcaatgtaggtatcctataacccctgatataagaagggcactctacttctatgatattctttctaaaaacccataacccacatctaattatgagaaaaacatcagacaaatccagattgggggacattctatatgacatccagttaatacttcaagactgacaaagttacgaaaaacaaggaaagactgagaaactggcacagatcagagaaggctagggagctatgacaactaaaagcaatgcagtaccctgaactggatcttggaaaactgggtggggggaatatggaaactctgtactatctctgtagcttttctgtgaatctaaactaattttaatttttacaacaaaaaatttatttaaaaaactcagtatgtggcctgttcctgtgtttttttgtttttcatcaaaatgaaaacaaaatggttctcagatttccctcagtaaggagcaatcctagtaactctttaagcctgttgctaaacggctttgcaaaatctgactcagaaaacaagtgaatttgagaaagtcaaatgaatctgtgctttgttcaacaatgatttactttcttgtagtaactgaactttatttctttgcagaatccaacatttaccagaacagagtatgctagcataacaaagtcatgagttagtctctgaataaataagataaatctaagaacggcatgtgtgggatttttgtttttattcccaatggaaaaaactttactatccaattcattatgttgataagcctatcttgctgctagacatcttagattctgatagagctttggaaaaaaaaatcatacacatcattagaactttataaaacgatgttctttgaccatattgttaccagtgtgagaaaattggaaatacagactggacctctgttctatgacaaatgatgtaccatttctattttttaatattcttatttttcttgttatgatctactttgttcatactgaacatattttaatcaactcaattatataaagatagtcctcatcacctaaaatgtgcttgtagaatgtgtaacaagctctcctttacaaaaaaggggccgggtgcggtggcttatgcctgtaatcccagcactttgggagggtgaggtgggtggatcatgaggtcaggagttcgagaccagcctgaccaacatggtcaaaccccgtccctactaaaaatacaattattagccgggcatggtggcatatgcctgtaatgccagctacttaggaggctgaggcagaagaattgcttgaacccgagaggtggaggttgcagtgagccgagatcgtgccactgcactccagcctgggcgacaaagtgagactctgtcttaaaaaaaaccgttcaatgaagaaaagctaaatacatcacctgaagtcacagaacaagtcagaaaaaaaactggctgaagtcttttccccagcctccagaaagaggtaatcgaatccccataaaagatgcttcctattttaaaatgtccattatgttgaacttattgcactatttttctttcttattgttcctaatctgttggatggtgttaattaattttgttaagaagcacacagcaagcctagagatgtcctatgtacaatttctaaaaatacagtcagatctttcaggactaaagttacaaagctttccaatgtgcttctaaataaaccattcatcttttgccaaactgaaagccatgatttataaaaattaagtttcctaaaaactacatgattgtaagcagaagttacattcaggatggaattatgttagcagataaagtttctaagtgttaataagtttgttttcatgaagttatggcagtaaaaaagaaaaattttgccttttaatacagccatttttgtaatatttgtggattaatttttcagggtctggttatttagatctgtcctaggctacaatcataatccagaaatatgccaaacagatagtgaatggctaaaacatgtacttgagtcaaagcttatgaggagtctgtgtcaggccttcatgcagaagctatttactttaattatgcacaaatgtaaaaagatggattatctaattttctattcataactatatttagaaattggtacttacatagctaaatttggataatgtaaaaaagttacagatggaatatcttattatctaaaaattttctataaatcaagtattagtacaaatactccaatgatctactagagctatcaaatagtaatatgggtagtgttgaattgactggaaacaaagttaaaaactctgcgttttacttaaaataattccactacactggttaagaggggagagagaacggtaaatgtaaaatactgatgattttgcctggcattcagtttagagagaagaggtctggagatggaaaacgcatgttcactcagtcccaatcccatattgctttcataatgtgaatttatcaagatgactctagggtttaaggatatatgtcacatgtcatatgacccccaaataaaagccaactgctctatctggaccttaacaataaccatgatcatctgttccaatgctgatacccatctcagctgctagtatgatcgagtgctgcaagttcttcaacaatgccccaccacatgcattagacaggtaaggaatgcacacaagctagaagcggtcaatgtatcatttctgcaagtaataaaagcacttaaggttctctttttattctgagtataaatttaattgtattcctcaagctttgacacaaagttcttagtttttattagtttctagataagttataatttgtctttcttttttgatccaacgccctttgggagaagaacatatgttagattttatgtgttttgcaacttttgacaaggaagtaaaatatactcagaagcaatattggaatgtgattttcaccatagcattgactttcagaagcaaatcctcattaaaataactctccacatttcaaagcctttaagatcactataggctaaattattaaatgtagattatttctaggtcttatacgtgttagaagcctgaaccaggtagaaaaatgttgaagttttaccacctctcaaatatcgatttttttctaagtattcaaaattccccattacatagtagcatctttagaaatgtgtaaatccacagcttagaggttaaattttagctttgggttctgttagggatttattgaatccaagaacttgatttcagagatcatatatgcactgtctgataagttagactagccacatgtggctatataaatctgaattaaacaaaattagaaattgagtttgccagttatactagccacatttcaagtactcaaaagccacatgtggctaatggctcccatactgtacaagcacatatagaatgtctccatcatcacagtgagttttctggaccatactgtattagaccaacagagagaaagtaatctgtataaggtcacaatttgttagtaacaaagctaaaactagaattcaggtctttaaaattctatgcttactcactttctacaaaccacactgtctccaagaactaacacacaaagaaagtaaaagatccgaatacaataactaacaagctcaatcttacataaaattatcttattttcatgtaaagtttagaaaaaaaaatcaagttacctggccaccaagaaaacccaataaattccaaaaagcaatgtaaagagtaactcctccaagcctttaaaatttgaagaaaaaacacttatgaaaaattactgggccaaaaaagaaatcaaaactgaaattacaagctacccagaaattaatgaaaataagaactttctcaaagattatgacatgcaattaaaattatattcagaaaaacacagagccttaaatgattttataataaggactgcaaataaagtaaacatttgaatttacaaatgtagaactagtgtaacattaaaaagtgagtaaaagtaaagaaaattagtaagtctgaacatctacagcattaggataaagagaagatataataacagtctgaggaaattaaaggtatacaagaatatgacatgttttgggtgaatgaatttgaaaatccaaaagaaatggatgctttttggaaaatgcaaattaacaaaattgccacaagaagtgagaaaatttgagatgaaaaggcacgagaataacttaaaaattgttaaaaattgactatttgtattaaaaaactgattcaacatcaatttaaataatgacattgataaattcagggtgaagaactgtgattaaacagatggaaacatactgactacattcaactgccattcagtttaaaaactataagcaaaggagtaaaggcaaactgttagaacagtataaaggacatttactagaagcacaaacagcaaacataatattaagttaaaactctaattcatcaaaatcaagttcctcaatcactactatttacattgttttaatgattaaattcaaaatattttcagataagagaattgtgtagagtgtctaagaatttttttaaaattattatagctgataagaaaatttagtaaaatgaataggtataagaaatatagaaatcaacagttttcctttatattagcaatagacatttggaaactgaaattgactattcagctcaaaatattgacaagaactataaaataatgtaacaaatgtaatggaggtaaaatgagacctggagagtaaactataccatgttcctggacaggatgacttaactaatgcaaactcatttaattcttcccaaaccaaaatatttcatgtttcgtgtactgcactgaccttatagtactgtctcccacatttttttttttttttgagacggagtctcgctctgtcacctaggctgcagggcagtggcgcgatcttggctcactgcaagctctgcctcctggggtcacgccattctcctgcctcagcctcccaagtagctgggactaaaggcacccaccaccacgcccagctgattttgtatttttttagtagagacggggtttcaccatgttagccaggatggtcttgatctcctgacctcgtgatctgcccatctcggcctcccaaagtgctgggattacaggtgtgagccaccaaggccggcttactgtctcccatatcttattaacctcatcatagatataaaaacattctctgtacaggaaaggactgtattgggtttgcttaccactctacccttcattgttaatacaacacctaatacaaaaagaaaacaaaatcttaattttgttgaataaaagctatgccatggatcacattttacaaataagaagctgaggtctagaaagataaagtgaccgcagggacacagctgctgcttttttttttttcccttcaacttttattttaagtagcagggtacatgtgcaggatatgcaggtttgttacataggtaaatgtgtgccatggtgttttgccacatagatcatcccatcacctaggtattaagcccagcatccatcagctattcttcctgatactctcgctccccccataccccaacaggccctctgtatgtgttgttcccccagtggtgtccatgtgttttcatcgttcagctcccacttacaagtgagaatatgcagtgtttggttttctgttcctgcgttagtttgctgaggataatggcttctgactcaatccaggtccctgcaaagaacatgatctcgtttctttatatggctgcatagtatagcatggtatatatgtgccacattttctttattcagtctataattggtgggtatttaggttgattccatgtctttactattgtgaacagtgcagtaatgaacataacacacacgtttctttataacagaatgatttatgttcccatgggtatatacccagcaatgggattgctgagtcaaatggtatttctgcctctaggtctttgaggaattgccacactgtcttccaaaatggttgaattaatttacactcccaccaacagtgtaaaagtgttcctttttctccacaatcttgccagcatctttttttttttttttaatttttagtaatagtcattgtgactggagtgagatggtatctcattctggttttgatttgcatttctctaatgatcagtgatgttgagcttttttttttttttaaatggagtcttgctctgctgcccaggctggagtgcagtggtgtgacctcagctcagtgcaacctccacctcctgggttcaagtgattctcctgcctcagccttccaagaagctgagattacaggtgcatgccaccatgcctagcaaatttttgtatttttgtaaagatcgggtttcactgtgttggccaggctggtcttgaactcctgacctgaagtaatccgcctgccttagccccccaaagtgctgggattacaggcatgagccactgccccaggagctttttttcctatttcttggcccatgtatgtcttcttttgagaagtatctgttcatgtcctttgcccactttttaatggggttagtttttttttgtaaatatgcttaagttccttccagactctggatattagtcatttttcagatggatagattgcaaatattttctcacattctgtaggttttctgttcatcctgatgatagtttttggatacagccacttctaagcatatttgaaagaaacatggaaggttctttgtattgggatgtttttcaaaggtaaactttcccctgtgtagtggaaagagcatccctacaaaactacagacagaagagataggtcctaatattggcttagctactaattagagttttgcagcctgagctgagtcacttcatttctcctgattcaggttttctgcaattaacattagggtgcttatagctgaatgatattaaagaattatatccttaattccttactgttaggtgggataacagaattgcagtttatgaaaagaatccttttataaagaaatttgaaaataatctttcagataatgccgaaatgtttatggatagaatatgtgcagcatttgcttcaaaataatctgaggaaaagggaagttgagtacagatgaaacaagactgaccataagtggataactgtctaagctggatgtatgcatttactattctatttttatagagagttaatttaaagattttctcaaaagtgttgatcaagatgatctctaaaccaaaagaatagagaaagatttcgccaactgggaatgtgaaattcagtcatttaataaaatttagtcttcaagattcattagcctttagctgcagggtcaccagcagtaatcattagccctttggtttcattccctgctaagtcatatcagcaacactatgatttatcatattattaataatgggtttctaggaagcctcatctatcatttttaatgtttcttcttctccttttaagtgagctgtttaatgagaagagcctgctgcagtcatacaaatgcatcattagccaaaaggatatttataacaaatatcaaactcattcattgttcatgagagagacagagatcgactgattcaaagatgaccaaaatcccactctatgcaaagaagtctgcctttcaacaccagaggagatggagaatatttgattaaattcttacaagagtgtctggtaggcagtgtagcagcatggtttggaatcaggtatctagctcacctttctttcagtctctgtgttgaacatacccaagttccagtgaacagtcaaagtcttagaggtaagcagttgttcaaaatatatcatatgaagcacagcaaggagagaaatattttctttcctcctaaaaaagactcaggtagcaatcaaaaggcaaaatctctgtaagactgttgaagatggagaaactctttcacattctcatatccttttgcttctgtcaaaggttaacatgtgtgagggcctaggctgggtgagatggcttgctaatgaatttgcttttgttcctttcggatcttaatctttttaaaaattatcttcagtattcctccctttgcaataattctgatatttctccaattgtgcttcagtgtttcccatttaacaagtattgcaagataattttataaacattctttgtagagggcctgaaattttccaaagaattctttgattggtagattataaaaaacaaaatgggtaaataaaatggataaagtacttcatatatgacatttaggctaattataagtgactgggcagtggagactttagaatttgggtgaaagcttaaagaaaacgggatgcagaagaacaaacatgcaaatggtccacctacaaaaaaatcccaccatgaataagagtcatatgtactcaacatatatccttcaaaccacaacaggctttatccgacaatcatttcttcataaggcttacagaatgctatacagatttttatgtattttgcaggttgttttgcttccattctgaaaggcagttaaatatccccaaaagtacctgtggcagaatgtgaagcacataagagcaaagaagactgtaattccacttctcttttcatcacttgccacagatgtgaacttgaatagttaactcccttggcctgaatctcttcatctataataacaggaatatttgtatttaactcagtgttctgtgaggataaaatggcaataaatattcagaacctggccagtgacatgtgcttaataattgttagttccctccttgtaaaaaatagatttagaatttagctgtggcttttaaaccttaatcacagtttttaatcattgacaggatctttcaagtaagagaaattttcctgacaaaatgaatatgtcaaatatgtcagtctctaaatatacctttagtctgaaaaatattgggtgtaaataaggaaactaaacattagttttcaacatgttttccagatagtcatagataaaagtatttttgaataaccaaatatagcacccaagaaaagtataataaatagcttatgtttctaataacatcctaaattggtgaatcactaataaaaagttgcctttctaaaaaaaatgcatgcccatttgttaaatcactgtataagaggaaataatattttgctcctggaaattctgaaggcattaaatgcattttccaaacagcacaggaagtaaaggtccatcccaatgggtcagtatttttattccctgttaggacaaacagggtttggctgggttcttccacagtcctctgtggaaaacagaacaggctagggggaactgcctagaggtattagaaccatagttggaaaacacccttatatgcaccaaggcttagctgaatatgagcttgaattggcaaatatgctggaaaaatattgaagagtttttttcctcatttttaaagattacttaaaagacagttgactgtttagagcaaaaataatagcaaagtattataagatttatatcacgtgcagaattaaatatgataaatagggaggattaatggcaacaaaaaaaggcaggctcatgagcaaaagtggttggtaaccagatgttagatgagatcttgctgtctcacttttaactgatagaagagctaggggataccagcatgtaggatagatgctcagaagtagaatttacaaaggaaatagtcaaaagcacatcccaaggctcttgggaccctcagcaggctgaaggaatacagtataggaatagcaaaggttttgtatgaaggatttatttcatgaaaagtattctaactacccctacatttctcagcaaccaaggaaggggtaagggtatgcctgctgctcactccattgacaaatcagagcctgaaagatggggagtgcagatagggagtgctgcctgactcttacctgagaaaattaaaggggctgttttgcggaagtaactacactatcactggaggcagtagaagaaatgtgagtgcttcccagatgggggccatgtgagagaggaacaacctcaacaggttaatgctttgtcaacaggatagcccaggaagagggactccaccggtaagagtctatatgttaagtggaccgcaggaaagtcagaagctgctggggaagcatccagccatcacccataggagcagccgctgcaggaggaaccaagaagggggtctctaaagacaactgctcaccccactccacacacacagagagaggaagggatcagctttaaatatttttatggaccagagatcatggagccagcaaacaggattaccagtctcctgctatgtaaaatctttcctgccctatttccttgccttccctttctcttgaattttgatcctggtgggtgccaaacagtgagctggaagaggaggggagtagagaaaaagcaaaagcatactatataaccttcttcaaatgcaggcagactgtagctgggagatcaaaaatgaggagatgcattgcttttgaatgattattaaagcatttttcactgttttggaatggaccctctaatgtctgaatgaagactgagtttatgaattaaagtcacttaagagctgtttattttcctagagtgagctgaaatgtcatgcagcctgagtattcattaacagcagaggaaaagcttccctaacagaataggttaaagagtaccacaggagataaaaatagctgtattttattctatcccacatttagagcttgttcaaaatattgtaaacagaagaaatgcacacacattcacatacatgcttgttacagtggatctcctaagatacattcactaacacagaatactcattatcaatgttgttttttaatataactaaagagagcaacactggaatttgaagagagataattgctagaagccaaaaggaaggtctccaaaacaagagagaaaatgattaaatgccctcctgaagagtaaggtacggctgccccttaaacaatcccagagagcagctttataaagaaatgccaaataacgcaagaaaataatatagcttttaaaaagctgataccagtgttggtaatagagtagaaacagtgtgagagtaaactgggataatttttctggccagtaactctgtgatatatcaaaatccctaaaatactgacaaagatattctatttctagggatttgtactaagaaaaccatcagtaaatacacaatgacataaattcaaacatgttattaatgatattaaacagttagaaaaatcaaactgacatgaaaaagtggctttcggacattagaccacacacagtacgggactaccatttctgaaagaagggaagccaacaagataggtctacaatttcccccagcttactgcctggagagaatttgcaagctgcagtacaggaagtcaaactcagcaattttgttggcttcagagagcctgaggcaactacaatttgagatctgaaaataccagaaaggaggtcattatacagagtgagagctcagatttgcagaggaagaaggtctcaagtctttagcagagtatgaatatgtgcatatatgagaagaaattagtcaaagcctgaaaaagaaccattaagcaagcattaggcaaaaaaaaaaaaaaaaaaaaaaaagcccaaaactaacacaggtctaggaacaattcacaatcctaccaaacagtgaggaaagattttgtaatatatggagcatcaggcagagtcctccgaagaaaactttctcagtagtggggctataaattaaactgcaactaaaggctactctcaactaatcttaacacagcttaaaagcaaatattgaaaaagatcaacctgagagacatctatagaatttgtgctacaacaaacatcaaaggatgtccttcaagcagaaggaaaaaaacatcaaatggcaatctagatctctgcacagaaaaagtgcaacaaacagaaaatatgttggaaaaatataaaagatttttcctcattttcaaagattacttaaaaagatagtcgagtgtttagagcaaaaataatagcgaagtataaggtttatgtcacatgcagaattaactatcactaaagaacacacaataaggcagaaaacagaagtttactattgtataattcttacattatatataaagtgatatattacttgaagtagattgtgattaaaatatgtatatggtagaccctagagaagccactaaaaagtaatccaacagtgaagataaaatactcaaaaaatacgtaattgatcccaaagaaatcaaagggcaaaaaggacagatgaagtaaacagaaaaaaaaatatcctgatagatttaaacccaaccatattgatgactacattaattgtaaatggtctaaacctccaattatgatttagagattataagataacaatctaactatatgattacaaaaacctacttaaaaataaaggtgttcataggttacaggcagaagaatggagaaacatactttgaagagtgactatatcagcatcagacagtagacttcaataaaaggaatattattgaagagacaaaatgacagatcaattcattaagagaatgtaagcttaaatgtgtataaatgcaagtagtaacagctctaaaacagataaaggaaaaagtggtataactgaaaggaaaaacagacaaatccacaattatagctgaagatctcaagactgctctctcagtaattgacaagacacagaacacttgaacaatactaactgcccatttgatccaattggcacttacagaacactgtacccaacaagagcagaatatatattcaagtgcaaatggaacagtcactaaaatagcctacattctgggccataagcaagtctcaaatttaaaaggactgaaactataaagtgtgttttctgacctcaaaagaattaaactgaaaaatttttaaaaagttatgtggaaaattaccaaatatttggaaactgacacacctttaaataaacaatgggtcatacaaaaaataacaaggaagattagaaagtattttgaagagactgaaacaacataaaaatttgtaggatgttacttgcttatattagagaaaaaaggtttcaaatcagtgatctaaggcagaagttggcaaatcttttctgtaaagggccaaacggtaaatattttaggctttgcaagccacacagtttctatcctaactatttaaagcagccataaacaatacgtaaatgagtggatatggctatgctccaagaaaaatttacaaaaataggcagtgggccagatttggtacatgcaacacagtttgctgacccctgttagaatatcagctccataaatgcagagaattttgtctgttttgttaactactgcatccccaaaaacgttgtcgtttatatttaacagtgcctgacccttaatatatgccagatcaatacatgttgaatgaattagcgaatttaatcctcagaacaagcatgagttaaaaattgtcattttaccaatgaatatactacaacagtgatatactacatgatcaataagtaaagaaccagtatttaagctcaagtctgtctaattccaaagttttatgagctttccactacattacactaataagacaaaggcattactaattgtaaaagtttcatatgacctcatatggattttccacctgtttttcttttcctgagcctcaggaccaaatggacaatacactaaagttaaaacaatgtctagagatttatgcttatttcctcacctatgtcataatatatttaaatatctatattttggactaacatttggattacaattgatgcaactaaacagactgaatcttcaacacaaacccccttgtagttttataaccaggaatactagtgacttaacttatttaaaacaggtagcatgtctagagaacccaatcaattttatgtgctcagacatgtagcacacaggagtatgacattaattagtatttattcttttcaaatgcacaaagatgtgaaaaatgtgagggagaaaaggaaaaaaataaaaaaacaccaaaagtgtcccattctttcttgccataagaatgcctcattcaatcctctccacatagaggagggctcttggctcttgtgccactcacgtactgcagccctgtccagtgggctgctattttgtgctttcaataaccagctctcatagctgaccatacacatctgcttcccttcataagtcaataatcaatgccagctgttctccaaaaataggcattcagaaagcactagagcagctctgaatatagattcagcggactgcacatctttccatcatttattcgcttgcctggggttttaccatcatcacaatcagcagcgagcttgaaggagccaactactgttttgtcaagttttcctcctttggatgctcagggtagaattgttaaaaatctgtgtacatgagaccaacactgcatactaagaagctattaaacggtaagacaaatagcatccacaccgtttgcttgccctgaaggcttaatgtttattgtaatctgatgctataatgattgatgataatgtcatgatgctgagaactcatggcttacacagccattgaaagattattaaactcaggaaaaagataaaagtaaatgaaaaataatataataaagctgaatttttcagcttcttgactgccagatcttgcaataaaaacatatttaaattacataagtcaacaaatctttgggacaaataaaaatagattgcttactgaaattacataaggaaggtaagctgtatctttatccataaccaataaaagaaaaaaaatgtgtcctcaaagggcttaattttggtgcttgaatagggacttaggataagcaggttgtactggctcctgtaaaatcatctcgcttttaccagtgtattttaaggtaaatatttcctctttaattttaagtaatagagcattacttaatagccactatttagagagtgcttgcagtgttcacttttcattttcttctcacttaatcctagccaaaacatgtgcttcagatcacataatttgtaaggggtagggctgaaattaaaaccaaactaaacctcatggacttgattctgaagctgccctgagtctcaaacaatgaaaatatacatggtgcatcacatacaaagaagttaggaaatgattatcagttatgaaagcaacaaaaaaaatgctaatcagaagtaacactaccaacttccattaccaaaacagtggaaccaaacccaggaacacttcttatgcttaatttttctcaactagacttccatgatgttcctacagaactccagagttgttcatcccactaggtccattcctttgggaactcgtgggctccaagttatattgagaaaagtataaagtaataaacatttgtattttaatcattcacaggaatcttaacaggatatgtaaaaatatggtacgcattggaaaagctttcctacaaataactacatagtgtacactaccactatgagagcttccagccttactacatgctaaatcataatataaacaaatcttatactgatatgaagatgcccatgttccccgaagggaagaagatatttaacacatttctgcttcatacccaggaccactgagcaaattgatttcaaaaatcattagtctagagaaatagatgtatttaaaaccctattgcttttgttcataggacccaatgcttttctcttctttgccaggtatccgcaacttcttttttattttatttatttatttttttttttatgagacggagtctcgctctttcgcccacaggctggagtgcagtggcgcgatctctgctcactgcaagctccgcctcccgggtgcacgccattctcctgcctcagcctctcgagtagctgggactcaagcgcatgccaccacgcccggctaattttttgtattttttagcagagacgaggtttcaccatgttagccaggatggtctcaatctcctgacctcgtgatccacccgcctcggcctcccaaagtgctgggattacaggcgtgagccactgcgtccggcccgcaacttcttataagaacaataacctatttaccaggtactaagtgtcaagctctgtgctatgtactttgtatgcattgtcacatgtattccttcatatagtcctataaagtaggtactgttatatgattcccatttttacagatgaggaaaaataggaaattagctcaagttacactgccagcaagcgtcagaaataagactttaatccacaactatctcactacagggccttgctcttacctactaagctaagagaaccaaatgagacccctaaaattatctgttctcaaaccctcactttatagatgagggcattttaacccaaagagcataagtgaaatgttcaacatcacaccttgattactggtagagtcagtgctaaaacccagggcttgctttcctatagtcactctactaccccgtatggcccttttctaaaatttgaaaacagaaatacattgtaatatcctacacaagtatttccacaaactttctatctgactcactgtacgatgctcaggagaccctccctgatttttttgaagcaatcaaaagctgctaacccttgtaactatggctgattctgaaagatcagtatttttacaactaaactaacaatataatccacaatttgctaagggttcttattatgatggctcaatgatgtttttctcttacattttaaaatgaagtgagttgtaatcaatctttaatatgctggttctcaaacctggtcacatatcagaaccacctgagttgctttgaatgacccagtgtccaggctacatcccagattaattaaattagagactacctgggctggaacccaggcatcaaaatttcttaaaactctgaggtattctaatacaccaccaagtttgaaaactagggcttgaataattattaaaacttaaacataacatttcaggtggcattagatcaaatgagctagactaacatgatctctagatcaaatgagctagactaacatgatctctaacattgttatcaactacattaatccaccttcctcaaaaaattattagaaaacaaatttaagagatttcaagaaaactgtcctatcatagaccaccagcctcagttatttgacaagattcttcttagcttgttctatagagaaacatatggaaatccttaaacacacacacaaagagcaaccgggctaccagccaaaatgagctcataatcataaacatacccattattgtttccatgcacgtacttgggaagcaacatcctggtctataatgaactacactcatgaattaagtcagtgataacagtcctctttccaaagctaattctaagaggtttcttccttgatttaggtcactattaaatgacaactgtgcatttcatattaaatgacaactgtgcatttcacaaggatattaaactctcacaggttttgaattccatagcagaggacaatgattatttatggggtcacatgaccaatcaagatgatttcaatcactgattaatagaattaacaattagcaaagttaattaacaacgctaacaaacttgttaattgttcttcctagtttaaaattttagttatggtaaatatttgtatttcttattttcagagtataattagccctttttctgttttttaagtcttctctaacttggtttcttctaagcaagaggtttcggctctgaccttgcctacttttagtcccaaatgcacagtaaattggcaaagctgaatacttctcagtgcttacttaattaaaatttgattctagtaagaaatatatattaaaatatttcatttttaaagaatcgtgatctcatggccctttttcttagtatttaaaatataattattctgatccaaacataattcagaataaaaaatgtctacttacaggtatcatccagttagccaggtcaccatatttggaaacctgcatcgctcctagcattgtcagatcgacgtgtccactgagaaagaaagaggaagaataaagtgaacctcataagcttttgtcccctttgcttgaacttgccagcaattagaataacttcataccaccaaaatatacttgcttcccccaccacacaactgatttcctaatagatcagctccatgctgacagagaaataatcactaaaaattctttttgaaaaaaaagttacagtatacattgtttcaataacaaactatgaacaggtgtacacaggaagactgtttccttcagtgaggcagaatgtgactacttgaacacaaacactagctagaaagtgaacacagtttgaagaaaatgttagaatcctcagaaagcaccttagaaatgtttatttcagtatggttggcacaaaggcatggattccattttgggggttcttttcctaacagtgggctggatattcaatgcccaacattcgatgtgaataatttcacaccctgcagccgaacaaactcctgatagttttctggctgggaaatgtggctgtgtttcagagccttgctaacacactcagacgatgactcagctcattccatactgtctgaaacatgaggggctctgttattacataccctctaatcattgcaaatgattcatcgctggagaaaaaagaggctcctggaagaatagtaactgtttccttgcctaaacacacacacacacaaaagaaagaaaaggctattagatttctaagagtatcatggtgaacagaggtccacatcttctccattcccaaaagaacttaagctccctttaccaaaatgcagtgacatagcaggtggggggacacagtaggaaccttttgtggtggaaagcattttgtcactgacattgctcttgcctttgcatgatgataatgaaaagcagaccacttttagttttcttattgtttggaaattctctacagcagcagtcccctttttggtacctcagaccggttttatggaagacaatttttccacagactgggggatggggatggtttcaggataaaactgttgttccacatcagcttatcaagcattaggttatcataaggaacgggcaacctagatccctcatatgcacagtttacaatgggttcagtcgggcttctatcagaatctaatgctgctgatgatttgagagaaggccaagcttagatggtaatgctcgtttgctcgcctgctgctcacctcctgctgtgcagcctggttcctaacaggccatggaccggtactggtccacagcccaggggttagggacccctgttctacaggaaatgcacccctctattgtccatacctctccagcctctcgccatccccattcccttcacaatcctctgctaaatactacttaggaatgaggaggaaggaagttctggggtaacacctgtcagaatctaatgctactgtaagtcactgagacagagagactgtggaatcaacatgaacataagaaggaatgcaattttgaagggaatgacacaggagatgcaccgcagtttctttttttaatcaacaaataacttcagtgataagaataacttctgagatgctaatgtacagcatatagtattaactatagttaatactatactgtataattgaaatttgctagaaaagtagatcttaagagttctcactacaaaaaaaggtaactctgaggtgatggatgtgataattaatgattgtggtaatcatttcacaatgtatatgtatatcaaatcatcacattacacgtcttaaatataaacaatttttattggttaagtatatctcagtgaagctggggagaaataaaaataaaattagaaaacacatatagaaaaaaaggacccacctaattccttaatttcatttggcctgaactctcgacttttcatctctctccccttttctttctttttctgactcatctgtactctcttgccccataagcttctattaaaaccacaggattttcataaaatcagggaataacatggtaatactggccaatgtatctaaggttaacttccaagaggtccccttggaaggacatctcccaagacttacatctcataatgaggttcagagctggaaaagattttcaaggtcatctactccccatagaactaataaaatcacctgactcatatctaagctgctcccatcttgtgatctatttcctctctattcaggagcttcaggggcctgggaatagcttctggtctcaaccaggaaggtgctcacataccactgtgccaaagataagtcacctgttttgagaacaccccatgcatggcctcagtataatagggcagacaaaaagaaagagaagcaaaactgttattccaaaattggaataggaaatagctcccagaaacaaaaggaccacaggcagtctgaatatccctagctgtgcaacacagttatatcctcagattctcaagtctttcccgaaagctaacttttccatcaatatccccctccattaaaacttgagtatggagaaagagtaagcttatttataaatatataaatacttcatcttgatataaatatatatctctcgagggagttttattccaaatgatagaaatatttttgtatcttttaaagtacacaaaattgaaaagttttgaaaatacttcctggtatggttagcaggggcttttaaacagcatgtaagacgtagtggattaaattagataatgcatacaaagtccttactctaacttgcctggcacagagaaagggctttataaacgtcaccttttattattgccatttttgttattcctctctccaaagctacttataaaagagataatgccattgcccctctagggacaaatgccacaggaccaagcaattggcttatatggtggggttgtatggccagcctgtgtgagctctaggttttaagacaggcataacacaactaaaccttattctagacacaatgtctataacctgcaaattcagatcctcatcagtcctgtgggaagtcaaggaggaggaatttgtaggacaaaaaggaagaaaaacattaaaaattccagttctttgttttttagaggctaaataacactgacttccaaaagacaacctgcactggctgataatacatagaaggcatatttaccatgttataggaaactgagatcaatgggaagagctttggatctccctatattatttgtgaagcatagttttattaaagagcctagaaaacaactctcttgaaaaatcattatcaaggcctctgctaatacattactgcatcttaaaaattacattcttttgaagcaaggttaattttcagcatttttaaacatccaatatctaaacaaaaataagtatcctaaaattgaatccatgattttcacatagaatgtccaagtttggtcaagaaaagtcgtaactaaaggcaatcaacacaaagagggctttcttatttggctattcctgattgatttgtctcctccaatttttctttatgtatatctcaatttttcatatttgggcaatagagttatcaatttcatggtcactgagtcctttggctcacgatttaacaggtcatccacacaatagtaaatgcctactatatgccttaaacagcgttataaaccaaatttgggtgatctgaactagtggtttgcaaactttaacattcatcagaatcacatggaagatttatgaaatgcatagtttctaattcagtaagtgtggtgaggtctgagaatttcatttctaaaacatttccagtgatgctgacgctgtgggtctggggaccacacttagaccacactgccctaagcaaaaggaacttactatacagcaagacagatgaacaaataattacaaggcaaaatgtgatatgcttctcagagagacactagatatgttgtgggtttaggggaagggcatttctgagctacagtaggatttggagaagaaaaatgggctggaacttgaaggataggcataatgaatgttgatagaaagttatcagtaaggagatggggataaaaatggaatggagcagaataaaatctcatgaaagacacaccaagagcaaagacatgcaaagaagagtatgagccataatcagaaaacacccagcagtccagaatgggtacacaaaagtatccttgaagggtacagcaagacagaaagccataatggttggttgcaaacactacagagatctggaatgccatgttatctgtactttagactgcagccctgtgattcttcagatgtgatacatatacctctagagcagagtttctcctgcttagcactattgagcattggggctggttaactccagcggatagggaaactgtcctggttgctgtgggatgtttatcagcatccctggcctctacctactagatgttactcccccaggtgtgacaatcaaaaatgtcctcagacattgccaaatgtctctgggggcaaaatcagaccccaccccattgaaaacgactagtgcagagaggacatggcagggggccagggatattaaacatggttattctttctaaagcaactttaatcaaaagttaagtcatttaaaatactgtatattaaaataagaaaacattaagaaatgaagaatgcaaaatgcacaatacagaagcaaaaatatgagacttagaaatttcacaactgcattgggttactctaggttagagcccagatcttgatgggacctctggaacattcctagcactgctgtctgcacctctgtgcaagtcaggtcatcagcagatataactcagtgtatagagaaaaaggccaggggtcacaagcaggagactgggtatgaactcagtccctagcaatgttatcttgaacccatcacttcaattttctggacctcagtttcccaatttgtataacaaggtttcatttgaggttccaatggtataatacatgtgaaaaagtatgctctaagccatgtaaaactatacaactggtagttcatttttacataaccttatgagacttttttaaaagagatccttggaaatagttatattattattttgaatttttatcataccaattatatccagaaacataactctttgtattcaaagagatttccataaaatgctttcaaactaacacaaataatgggttgatcttgcagataactttgggaattgaggaaaccaccaatttatattctaggctctccagcttaaagtatttcctaatttaaaatcaaaagtgtcaaagtatcaaaaatcccaaaaaggactttgaaaaacttataatattattaaactgacttggagcttggcttcccataagcaatgaattcttgctttgtaaagtagtttgtaaatgtggcacttcaagtgttgaagttgaaatataaaattggtggaaatataaaattggtggcttcatttggactgagctacttctaagctctatggaatcagaaacacctactgtccaaccacattgaaaaagttaacaacttttccaaagaaagtgggttttataaactgaagcctgaaatttggaacatgcagttattcattttgcaaataactcactaacatcataaattaattaaaccaagcagcaaatattttcacagatcaatgagctattgctaaagggtacagtacaattaaattacagccttggttaaatgtcattgctttatcacagtaggcctttcagagttgagtcgtgttatctaattcaactattcaaccagaagctgtttcactccaaaaattctaagtatcaaacatcaattttacttggcagctggcctttatgttcagctcatattacctgtcttctgaaatttacacatactatttttgaatgcaaagtaagaataataaagaataatagttttgcgggggcagaatgaataaaaggatacagaaaatcatgctagaacctaaaaattagcttcttatgggcagctgcactccagggatgacatatggctccaaagtggtggcagtgttgcctcaagcataggcagtgaagatggccaaaagacctgacctgttcttcctcctctaggctgttaatatatgaggctacatctcagtcaaagaaaaggctagtaataaaaggtaaagcatatgcctgtaagaacaaaggagaagacaaggctctagtccccagttcaacaaaactatatttattacattactagatcatacttaccagcagagtacctccttaagcacctctcctgctccaatgagaactagaaaataggaagcatcaccaccaacaaaaaccccagtgtaccagatcttttctttttgctgctatggattcactcccacccttctctatcctgagaaggctgacctactttgacttgagattcgccagtgggaagcacaggcaggcaacccagcagaggacactctccacccaaccaggttgctgtgatttgactgagttcctctaccaaaggccacagttcctactaagtggccagttcctctaccaaaggccacagttccattaagtggcctttggtagaggaactcagtgaaatcacagcaacctgtcccataaagcccagaggtgataactccctgtggaatttcaccatcctttcttggtctcttttaatcctgtccatgcccttgtaaattgtcccttcctctaactctcaattaccccatataagagtgctctctgttcacaggcaggaccctgactgattgatccatcaaagctcttccattaaatgtgccttcatctgcatttcctcctttatcttggtcattcctgaatgaggggagacctcaaaaaagcttatctctcctcctcaacaatgaataccatggagtgctctccaggaaaagacaaagaattgagtccaaactcttattatgtagcacaaaattaatagcaaagggaagggctagaaataagtgagcttacctgcattgatgagatctgcatcagcttcatgttgtcgtggatatggaccctgtcaaatacaacatacattcaattagtaaatgaagattctcactgaatcacatattagaactataatataaataacttccctaaaaaccctataaatttatcatccgaagacttgaggtaaacttttgaaaaataattcggttgtgtccatggctctgtttcttatgttagtcttttctatactaaagttgtgattgggcaaatgaaaaatattttctaaaaattaccagtttgaaagaaatgctatactattagaaatacaagtccataaaacaaaaagtaattatttagtccctactatgaaaatgtattagaaatataggtcggtaaaactaatgtaggccagggcagtggctcatgcctgtaatctcagcattttgggaggctgaagcaggaggatcacttgaggccagttcaaaaccaggctggccaacatagtgacaccccattctcttaaaaatataaaaatcaaagaggaaaaatttagtacctactatgcagccaatgttattcaaaaacttttctgtgaggattaatgaatacaaactacatcacattatttggctagaaggacctggagaggcaaagttttagctttctgatttgtaaaatgtaggcctgaatttgggtttctaatcttactcctcactacatctaagttttgatatacttatgtccttatgttccttttgcacagctactctcagtaaagtttttaaatttttccatatatttttataatgtaactctatttaaataggccaagtagtttaagaatatcacatatattcgatgaaaagagaggaaactataaaaaaataaaaggcatactatataagatggagccaaaaatgaagaaatattggctgtgaaatttttacatactttctagagagggaccaaaaatttatcctttaaactgaagtggcaactaatgttcagagctatgtaaattttcctttaaacactggccatggataatccacaaatttatttcccttttcttcaaaaccaggaatttgatcactctagataatctctaaggcaccttaaaaatgcaagtctttaacttccacatgaatctgcttttatccaaatatatatcatttttgtgtctttgaaaatgtcatgattattgcctcaatcagtatcaactatacgctcaggatcattatttattttgaattgtgaatacattttccatatgcataatttctattgcattaacagttattatctactgagaaataaaagattatgaataggcaaaccaaatccctgccattgttaattaaattaaaatgtcatacaggaagtaaaaaaatatgattttattatactaatgaaaaaatatggcctaactaagaaaactgagctcatctggatgcttaatcttaaggaagaaaaaaatttaaccttttggacagtagagcttcaaaaggagaatgagatgagaacttctacagctttttgaggcaatcaactcaaacaatgtccctgtcctaaagtagaaaccttactcttcagtttctcactctgaggcttacttaattttatttaacatagaactattgacaaccttcattatcttgtccaacaacagaaggatgagaaatagtttacacaggaaatcatgaggtctctctgaatcaggttccacatgggagacgcagtcagaaagccagagtcaggaacgtaccatctactacataaaatacaatactacattgcttacattttaagggaaaaattaaatattttatcatgataaaaagaaaaataagcttgggcactttatgcaacaactcagatttcactatgtgggacggatccactaaaatctcaggtttcagcattatacaatttatccatgtaaccaaaaatcacttgcaccctaaaagctattgaaataaaaaaatttaataaaaaatttcacaacatgaaatatctcattcttcattaagactggattttagaaaacaaattttcatcttaccaaacccagaactccattttcactttgaagatgaacagttatatttgggctgataaaattgctggccaggagagggattcctatgcccaaattagctggaaaaaaaagatgttaaggtccagcatataaaaggtagagaagttataccataaatcttctacatatacagatctgaacagaagctttatttaaaggtggcttactctgaatgtaataaatgaatatattctccaatcacccatggcgcattattttgtaatttttcaaaaaaaaagtctctaattagtcagctttttcagtaacattaatatcaaagtagtggcctcagaagctagccatttgtcacattttaacaaaaatgtaagcacattttcattaatgtgctctgcaaatttgggtttatgtattataactgatttattaaacacagcttgacttttaaagaatgattttcactattcaaaactcctgccaaaagtaaagatcgtttttcatcgtctttattgataaatggagttaccgtttttaaattttaaaaaagttttctgacaataccaaaatttctgcctaaaagtatatcagatcctttgggtctctatagtaacattcattggtaactgaattttctatgtgacataaaaagaaaagtggggaggaaattaaatttcagcaaatacaattgagctcatcgataaaggagctgttgttaaggcatcaaagagttaaatgaggttgttgaattgtcttccttaaatgatcaaaacaggagtgatgatgattactactcaatggtgtgggttcaatcctgcctatcaacataggcaggctgatcagatcaaagatactcacactgcctggaactactgcccactactgtccactaccactgcacaacaaatacctcaccagaactagtacaaagaatgatggcactctgatgagattctaacagtgaaatcttcacaaatcaaggccagaggaggtttatatatggtgccatattataaactacaaaagccagcagtacaactcaatgacccaggtcacttcttgtggatagagtaaatctatgaagctatgattatagctactgggtttacctctagtgttctatcacagtctagtatagtgttatttgtaatttatttctcaataatgcacagaacacattaggatactaattccattatgagcaggtgtttttaggacagagcaacccaaattacaagtctggtacctcaactctttcatcatattatagcattctctcagttctttaatattttaaagtcaaacaccagggaggaaaaaagtctatgtattttgggttgaaaaaaagtaggagatatggaaagaccacttgcataaactgacttgcaaatatttttcacaggcaatacaataactgaataaagaacacctaaaatcagtattatagtcagtgtttaaatatcaatggtaagtcaggataagacgggttgagaagtccagtgaccaacttttacctactaactcaacttggttgacaccacaccttgctgatacaagaactggaagagcagcaacatgctattcttttcccctatgtgagtttgcaccataacacaaggtataaactgaaaaatgaacaaaaatgaggtagaggtaaaaagaaagggaaaaaagaaaagttctcccagtcaagatcacagtctggaagactgacattcatggaccagggaagctcacagaatggagacatttgtcatgtctctcattctttctgtcctaggtcttttaagtatggcttcactgtatccaccattcaacaaacattcattttatcatatgcgatctgtatttgtatgtgttatttgtattatataattcaatgtctactgtagtgaaaactagcaaaatggtgaacagatttgttatttaaatgcattcaaaatccaaatattaattgcattaattatgtctactctacctctttttttgacaaagtatctaaagcagaatttgaatcatttgttgaataccctcataaaatattagatataacagggtaatcacaggatctttgtcaagagaataaaagggttgttaagaagttggatctttcaatgagtatgcaaatgtcaggatagacagaaagtaaatagcactggttatcactaggaattctgagatttgaaaacactcatcttgggtaatctcttttcccaataatctcccattaaatgcaagttgtactgaaatctaatgggtattagaaaatagctaagcaaattattgattgccattttgtttcaagaaggcaaagagatatctgtcatgtatcttgacacctttggattatatgccacattttgtaaaaaaaaaaaaaaaattgattaattaccttaaaagttaccatagactagagatgactcactatgcaagaggtctaatagcctgatcaatatgggaaaagcaaaggctatgtctttgcccgggctcagaaggataaaggataccatacatgccatcctcaaactcaagagcggccctcttgatgattcgttcccttacgtcatctccaggtttagcagatttggcttccccatctccctctttccggattgataaacgctttaaattaaacagaaataaattattcgtggttgaggtatgctttgtattttatcactgctgaaataaattttactggaaaaaaagatgagctctctcccattgttatgagacaaatctgcaatataccagatatttaaaaaatactatgggtgatatttgatggtagaaataattctttaggaactaaatgaaagtggtcagatttgtttaaagaggaagatacgctgttcagtctgtttgaagcaaataatctgttactatcacactgtctgctccttctgttattcttccaactaaattctcctctggtgctcagggattggccagaagaatgaaagaggaacagactttgggaatgtgtttttcagggctgtcagaatgtgtttaccaggtgttgctgctgccaattgcctgtttccacctgcaaagtccagactatttttaccacaaatgcaccacaggaatcatagaaatacccagaaaccagccaggaaactatttcctctattaagtctctttgacacaaactctggctcgtgtttgcaaaagtctcatcctttcttcctgggcccctgacactggttttgtattataaaatgtcttcctgtttgatatctacaaggtagtgggtatctctagcaccctactgtatgtctattctgttgctgatccctagacacttctaaatcatgacagtaattctggtagggtggccattgtctactctcactggctgatgatttagatatgtgtcccctccaaatctcaggttgaaatgtactttccaatgttggagatgcggcctagtgggaagtgttggatcatggatgcagatcccttatgaattggcttagtgccatcccttggaaatgcaggagttctccctctgttcgtttacacacgagctggttgtctaaaggagcctggcaccttctctctctctcgccttgtgacatgcctgcttccccttttccttctgctctgagtaaaagcttcctgaggtcctgaccagaagcagatgctggtgccatgcttcacgtatagcccacagaagtgtgagccaaacaaacttctttataaattacccagtctcaggtattcttttacagcaatgcaaaagggactaacacactggccttagaataccttcaatgctcctggtacctacactccttgccacaatctcatactcaccagctacccacagcctgaagctaattagaatgacattctacactctagaaaagtgcaaagcaccttcaagacagacaattctgaacaatcaaacattaagataagactacagcagggataaaaccaccaaagacatgattattcttatctcccctctaagacagccagaaaaactacagatcataaattaggacagtagaagcctagtagacacagcctagagaatctcatggcatggtgatacatatcttgtgatgacaaggcactgtcagcctgcacagaggcatagaccatcatatccccatgatgatagacacatgagaagctcttactaagatccaagaccagactttctgctcagctctagttccccatcatctcgaatggccccagggatgcactatctctgtaactggatccatgaatactgacaaagcagctaagtcaattacctcaattcttttctcatatttttctccctttataaggcgatgtacataaatctgaggaatatggatgtcttctggagcaaatgctccaatatccacaatttcttcaacctagacaaagagaaatttctttcaaagttagtgaaagcttaaagtgaacatttttaattttttaaaaagtatacacaacttcacatacaacttaggctgcaaacatatgacggaatatggacatatatctatgtatgtatatgtatacatataggtaatgtctatcacacctcctggacccacaaaagagaagaaattaaagtgtatgcgtctgaacagaaaatacagaccattaggctccagaagttagtctttgcttaaaagagtctcagttacaaatttgtcaaatggtttgtcagtacagcagcttgaactttcacaaattgcagttcaactatgcaatgatagcacattccttaaacacagattttctaaattaatgggaaatttatcatatcaaagacaaaaatctgtaataacatctgcttggtcaattgaagagctttttaaatatagatacaaatgctatttgtaacagttgtaaattattcttgttagcttcctaggatcgtgatacaactgcaattgctgaaataatttacttaaagacagataattaattccaatatggaaacttcaaaactgaaatattaattaataactagaaatactcaatttaattagaatcaaagtcattcaccaagaataaggtcatatagcaatatgaaatgcctccacattagtctgttattttagaattaatttaaaagacaatttttctatcaacataaaacagttcaaaagaacaaggatcaagaaaaactaaactcaacattgttgtggtgaaagaattagctttctggtgacacgcacgcacacaaacatacacacctttaagttgtgagtactcagcttaacagatacagtgtccaaaacaaacgtttgcttccatgaactgacttatacaaggatagtagtattgatttttgtttcctaaactaatcactgaaatctggaaatctgtgaggttaagtagcccttcttatgctgttctactactatatgccttcactaggctcctcctacagtgcaagaataccagggcttacagaagacattttacttattgtgcaatgctcacaaatagctgaaaaaggcaaggacatggtggataaaagctatcttctttgataaacagaaaaatcaaacaaaaattccaaggaaaggtcagaaaatatgtcggcatccaagttgaactactgggtagagaggcatctggggatgagtgaggagacagggaaagtggggccgaagaccccttgccactgcactctatgtcctccccttgaaaactctgtatgctccagtattttctattcgaggtggaggtggggaatgcagagcagctaagcactactgctacctcttcaactggttggaactttcagccattagggctcattcacatctttccatattcagttttagccttcaaagaagttcttgactttaaaaatgtgtttatacattaatccagtatcctgaggatagacatgaagatttattattcatgaaaacactaatcacaaaatttattataataatgaattgaaaacaactttaatgtcagcaatagggaaatggtcaaataaacatggtgtagccatgtgattaatcaatattatgcactcataatatttaatgatctcataatttcatgtttcataaaatgcaagattttgtataagtaaataaaaatttatagaaatgcactttgggatagacaattatttatatacctacagaaaataaaaggaaacacacggaaatgctaagaattgttatctctgggtaatagtacaagtggtttttgttttccttttacttttataatcaaaactgaaacccacaatgttattttttcagaagatgtgataaacactaagtttctaaaactagaaaatcataagtggagcatgtgataaatctcacaattagtttgacatgtaccaaagagggcatgttaaaaagaaaatagagagtctaagaaaaactgaagtttctaaaccctaaaagcagtcacattatgaactaaactaagcaaacccttcttgcctgcacatttgaaaataataatgtgaattatttttcatgcctaatattgctccaaaaggtcaggccctcaaatctcttgctatgattgtgacagcagcttcctttggtcttcctgccttaccctctagcaggggcaaagaacataataaaaaaggaagaaaaaaaagtattgctcacttaaactgaaaatgctgatggaaacccgccactattttcttttggttccatcaaagaatgtttcaacagaaaacaccaaatcaagacaaagcttcattaccaaggacaattatatcataactctcagaactaacagaatgaatatgtcctggtaaaacaactccgataagcaagaatctagctaaacataaacaattccatgttttgtcatcctaatataaatggctttcagactgtagaaaatgcatgtgcagcatttgtcaaaataacaacactcaacagtattgaaaacgtctatacaaaaatcaaagctttctcagagttggttagcagagttaatagctaagaaagaaaatatttgaagtacaaaccaaaagaagaaaacatgttttcagacaatctatgaaaagagtttaaaaaaaaaaatgaagaggcagaactatcttaatgctagctattgaagggactgacttcagtgccagtttcgtgtgatcttgagaacaataaggaaggagcaatgggaggattaaaaagtctagtgagatcaggcgatttaaacataagcgttaatggaaaacctgatgagaaaatgatgactaaaatgagctggttaggacaaacataaaaataaaagatcccttactaaagatggcagagttttcctcctgaagttagaaatgggtaataaagaataaaggacaaaggaaaagcctcagggcaaagcaatgggcagatgtaagtatcctcaggcaagatcaagatggaagagaggtagctaagaacaacccggacttctccatggcactatgaatagttctcatgccccaccacttgctacaaccagaaatccagacgtttgaggcttctctaattggtacttgtctttagtcattaacagaaaaatagacactaggaaatgttgttattgatctgaactttgttttaaaagattgctttctctgcactgcactcttcctactttataactgaaaacttattttaaagcttagagaaggataagaattcatcccttggtgacaatgtgtttgtgattgcttggcaaacattatatctcaggtaagagaaaagaggagctgcaaggcaataacgtcctcattttttattttattttagtgacaacctcaatctgttatagacacaaaaatggacccaaccctaaatggtgttagcgaaaaattatacacacctgcaaaactctgtgtacgatacaaagtaagggctgttgagggggaggaagagggagactcacattccaggctttcttcctgactcattttaagtttcaaaaaagtttaggaggaaacttcttttgccaaaaagaaaagaaaaaaaacagacaacaagcaataatgtctagaatcatgagaaacattaactccaaaagagagggaaaaaaaaaaaaagcagctgtggaagtctagaaaaataaaagggggagacaataagcaataagagaagttacaagttaaatgcagaggtgctctggatgttaaaatgaagtaaaatgagtaaaatgaagaggaaatgtgagtaagacctcacgttcaatagataaataggataactatagttaaaaatctattgtacctctcaaagttgctagaagagaataatttgaatgtgcttagcataaagaatagataaatatggtaatgaatatcccaattaccctgattttacctttatgttatacgaatatgtcaaattatcacaggtaccctgaaaacatacaggtctatcatgtatcaaaaaagaaataattttttaaacaagaggcaatgtagagaaagaggaggtcagcatgtaaggcatctttctcaaagattcaaatgaagagaaaaaatccaaaggagcaagaaagtgaatatattcttaggcttcatgctaaggaatgataggaccagtacaaaaacacagaaaaaaatggtatgaaagctaaaagggccagagacagatacatatggtcttagatgtctataaggaaatgcacaaagactgaaaagttgaggggctaccaatgaatttgcaacctttaaaatggtggtacatatggttgcatagtcattgaaaccgagtagatgggagctcatgccaacagacattccacaatgtccaatgaaaataaacctaacaaaaaagcatgttctgccaagaaaatatgcataacacctgggatgccacagacctaggcatgaagtgtggtgaggaatatttaaagtgagtttaaaaggagaaagaatatcacacttatggtcatataatgcccaaagatatagatgttatatttgtaacagaagtgacaaaaattggctcaaataagagatgccaattatttgaacatcttctattcatcacagtctgctgataactctgtattgccttctggtcatttctatcttgcagaataaaaacactgagagaaaccaagattcaggacctctaacgaataagaataaattgcttggtaaagtagaaatgacagaaattttgaggaaaaaaatgacaacgtaaaattggaattggaaatagaccaggaagtgaatcttaaacgtacacagaaatatatcctggtctttgaagaaaaaaattcagtaagttcagagaaaagagaagcaggatcaagaggtcagaaactcaaaatcacaaatgggcttatgaaagatgaggattgcaaaacttccattctgacaatatgaaaaagggttatattgatgaggaagagaattgcatataaagaaatgaatgtaacaacatggatagctttgtgtttcttcgtattttatcagggctcccacaaaagagacacgtatgacctaggacaaatggaagtcaagagaccttaagaggtctatcaaaagatacaaaatcagaatgagatgaggactcctcaaaatgctcaagataaggaaagggtggctcctggggtgattttgtttttgctgccactgctggagaacttgaaaatgataatcactactgcttgggcagaagacaggaaaaaacagagcagttcaattttattttttttcctgacttcaccagggagaaagaaagtagaactagtatgattatgaagaaattcaattccaagaagagctacccagattctctgtactaatactaggctgtagacccacaacatctatatcccaggacccttaaagagcctgaagatacgatcacagaattacagtcaagcgaaaaatggtagaagtgtcaactgagaggcaaatatactcctttccaaaaggggggctcaatctacaacagtattctaaaatggattattatatacatggtctagatggccataaagagagaaaagaattggacagcagtctaagtcttccacccaattaaatcatgtcatatgatcttcattaatttgtgatcaggctagaacataagtgggccaggaaaaaagcacagtgtgtagtttcacagagcctctgaccaagcccttcacataagagtcttatagacatagcaggaaaatgtgacttgagctcattcacttaaaatcaacaaatacaaactaagcacctactagatttggcaaggaagaaaacagaaaaggtgtatgctctggtgtacagataggtagacaaatacttgaagaaccataagtatatggtggcttgataaagccttagggggaagtcttcagtgctgtggtttttatcttttgagggcaaatgtactactttaagaatctcatgggtcaattcacatacacaaaggtttctttaggtataaaatcctttgaaagattccatggaattattccacagacatctgtccactcccatcccctagctccagcctagacccctgctctaatggtttgatgtctttgtcctacgctgttcagtcaacatatttacaaggctttaaatgaagataaggaagtcagcattatagttaaggggcaagggtttgggtgcatccctttctctaacagagaagacagtctgacgctcatgcctccaagtatttactaaaagaggtgacaaaaaccatattcagggagttgaaccactcttttaaatgccccaagaatggtatgcccctagaacaaaccaattacctttatgccacagtcataaagagtcagtttttctttcttgcaatcaagtgagttatttcttaccattaaaacatagtgcctgacataaaactgtctggttgtagtagcaagaatagttgtatttcatctgatcattagctttcttttatatgtactattaactatataaatactttgatttttatttggcatcccaggcctcactcatgtttgtcattatagtatcaatttttagtccaatcctagggtcactgtacagttctaccattccttttcattcttatagctctgttcctaattgatgctatcatgtatatttatgtcttataagctattttaaatcatctttgggaaaaaaaaaacaggtaaaaactaaacagcacatttatcaaattggaaactgatccaaggccagaaagaatagctaattcaatgaagacagaaaatgatctctactggttagggaaataaaatgggtcagtgtcaactgaatgaacttcagcagggatcaaagttcatatcataaaatacctggcctaatagttttttgaaatgcaaatagaaaggtttagctaaccaccagcacaaagactattaaacatgacagaaatattccaaacaccatgctgctatagacacgtgcacatgtatgtttattgcggctctattcacaatagcaaagacttagaaccaacccaaatgtccaataatgatagactggattaagaaaatgtagcacatatacaccatggaatactatgcagccataaaaaaggatgagttcatgtcctttgtagggacatggatgaaattggaaatcatcattctcaataaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatgtcacatgtatacatatgtaactaacctgcacattgtgcacatgtaccctaaaacttaaagtataataataaaaataaataaataaataaaaagagtcttcctttctctgtttgctgtccagcctcaaagttggtgatagcaccttcaacctaatgtatctcattacaaaacaaaaacagtccttcctctctacaatgtctcattgtaaaacgcaggatgtgaaaaatggataaaacactctgaactctagaggaaaagctttatctgaaataactcaatttgttaaaattgactagcagcaaaattaatagcttatatattaaatctttatattatacaacatctgacccataatgatctgaaaaaagtagaactgttacttcatataccatcccaattgtttttgtaatgtggaagaattgttttaaaaaaataaaaaataaaagcagtctaagacaagtattttcatttccactgactcaaaccaagctaaaatagcaaaataccagcattgattagactaacactttatttttattttattttactttttgagatgagatctcattatgttgcccaggcttgtctcaaattcctgggctcaagagattctccagcctcagcctcctgagcagctgggattacaggcatgcaccactatgcccagctgctaacattttttgtttgcccagaaatgccaatcttctctttatgtgtgacttaataacattcaggcaatattctaaatatctatatttcatttgtcatatctcttttaaaaaagaaattttattaggactgtggcaaatccagagaaataattaaaatgaatacatctacccaaaggaattaaaatacatctaacatgttcattcaaagcaccagtcttatctataatagtttttaaaaattacaccattatcatataccccaaggaaaacagggagacataatataattaatagaattaaacaaggaacatttttcagtgaagagagtcatagagaaacaggaagagaaaaagttcgtgttgggtttttacagctacagaaaggctgcctattggtaatgccaactaaaatttaaaatgttactctaagactatttccaaatgttactctaagactatttgaggctgttaatcatccctgaagcacttcatagtgcaggaacacaatacttaacacataaaatgcaaaatgggattgggttaaaccctagcatttccagaacacagttaatggctgctaaatctaacagatttgatttgaattcagcatgaggatgactcaacagtccctaaatttaaaattgtttagcacgtgcattagaagagctttactttattcatttcatcttttaaatgttctccacgttttcatttctctagagcagtaagcagagtagaatcctacatatttcattaagaaaattaagatgccatgtttgttttccctgatttatatgaggtagatataaaatggaaaaataaactttaaaacaaaatatttcttcctctctgtggttcagttttcaaaactagatctttaagtcctaaagaaattcaaacatgtttatcacatttcaactatgactttagcatgatgatcaaatggctcttagtacaagtagggagatgcacaatcagttttactgctggcaacacttggttccaggcttttctaactcactgaatttcagcatctagtcatcatgggaaagcaaggcaagtcttaattctggtgttaagttaaataattcaaacttaaagcttgtggaattttaaatcattctgacccttgagaggagtgtggctatgcagccggggtcacttggcatgccgctgcaacttctgcctttttttcctataaataattagaaagaccaaacagcactagagataagacccccttaagatcactatctctccttatgaagtaataaactaatcttccttgagtcatatcactacaacatatgatctggtctcatatgaaaaatgttgtagtactgctggaatttctgttcctctatgagtgaaaacttaacttttcaatgttggaatgctaaccccatttgtttagagtgtctcctccgtggctaccctcagactgtactcaaactctatacttaatcatatcttctgaatctcattatttatagttgacaatagccatcattcggacaatgactgaaatctaccatgagtaaagctgatcgaggtcccaaatccaaaatatcttcctggcatataaactcattcccaaaactcaacaccatatttgaaaacttaagtatgatgattaaaagaagagtaggaatggttgataaagaacagcaatttattgatgtcaatatttagtaagggacattttagtccatatgattctaatgccatgtatttcactgagccttcctatagttaaaaaaaaagacagtatgatataaagaaagtactggatttgaagtcagaagacatcgatttgtggtttcagccctaacatcatctaatactatgttcttacatgaatcacctaaagtcatttcacctttaaaatgaaaaagttgaactgtaaatgaagcctaatattcttcccagcacttgcatgaccgttaagtctatactagttcctagacattctattacaagaccataaagtttgcacattattgtgtagtatctttctaattattctggatattgaacactctagattaatgtcatcttactggacatatctgttaaatgcaaaacatgattttagttccatgccacgcagcatatcttcaatacccctctgtacttgtgtacttgctatatccatcctttcctgaccaaacaggctgttgaatttacaaggccagtttatttgccaattcattactttataaccctttgtataactaggtaactaccatatggcttattctgcttttgcagagtaataaaagcttactgaatgagacacactataccaggcagtattaaaaggcacaccttgagataaaatgatcccagagaagtcagaggaaactaggcacagtaataaggaaggcagttacagaacagctggtggcacattatcaagtctctcaatgcaggactgacaatggcctcaaatataaagccatcaggaagaaccactgaacataaggcatttttgctttcttagaccatggcaggataatgtcaatcaagtaaaatccatagaacatttctaagcctgcaaagtgttgtgtatgttttgaacctgctgactcagtgactcaaatatcatttaatgagcagctattatgtcccaagcattgtgttacatgctgggactacagagatgagtaagacaaggtcctacaaagtgctcacagtttcatggagaagacaggtaaccagagtatcacaataaaacatgaaaataagtgcaataatagagggaacattccactaaccaggcagaaaattagccacaaaaagagggagaacattctaggcagtaggaatgtcaagggcaaagggtagggaaggatgtgatctcatgagagaatgtgaggatgtgttacttgtcaaaggacctagggtacacaggaaataaaagcattgcatcagaagttcaaaatttttattctgtggaatgaggaacctaattttggaaaagctatcagaaatggtaatagctaactgaacaaaaaaggaaatatggcgtccttcacacttcaaaaaattcacaagagagttcactttagctaatgatgctgggacagtctcttctgattattgtggcttctcacaagaaaaaaatttaacatattggcaattaccttttctcgcttttattaatttttggttgtgtacctggattttcaaggggcctagtaaaaggccagatatttgcatatgttctaatattaggaggctgccatatgctgcatgctcatactacactaatacatggaaaaacgtgtttataagacaaaaattaacaaaaggggtcaatgaatcatatttatcactttttcccacatttcttacttaaatcatttatataagccatgactttaagatgccttcttttagctttgtccttgaaccagaaagatttgaaaagtgactcgtttaaaaaaaaaaaaagaaaaagaaaaaaagcaactaatttttcaaatgaagcaatcttgcataagccctaattatcacttcagtatttgtagactagatctatatttgaagttggaaaaaataccattttttgacaaggtctctggaaggagtaaggaaaaccactattattcttaatcagagtgactttaaaatcataagttatattcttaacacaaacatgaaataaatcgataagtaggtcaaaagttgttaaaccaaaagagagcaaaattaggaaaaggaatccatgtcattctttgtattaagataatttttttttaggagaacatcccctcagtttgtatcagtgacagtgtaccttatttaataatctttcaggagggagtatcacgaacattctaaaaccattaatatgctagtaatgccctctggctcttccttttttgggggggattgggggggcagggggatggagtttcactcgttacccaggctggagtgcagcagcaggatctcagctcactgcaacctccgcctcccgggttcaagcgattctcctgcctcagcctcctgagtagctgggattacaggcatgcgccaccacaccaactaatttttgtatttttagtagagacagggtttcgccacatttgccaggctggtctcgaactccttacctcaggtgatctgcctgcctcagcctcccaaagtgctgagataacaggcgtgagccaccttcttttttttttttttttaaacacaatctatgtcctcatttgcaacaaaattgttaattattttgtgagaaatcatgactgtaagttttagagagctatctcaaaacaatgaatcaacagcacttgactcacaccttattttatgaaggggctctgtgggtatagctgctggccatggttaccttctctctgggaatcttacccacatttacttccgtaactggttactgctctgggttcaaaatgttcttctttttctagtctactaactacaggcaatcaagttcttatcctgggtcaagcagccaggaggattctccaggaagctgggttctaatctagagtgcctggctccagagcacacattttaaccataccctgtaccttttcttccctcacacaactcctcaactaagtgggaggtttaagaacacctgggaataaaataatagtgacattcccattaaaataagacacaaaatcacaaaagaaatagagtcaataaatatatgaaaaatattcaatgtctcttgtcaaagatattgagttaaaactatagggtggcatttttcacctagcaagttatcaagtgtttaaagtataacatccatgttgttgagagtagttccaaatgatacttttatatatcactgaggggttataattgaaattatctttctagagaatgatttcgcaatactttccaaaaccttaaaatgttgatactcatataaagaaaatctacttctagaaatgtggtcaaataatcagacatgcacaaaaataataatcactaaagcattaatagtgaaagatggaaaacatgaaagtccaacaatagaattgttgatatgttttactataacttaaaatatctttcgttagggattagtgaactgcaaaaacatgcttaatgttttatgtaatgaaatatatattataactaaaatggtccctattttataaaaagaaacattaggtatggacagtaattaaagaaaatcaagccaagacacttccatgttttctctcaagtctctttgttccatgcagaaagtgtctccccatcccattatggcccatcctgacccaaatgtccctagacctgtcaatcaagatggcaagcgtaaaatgccttaagtcttctccttccttcacaattgaccttacttttcttgtttatctgcataaacaaggccaagaagtggagagggattgggtggggttagtgccatacactcgcagcaaaccaccaccatcaagatcccacagcaattactatctttatcactaaattgggcactcactgctctatgcacaacttattttcaggttagtcctacctcaactagattgtaagatgatctaaaacaatcacagtgtcttatgtagcaaatccttaacatttgtatacctaatagccatgttgttgactacatccccaagcaactctgaaagtagcaatttgtagttttggtaagctagaaacttcactcaatatgcagctgaaatggacttcaaagccaattacctgtctcccacatttaaccaaagtattgtttttatctacacagggacacacatgcagtcacttcctgaagaaaacattgcctctttatgaaagtcagtacacagtgccaataaagtggttcttagatgtttaggaaaaatatgagaaatgaaatataaaattcaacaatggctcagaatcagagcatgaacaagtctatcacatattctacatggaaacaaaaataggcaatttattaatctttcaggaagcattccaaccaacatagtgatttaattccaaggagtgtaattgctggattatttggtaagagtttgtttatttgtataagaaaacaccaaactgcgaaagaagctgtagcattttgcattctcaccagcaatgattgagtgcctgtgattttacatcctcgtcagcatttggttgttagtgttctgacttttagccattctaataggtgtgtaatggcatttcatttaggtttgcaattccctaatgatatgatgttgagcatcttctcatatgcttatttgccatttgtgtatcttctctggtaaggtgcctgttcagattttacctattttgtgatagggtgattttcttgttgttgagttttaattgtttttgcatatgtttgacaccagtcttttataagatacatgtttcaaatatcttctcccaaaccagagtttgtcatttttttccctgtacagtgtcttccacagagtagtagtttttaattttaacgaagtccaacctatcaagtgtttttctctcagggatcatgtttttatctaaaaaagcatggccacttttttcttatttccgatgagttttctattttacacttacatttagttctttactccttcttgagttagttttgtcagttattttaatagaatttaaataagaaattgagaaccaaaaaggcaaaaaagcacgcaggtgacacggatctagtaactgcaggaggaacaaagagaagtaaatggaactggtgatggggccaggggtttctcagagctgggattcagacccctactgggagtgacaggaggcagccagtactggtacttctgaagctcatgaggctagttctgcggtagtggtttgggggtgggaggagaccagaaataagaactgccacaccataaacactaagaatttttctgtttttgtggagaactgacctctttatcattatggactagccctctttatccctaataattttccttgctctgaagtctactttgtctgaaattaatacaactgctccaactttttttgctttgttgtgttttgagaccatttcactcttttgcccaggctggagttcaatgatctcagctcactgcaacctccaactcccgggttcaagcgattcccctgactcagcctcccaagtagccagaattacaggcgtgtgccaccatgcccggctaatttttgtatttttagtagagacggcgtttcaccatgttcatcaggctgctcttgaactccaatccacctgccttagcctcccaaagtgctgggattacaggtctgagccaccgtgcccagcctaattgctccagctttcttttgattaatgttagaataattttttacattcatctctttacttgtaatttgtgtctgtatattaaagtggatttcttatagacaacatacagctgagtcttgtttttaatccactgtgagtcttaattgttcggaccagtaatgttcaaattatttagtcggattaatatctaccatatttgctactattctcatcattgtccttgttctttattctttttgctctccactcttttctgcattctgtagttttaattaatctttttcatacaattctttttctgctttttttgttacacttgagtttgcaatatacatttacaattaatccaagtactctttcaaataacactatatcacttcacaggtagtgcaaatatcttaaaacatggtatccccagcacttgtctcttataacattactatcattcatttcacttgaaggcaggccttgttaaaaagagaacgctctgggtatatttcaaaatgtccacttttcccccctccccttgccagaagcacaaggaaattttcctttggtcttcaccaaaactctggtagggatcctagacataaaactcacagaaatatgaagcccctcccaagaccagaccactctggagtctaactctcaaacttgtccacatgagcctccaacaattcatcaattacagtttgagcttttctaccccaggactggttcccatggagatttctgctactaggcttctgctccagtcagttgtgattctccgtattagcctgtctctctccaatttgggtggcagtggtttgccctgtgactttaatcctctgacggatctaagaataattgttgatttttcagtttattcatcttttttcttattgtgagaatgggtgtggcaacttccaacctcctggcacgttaggcctgaaattggaagtggctattttttaaataatcattaccagtagttactatatagaatcctaaagtttctatcttgaattcaaacaactatataatactatctacctcattttcaattggggggaaaaaaacattctgtcttcctaaatgtgaaggttctcattttacagcttttaggagattatcctatttcatattttctaaaaggttaacattactgaacaattcttaattttgcatttatgaaagtattaacattatcctggggctacactaagttaactgaaaaattcagtcagctaaaggtctatgagcctgcaagtaaggagactgtaaattagataaaaatgttaacattgcaaagcataatgtaaaatgcacctcaaaatataccaaccgtcatttgtttttgcttcagaacataagctttagaggcacaaagaaatgtttagatcttaactcttccccctaccaattttgttatcttaaagtctttccttatcctcatttgttcttctataaaatatacacaataaaacctacctcactgggttactataaagtgctttacatgtaagtgcatggtataaacagaagttgttgctattgttgttttcataattattaggctatatatctccttcaacttatattaccattattgaaaatatttcaagtatagcatctaccacactctgtgtaaagcacatcttagctgtatagagtctacttggaccatttcactgcccctatttcctgggaatgaatttcattaagaaagttttccattccattttcctatctccttataaaacctagtcctcaatttacatataaaatattaccttgtacattaaaaacataaaccaaagaggaaaaataagtgaaaacattttgagtgcaaacatattcagatgccaagagcactgaacaaaaaactataaataaaacagcagctaaaatactttttatagcagaagctgagttataaaaatgtctttcagattctacttaatactacttttatttctaaaggtctaattccaattctaagaagacaattcaagatgaatgagttttgtaaattcctcagagaaagttaaattacaccaaaactttcaaactcattcttaatctcatagctttttatagttaacctgtattcgcctgagtttggtaataacgatgaaattttcttctgagttttgtctgtgtcggcaaagcttttccaaaatttaaagtgaaattcaaaactgaacagaactttttcacaatacatggcaaaacttgtatccttttctgcaactattaaggaaactaaaatagattctttaaatgaatcacccagatccttttcacagaaggcacagaaaaggtagcagggttcttcacattccagtttaactttcctcaggtaggatttgtatttagaattctcttcgaagaacccaaatatgttctcagtggcagaaacactgtatattatcattaaacttcaaaggctgaataagagagaaggtgacctatacttttggacatgagtggttgaagaatctgaatgtggactttgttactcagtggcagaaacactgtgtattatcattaaacttgaaaaagctgaaccagagaaggtaaactctagtcttagacatgagtggacttgatttcttcatggaataaaccacagagtagaagaccattacattctaacagttaagtaactcttggttcctagtcttaggaactgttaactgttttaaaatattccatccaaaaacaaaaagatattttcataattctataaaaattcaataaggcaaagctatcataaggaagaaaagaaaacacttccttccacataacttacattttggaccttaagtccctctgtgttcagggagttgtatgcccacaggtgaacagaaagcatcagtatctgaggccctctttatttatgtccccaaaagaacaacagatgtgactttcattcaaaagaagtcatatggctcttgcctcctctctcatcacatgatctctttgtgcacacccactcctcctccaatttaggccatgagtggaagcagcatgaggccctcaccagacacagctacccagtcttggactttgtacccactaaaatcatgagctaagtaaacttttctttcttaaagaataaaaaagtcacagtggttattcagcacaagcaagttttaagcaggaaataactttaatcttcatcccaaaccaaaatatgtgaatcttttgagccaaagtataaaaagagataaaatgggtcattaactaatgctccatatttcaaatacaaaggcagagagaggtcatcaatttgagggtgtacaactcaagctatgaagtgacagatttataagaaccttgctctcgtgaaggtgtccataatattcccctcaagagtcatcacagtttttgcttgatgtaaggtatcagcatgtttaagttgattttatggacttcaaatattggttagttttctgaaggatttaagctaacaatatttttaaaacaaaatttagttttttgatcatgcactaagattttaggaatcggaggcattatggaatttttattttctcagataaagaactttggaagacagggaaaggttacagaggatgtgccttgccagctgccatttacaatgtagttcaatagtcatcatcactgggtcaatgagaacagtcatctaaggtttattaatcaaagcagcgggagggattaaggtgagcatgtagcatttttaagctttagaaaacacactggaatgctctatcccactgatgctcaaaataaacccatgaaataagcaaacaacagaggctgtaaggaagacgagattctaaagtcatttgtctaaggttgcaaaagtagtgagaaacaaatcttaatctcatattctgttcaaaaaaaaaatgaaaagaaaaaagataagcctcctcaggattagtcccagagcttctttccctaagtgatcttttccattccataaccctaactcaagtatttgtgaattattcccaattgtataactacctttccgacctcccctctaagcactacaataatatatccatctgcacctgcgtcaccaccatttgaatgcctaagaagccaatcaatcctaagcgagctcttgattcactccaacaggatcatcccaggtttccccgtctcagtaagtgatgtatcattgctcaagccaagtgtaggagtgaatctctacctttcctctatccaagctctccacatctaaggcctgggcatgttggatagattcctcttccaacataccgtatctcttaatgctatcctcctctccaccactcaagtccaagccaccattcaagctctcacccagatcacatcagtctcctcattggtctgcccctttatgcctctaaagtctgttctacaaacaatacgcaagctaaaattatgacctttccaaatgcacttaaaatccaagctcctacaaatgcctatatacctacctacattcagatttttataattcctacttatacatatccagaaataaagcctcgatattgtcagagcaaccagaaagtcatagagagactcaggacttaatccaagtcttccaagtgtcctttacatgccattcaactgcccagtcatcgagtccaggaaatttatctatgtcagttttctcatttacaatattgtaataaagctgcttctcctccaacttcacctggtgattagaggatccgatgagatactgtatgtgaaagtgatttgaaaagcccaaagcattatgcaaagtaatatcaaacacaagatactgcggaaatggtgctcaagtgtgaagttctgaacactgtttataagaaaggggagttaaatgaatctagctaaaataattgacttgccattcatcactaaccttggctgtttcaatccttttctgctgcttaagaggatcggtgcaagacaagaaagcacattgctaccctgggtaaacttcctgatttgaggctttaccttaccaacaaataagaaataaataagtcttacaaaagtgtttctgaccaaaaagaaaagagagagctacaaggcagtttagaaaactggtgggggaaaaaaagagtaatcagcctcaccatcctcaaagtctctccaacactgttcttccgcctcctaaggtgctgatgatacagatgaaaaatcagagacatagggccctcccaaaccccaagaacacagcatgacttcaaccctggactatttctgtagctcttggaaactctgccagccagcaggagctacagccacatgctggacactagtcaggctggagaagattccacccatcatcctggttactgacattcatctggctgtgcaatttttttttgttttgttttgtttttgagatggagttttgctcttgttgcctaggctggagtgcactggcaaaatctcctctcactgcaacctccgcctcccaggttcaagcaattctcctgcctcagcctcccgagtagctgggattacaggcgcttgccaccatgcctggctaatttttttttttttgcatttttagtagagatggggtttcaccatgttggccaggctggccaactggtctcgaactcctgacctcaggtgatccaccctcctaggcctcccaaattgctgggattacaggcatgagccactgcacatggccaggctacacatttctatacatgagaaactggccgtcaagtataagtcaaataaccaagaaaaaggcaagtgcttctaataaaatgagtccatcaatatgtaattatatcatattaatgtcagatctattgacagaggcatcatgcttttaaaagatggcagcaactacagctggatacacaaattttttgcacaagatcttcccttcatagaagccccaaaaccagtcccacaaaattgcagtcatttctcgacatctatacaaattcacattattctaattaattttctattcattgtcttcaaatcagttatttcagttctatgttgatcctttaagaaatactgagtaatttaatatattcagactacagaaatagaagttatgctgtaaatgaagggtctgcacacttttttctgtgaaggattaaataatattttaggctttgcagggtacacactgttacatacttttttaaaaaatggtcttttcaaaatttaaaaatattcttagctctcagactgtataaaaacaggccgtgggctgtattttgtcaatccttgtaagtaataactgtgaaccaatattacagagaaaaaaaaatgttctatacaacatgaatcagcctctctttaatacaagccacactagttcaacaggctctcctgatgtcctgaattaggaagttctatattagagaaggatgaggaatatgccctatttttcacgaggcaaaaaaattccacccagatatttctctcttctttaagtggtcaaggataaaagatgttcaataaggactatgaagtatcacttataatgtgcatatttataacatttaaaagcctggatttacataatacaggttaataaaaacacaaatttgaggcctgaaaaattataaagacaaaaagccaaaaatagctaggataaaattcaccaatccatcaagaaagggggatatattattaaaatgactttcttttaggatctctatataaactataaaaaatagctccaaaattttgtgaggataatggcatacaaatgacttgctgtaattggtatttttacctcacaatgcaatgaagtccattgtacctgagataatggaactctctcgcattactgcagcattgttaccaagcaacaagaaataaaatgtcaagattaacactttgtttaatatatttttatcaccaataaactatttctattctgctattcttctgggtgtaaatggtcattaagctaagaattatatttgttaatatacaagtgtatgtaaaataatgcagtaagttaatactaggcattcaccaagtccatatttttatatttattacttccttggtagaaatagcaaatattaacgtaacagtaattctattaggttattttgccaaactactcaactacaatatgtcttcattgagtacatcttcattagcatccaaaattttcaaaccaatctagcatttcatgaaaattcaaggaaacgaatgaattgtctttaaatacttcaatactcttgaaacaagtatgatcagtcagttcattcagtatgcttatgttaggacattacattttcaaagcactctatacctggctaaatatgtggcacagaatttacagatctctttaagaatgatttagtaatcaattttaaaaagtccaaaagcacaagtaaaatattataactgaaaaagaataaggaaaataaatgtaagttgaagattttatataatttaccatgtctaaaaaatcaaactgtgtgaatgatatccatcactaactacatccatcccaaaagttagcacttaggaaggtgatagtattctgccgaaggactaaggattcttcagaaagggttggtggaaggaaggtatttcttttttccatattgtatcaaacagacacctttttctttctcttaaaagaacttgtgtcaagtgttcaactcaactggctgatgtgagtagattcaagaagattaggaacagttttttgctaacctcattctacgtagctaactgaaatagagagctttaaccaggtaaattctaaagtgcagcaaagagcatgtagcatagtaagttcacatagtgaatgccaaatttgacatttcagccaagttcttataaatatgcctccatatgtcagagatgtttgtgtgtgaatgaatttcacacaggaatgagcctgcgtatggatgtgtgtgttcttgaaatgggatctaatgaagtttttcaacatggtgagaagtctttgtcttatctggacagaagcttcatttttcttcctatcccaacattctttttattgcctcttgaaaaattatgagttccactgcttttaaaactgtatcattaggcattagcagtctaaagaataagaaaaatttaagagagaaggaattatgcttactctttaggcattttcatttctctaaagcaagaagcatgatgccccaaatctctaaaacactgatacattaattggcctgcttaataatgaaaattaaatgttcataggatccactttagtgcttaagtcacctggttaaaatctactgcattcccaccttctattgtaaagtaaaacaaccagcttgatcacttctaagataatgtatgaggaattattaacacaaagctctccaaacagggccagagtcacaaataccaggaggctccaatgtcaaaagtcacagtctttgaaaaacatattgccattattctcaagaaagttaattctcgtaagactccacaccctatgaccatgcaatgaaaaaagtttgtcatccctgttctccaaaccaccagggaagctcttgcctcaggcctctgcacgcactactcatttggccctaaaaggctccaccatcagttagctgcaaatctagcttcctctctttcttgaggcctttactcagaagtcatctcaccgaggcctttcactgtaccaccctaagtttcagtttctttccctgaaatatcaggtcccttttcatgctttgtttttcctcccttaacacagcaatatcaaatatactacatattttacttattattcatcctattatcaagatagaccatcagaatgtaaactccatgagggcagtgagttttgctttgttcactgctgtatttccagaacctataaaaatacctagtacactagaatttgagtatcagtgaactttccttaaactatctttgcactgtaatatctggtacttgcttcaaatcaattagaggagggagaaggcaaagagatggggatgtgaatggggcaggagtgaccatgggttgatagtcattggagctaaggtgttgggctcaggaaggtacattatactcctctgcttactattatatatgttcattatcctcaaaaatagacatttaaaatgaaaatttgtattatcagttacactgcaatctttacctttcctcactcaccaatcagaaacactacatgtctgcttggcaggatggcagacatacccatgatcttttcctctgattaacctcctaaaaagagatggagaggtggtggagcaagatggtggaattgaagccatttgtccacacctcaggagcaccaaattttaacaacgatctgtaaacagaaaagcaccatcacaagaaccaaaaatcagacagcatttggggaactcacagcactgaaggtaagaatgcagacctggctggcttcgccacctgtttattgtagagccctagggccttgagttaaaataggtggtagtcaggtagtagttaacagcaggccttgggcaaaacccagtgctgtgctggctttaggcctgacccaccacagtcccagtggtggtggccatagggatgtgtttgtatcaccacacccccagttccaggcggttcagcacagagagagagagagagagagagagagagagattccacttgtttggaggaaagtaagggaaaagaacagcagtctctacctggtaacccagaaaattcttctggatattatctaagaccatcaagacaatacctcctacaagtttacaaaaaccacagcaattatggttggagcccaagtccctttgaatacctagaaagcgttcccaaggaaaggcactaacaagacaagaccacaaagactacaataaatacctaaccctttaatgcccagacaccaacaaacatctacaggccttgagacaatctagggaagcatgacctcaccaaacaaaataaggcaccggggaccaatcttggggaaacagagatatgtgacctttcagacagaattcaaaacagctgttttgaggaaacacgaagaaatccaagataacaaagaaggaattcagaattctatcagataaatttaacagactgaaataatttaaaagaatcaagcagaaattctacatttgaaaaatgcaactgacatactgctgaatgcatcagtctcttaaatagcagaactgatcaagcagaagaaaatcactaagcttgaagacaggcttattgaaaatacagtcagaggagacaaaagaaaaataaagaacaatgaagcacacctacaatatctagaaaatagcctcgaaagggccaatactaagagttactggctttaaagaagaggtagagaaagagataggagtagaaaagtttattcaaagggataacaaaatgtcccaaacctagagaaagataaacattcaagtacaagaaggttatagaacaccaagcaaatttaacccaaggaagactacctccaaagctaccttttgcgagttaatcaaattcccaaaaaatcaatgataaagaattccaaaagcagtaagagaaaagaaacaacagacaacagagctccaacatgtctggcaacagacttttcagtggaaacattacaagccaggaaagagtagcatgacatatttaaaggactgaaggaaagaaacttttgccctagaatagtatatatggcaaaatatctttcaagcatggaggagaaataaagaacttccaagacaaccaaaatcagagggatttcatcaacaccagacctgtcctacaagaagtgatagagggagttctttgatctgaaaaaaaaaaaaaaagaatgttaatgagcaaacaagaaatcatctgaagatacaaaactcactggtaataataagcacacatagaaacacaggatattattaacattgcaactgtggtgtgtaaacactcttaagcataaagactaaagaaccaattagaataactacaataactttaagacatagcacaataagaaattaagagaaacaaaaagttaaaaagcataggggtgaagtaaaagtgtagagttttggctggatgcagtggctcatgcctgtaatccctgcacttttgggaggccgaggtgggtagatcacctgaggtcaggagttcgagaccaacttggccaacgtgatgaaaccctgtctctactaaaaatacaaaaaattagttgggcgtggtggtgcgcacctttaatcccagctacttacgagatcatgccactgtactccagcctgggcaacaagagcaaaattccgtctcaaaaaaaaaaaagcatagagtttgtattagttttctttttgcttatttgtttatgcaattagtgttaagttttcatcagtttaaaataacgagttataagacagtcttttcaagcctcatgctaacatcaaatacaaaaaaaactacagattcataaaaaataaaaagcaagaaatcaaagcaccccaaagaaaaatcaccttcactagaaggaagacaggaaggaaggaaagaagaaagaagaccacaaaacaaccagaaaacaaaaaacaaaatggcacgaataagtccctacttatcaataataacattgactgtaaatggactaaactctccaataagacacagtagctgaatggatgaaaaaagttaagacccagtggtctgttgtctacaagagacatggttcacctataaagctacacagagaccaaaaataaagggatggaaaaatatatcccatgccaatggaaacccacaaaaaaaaaaaaaaaaacaaaacagaacaggagtagctatacttacatcagacaaaatagatttcaagagaaaaactgtaagaagagacaaagaagcttatcatataatgataaaggggtcaattcagcaagaggatacaatgattataaatatatacacacccaacactggggcagccggatacatagagcaaatattattagagctaaagagagacagattaaaatacaacagctggagacttccacaccccattttcagcactgacagatttctcaggaagaaaagtcagagacataggacttaatctgcactacagaatgaacctaatagagatctacagaacatttcatcagataaaaattactaagaggaaaatttacagctataagtgcctacatcaaaaaagaaaaagaaataacctaatgatgtaacttaaagaactagaaaagagcaaaccaaacccaaaactagtaaaagaaatatagatcagagcagaaataaatttgaaatgaagaaaatacaaaagaacaatgaaacaaaaagttggtattttgagaagataaacaaaattgacaaacctttagccagactaacaacggtgggggtgggggtagggatgaagacccaaataaaatcagagatgaaaaaggggacattaaaactcataagaaattcaaagagtcgttagtggctactaggagcaactatatgccaataaattggaaaatctagaagaaatgaataaattcctagacatatataacctatcaagattgaaccagaaagaaattaagaatctgaacagcccaataatcataaatatatacacctactatgtatccacaaaaatttaaaaattttaaaacaatggcacatgccaggcaccagtatagaacacagaagatacagctccctgaagcctggctcttataaataagtcttagaatatcacttttgaaaataattttctatatgtccattaacctctaattcttatattagatgggttcaccgatattcaatttatattgtgattcataaaccacacaggctacaataaatatttgtgtgcaccaaatatcgtatcatctaagcaattcttttacaggcaaacataccacaatataaatacaataaaagtaattatatttatgtcatgataaatgtacttgttttgactgaaagctgaagttaactaaaatagttgaaagggccttgggtaaacctttgctgtctcgtaaactagccatggcacaagcctgacagcacaaagaaatccacagcagtgaggttatttcagtcacaggcagcctcagcagcttcagtggctgagtcagacgaccttttctgacagcacgtgcatgccaggctgcttgcaggagacaaagcatcaacagtctcctgagtgaagcactctcatccctccccataggttttctattacaggctccttcaaaaaaaaacagaaataggccatttccagagaaacttagatggtaggttatgcacacagaagactagcagaggggctcatagggagttgagagcttaacacaataacaggattcctcctgagaaacagccaaattagttccctttggaagactcaagagtccttgctactccttgtcatacacatggaaggcaacacccaagagtcattccctggctggttttgcacttgaacttgtaaagtttatcagggaagacttcaccctcactcaaagagagggaggtccagaaataacactgtctggactgaaaagagaaacatctctctagcatgtgtggcaatatgcgcccatgtgcactatttttcccaagtagctacctaggtccataagaggggtaggaagatacagccagcatcaactgtgtcacaactttgtggggaagcatgcaaatggctgcacattttaagaaatatgaatgtaatgttcatattggttttgttaaaaacagacataagtgatcacctctatggttttacacaactcataagtttatctagaaaagtggtccccagcttttttggctggtactagggatcagttttgtggaagacactttttccacagatgggggttgggcagggacgtggttttgggatgaaactgttccacctcagatcatcaggcgttagttagattctcataaggagcgagcaacctagatccctcacatgcagagttcataacagggttcccactcctatgagaatataatgccagggctgatctaacaggaggcagagctcaggcagtaatgctcactcacccaccactcatctcccactgtgcggcccagttcctaacagaccatgggccagtacaggtccatggcctgagggttggggcccttggtctagaacacatctgaaaacaaaactttgccaaaaaggactaatgtttcccttttgcagagtctagaaataagtaacatcaaggacaatttgattttcttttaaattcacaataaacatactcatttacttcttgatgtaaaacatttgctgtaaattatataatttaaaaattataaacaaaaaagcaagatgtatgttcctttgccaccctgcttctaaatccaaaacaaatttaagatgcctaagggaatcttagtactttaaatatttatagttctatcctctttaaaactcaagtcaaaactcaaatcaccagggagaagaaaggttgagaagatgcagcattgtggagtgggaagatgctggcacagagctttaggagacaagctctaatccagattccacaattcaaaagaaaggagatgagctaagagttctttatttaagaaaaaaaaaaaaagacgccgttgactatgttatatagggtgtagtcacactgttatgcctcccactgcttaagatactatagtactagaacagacattcagtcaccacatttagagaaatatgtaaaaagcttaaaggtcaaagaggctagacaatcgaatgaaaagagtccaagagaaagactgaatgaatgcacggggccactgaacacaggatgatgcctttctcaaagacatctctaaggtagatggtactagaacaaaaaaaaaaaagactacaattgaaataattgtcaaggaaggtctgggatagaaaaataagctgggcaaaaaaaaaaaaaaactccttatttgcttgtatctaatagttagcaatgaaatggactacttctggagattcaatatcttccaagagtttaaagcatccattgatagataacatggaagcatttcattacataatggaaaagagtagacagcctggaatcagtttctctgtgggtctctcctggttccacctaagctgtgtgacattgggtatataacttaacctctctatgccttaaagtcatcatctctaaaataaagataattattattcctatctcataggactattgtgagaatttaaaataatgcacataaggaatacggtagtgactaatacatcataaatgcctgaatagtagctaacattattggcattttgcatgcagaagaatatgcagttaacttaatgatccctgaagattcctcttaaatgttgcacttcagagaccagcttataatcatccatcccactatgactcccataaaagaaagcaagatagggcttgaaaagtcatagcaacctggaggccagcgcaggtaacggagtgcatagggtatagcacagaacagggggctggaggtccagggtactcactggactcaaaatacaaatcacaaagccaaaacagagtttcacatcagaaaatgcccaatctaggcactaaccccaattccaaattattttccacttttgagagcacagttcttacaattcaatctatggtcatgtttctactatgtatactatatgtttctactatgaacaggtgtcaggggtaggcttacaataatcctatagtccaaagagctgttttgcttatgttcctgtactagtataacagattattcttgatccttctaatccagctttgtccaataaaacttcctgcaatgataatgtttacttgtgctaatcaatacagtaatcactagccacatgtagctttgcttgatatgggactagtataaaggtaaattcaatttctcagtcaatttttttttttttttttgagacagggtctcactgtgtggcccaggctggagccacagtgacacagtcacagctcactgcagccttgacctcctggactcaggcgatcctcagacctcagctcctgggtagctgggacttaggcacatgccaccacgtctggctaattttttgtagacacagggtttcaccatgttgcccttgaacatctaggctcaagcgatccacctgcctcagccttccaaagtgctgcgataaattaggcctgagccactgtgccataattttaattttataagtcacatgtggctagtggctaccatactggagagtgtagtgaattaggagtggttgcgcacattactgtattgaaagagaccctaatgtgtgtctcggcctaccaggaaagcattctgtgatccatcagagatgtctgttccgggacacaggagggaagcctttattacatttgcaggcttagttaaaggattttctctccttaggccaaaagagagcctctctttcctaatacctgcaatgattcttcaacacaaggttattttctgctcttgtaagaaatgagatgaactgaaaagaaccagattataacaggaaaaattttaaagagaacttcacccaggataatgcataacgcccctctgtactctggaaagaaatactggtttctgacagttttacagaaatacaggaagtcaacagggtgtaaaactattgattattttaagctatgctgtaggccttttttcagtaatgctatagttgtgtgccacggacaggtcattaagatggatgaataaattaaagacaggttacacagaaagtgtaagccacactatccattttaaattcagaaaatgtaaagccattgcaaaagaaaccaccatgcctcggttgaaagtaacatatacttcagcaatttaaaaatagcacacttcattttccaagaaaggaacaaaactctaacatttgattgtttcaaaatacactgtactgacttcatgaaacattatcttggccttgtaaaaatgaatcaaaagataccacatacaacacctgccatcatgagaaaaatcaatcaggaacctatgtattttcaattccagatcccaataggggtcctataaagccctcccaaggaaaaactacctcaaactcccacgaaaattgggttccaagttgatcctcaaagcctcaagttaagaaccatttgaagtcttctttgaggttcaatatgttacaaccaaaatggcacggttttggtataagcccctgtttctgccctgggtccttaagcctggaaaggctgcagaattatccaagccccttccaaacactgagatacccaaaggacagtcagtgcctgaatttgctctgaattgaaccacatcaaagtagttatatgtgcaatgctcttcccttaaagaaatcacaaaatctatcacagtaagatcatgaacttcttctgacacatttactgttttccagggattccacatacataaattcatcttgggatttcattcaaggagatctatttcatttaaggatcaaaagacttttataagctggtcccattgcttgattcccaaagagagcattctagtgagaccctatctaaccagaaagctgaagttacagcaaaattttaactattatatatttagatagaatggatccatttccaaaacaaaaaaaaaagctgtcattgttatccataaaacaaatgaactgtggtactttttcttgaattaatacttaacatcaagttaaataattaacaccaagaattcaaaaataacctcttacctctaccactgtggtttctgcagctttgcacattggcaagttgaaattccttgcacttttcctacaggggtggaggagataagaaagtgggggggaaaagacgaaaaataagcatctctgtcacctttaaggttttatagattagaatttctatgaactaagaatctaagaatctttccaaaaagagtgtatcatattttccattaataaagtttcataaatatctcataaattttaaaaaccataactactttattcaatgtatatagttttgttttgaacaggattgagggaaagaggaactatttttcacattcaacatatagctacaacaaaaaaaggaatattaataaatctatcttatttgaagttaatttcccttaatcttttaacaagtatgctttgtccctattagttaaatatttcattcaaccacttgctttcattaaaatattaagaaaggaaaagtagcaaatgcttcacatgagaaggtacagtaattacattctctattgaagagaagcctattgctgaaactaaatgaaacattcattgataatttgtgagtcaactataaagatcattctggagaatcattttctgatgaagtttttggaagtataacacccacatcagaccccgaggtgtaaaaatttctagcaggtgccaattttgccgatggttttgcactctgatgttcctcaatacagttcccctaatggtaaaaattaaaacatattttttgtctctgggaatatacgttgatggcagaatttctttggtaaaaggaagtaagtcacagctatgttttactagctcttttgagccaccaatatttcttttgctcagattgaagaatgagtacaggaataggagcatccttgagaaaggagccctcgtgaactttcacaagttgctgggttagatcccaccagacatccaggcatcaaaagctccaagggcagaatggtcagaggcaaaggagtcccaagtcccccacttgaataacctagacagacttctgttccagctgtcccactaaatatgaagttaatcctaaggtcacttgaccattggtgatgcaagctttcatttcacacccgaactcattaaccaccagcataaagtcagtgcccagaatagcccttgtgcagccttcaaataccagagccaggcactgcagcgcagaataaacatgggaatattttcaataattcctttctgtttggtagtatacaattttgttaatcttttttaaaaagcaactaaacgtgtaaatattacacaaacgtgtcaaataaggtaaagatgatgtaaaattactcctgttattgccaaaattagttgtactttaaaaaactggctaaattaaagaaatcaaagagcattaatatcacataagtccttcagaaataaaaagtgatatgagagtatcactgagaacttaactgtaattgcaccaaagctgcatttgctaaagatttaaaaattgttaatcgaaagcagcaaatgataaataagcaaaaacaatgatttctgtaatctgataggtaaagtcttcaagatcagtttggaaaactcttaagtgtacactcaaaggtttcatattcctcaaaaaacaactatataaatctataaatccaagatataaatacttagtatgcttagaataaccaaaagattttaaaatctataaagtctgtggctgagaggattgaaaattcagtattataaaggttaatcaatttttcagatagaacctttgtaagcatttcctagaagacaccaaaaggactgaaggactgaccccaatgattattagcagtatctttccagagtatcaaattagctttgacattttaagacaatacatgtaaattacaatatcaattaaataaaattgtatgatgtcacattttctaagcatgtaactggtcttggcaactaaaatacacaaggagaaaaacaactgcatgtgcctatataaaagggcatatagatccaaatatttaacaagcagtgcaacatagatatcgaccagtctaaacagactcccacaagtggacataccagcagccctgcacacacctatatatgtgcaatacacatgggcatgtatgattttgggccattacgaaaatacatttttaaattccaaattcactctgatgtccatttttagagttgctgatatgcacgagtgtttttaaaactatcacaatacctgaaaatcacgtttcctgctcggtccgccttccaggctttcaccaaagcaaaatcccctgtaattgcttcctccaaaataaagtgctgaccattgaactccctcacctgcagaagagggagaaggcatcatcaggtatttgcataggtcttgattgtgatagaggcactctgatagaggtagataataaggatacaagcctactgagggaaaatttctcagagggaaaagcatcccagagacttcaaagataagcagtgttaggcaagcaggacttagtcaaagtggtctaaggggagctaaggaaacagacaagcaaaggtccagtgacaaaagaaaatttgtgcatttgaggaactgaaagttctatggcctgagggatagactattttcattttactatttgtatgtacaggttgtatattgaatgtgaaaaatagtccttctttccctctcccctgaaaaaacagtttgcataaaatggtctatgtattgttttcctacataaaatagttacaaaaatctatcattcagctatcctcaataacctatatcacctgttgagattttaaatgggattcacagaatcagtaaatttggagaaaaccaacaagccctatcttcccacccatgagcatagtatatgtctccatttactgaggttttcttcgacctccttcaatagttttattattttctccataaaagctttattttttttcttaggtttatttataggtacttagtggtttctcttgctactgtgaatgttacatttgctcctatctactcttctgacattactgatctagggaatgctattgatttttatttatgtttattgccttttaattatactaccaattttggagggaagaacataaagcaaaactgtcttgccatcatgttcttttattcttgacggtttatttccgggaattaaaacaagcatccattgccacactccatcactgcacaaaatggagccatgtgaatgtagaactccattctcatccctaccgcaccccctagtggaaaaacagactaagtgcgttttacaaaaagctgctatagaaaatagaaaattttggtacatttatttcaactatggtttgaaacaaaacctttcttaaataaaggctactttaaagacattaaccaagttgcctgctagaaaaaagattaatgcacttagggaataactgatgaatgaggatcttactataggaactaagataaattatatgaaagatatttctgagccacatatcaatatacaaagttattttggaacggcttatgtatttcaaaaatcactgtaaataccaacaatgatagttgagtgttttacatacagatctagaaaactggggtaaatatatgcaaatgcaaggcaaagtcaataaataggcttcttttatattctagttacataattttctgatgtgtctacataccagctgttgctgagtgttagttttactgaaatttaaaaatggggaaggagttggttttgtcaaactagctattatactcacttgaaagaattctacatttcgtagtcaccacttcctcactttttggttctttcttgaatctaatgagattttcatcccctctattccaaaaaggaataattcttaaagttgtcaatgacctctgtttttgcaaatccaatgattcaattccaggccctgtattaccaacctcttcacactcagttgatcattcccttctttttaaaatttcccttctctttcaaattgccagatgcccctgggtttcttctttacttactaatcactctttcccatttctctttgctgctccttctcttcccaatttctaaatgtcaacgaggtgctctgcactcagcccctagacactcatctagtatacagatttaaatactatatgctgatgcctccaaagtctctatcctggctctagactctcccctgatatgacgttcactaagcacctcctcttggagtctaatgaacgtctccaatgcaccatgttccaaacagagctctttgataaggcctgtgcttcattcatcttacacagtatgcttgactcctcttacaccccttacctatctaccagtaaatcctgttggctctaccatgaacataacaccaatttcaaccacttctctcaaactccactgttaccaccttggtctagccaccttccattccctcctaaattaacacaacagcctcctaaaccctctctcgctgcttctgctcttggcttcctagcaaaaaaaaaaaaaaaagaaccaccaccccagcagccacagtgatagttacaaaagacaactcaaattacatcactctcacccttattcaaaactccataggcttcccactgcgttccgtaaaattcaaactttgcatgaatttgactcctgcctctcttcaatctccatccttatcactctctgcctcatgtgctgttccagcctcaccaccctcctgttccccaaacacggcaagcctgtagctgcctcagcaccttgtacttactcttccttctgaacagagcacaaaccctcttatctccacttgcctcgttctcctaccttattcaggtctctaccaagtgtcacctccccaaagaagctctccctggccaccagtctggaatatcagctgcctggccagtgataattaattctctttgctgttaatctacttgatttgtcttcacagtacttccactatagacattatgcatttattcattcattgtcagttcctccactagcaggaggacttgatctagatcattttaccacagtgcttagaccagggtttggcaaagagtaggacctcaataaataacactaatttagaaatgaactcactttttcctgctttaagtaaaaaaaaaaagtactaagaattaagaaataaattatctgtcatattcctagggaattcagacaaaattaaaaaactacgagtttgaggcacctgattccaggcagaaatgaacctaagaaatattttagtctcatattttcacgaggtgaattaatttttcaacttctagcaagctatcaaagtatttatcccaagttttccgggaactttatgagatactactacagttcattttaacaattaggctcctgtcttttactttgtcaagaagccttttaaacttatttagacagtaaaggaaaaagatcaaacataaaaaacacattttttatcttaaaatattttaatgtaaaatttatcatataaaaatgtacaaaatatgcttatgtagcattttaaaaatatatgcagtacttatacatttttataacaccagcttaagaaatagaacattaatattcagtttaaatccccctgcattccctccctaattgcactcattttctgccttccaatccagaagtcttctctttatttatttatgtatgtatgtatgtatttatttatttattattattatactttaagttttagggtacatgtgcacaatgtgcaggttagttacatatgtatacatgtgccatgctggtgtgctgcacccactaactcgtcatctagcattagggatatctcccaatgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttaaagcagcatgatttatagtcctttgggtagatacccagtaatgggatggctgggtcaaatggtatttctagttctagatccctgaggaatcgccacactgacttccacaagggttgaactagtttatagtcccaccaacagtgtaaaagtattcctatttctccacatcctctccagcacttgttgtttcctgactttttaatgattgccattctaactggtgtgagatggtatctcattgtggttttgatttgcatttctctgatggccagtgatggtgagcattttttcatgttttttggctgcataaatgtcttcttttgagaagtgtctgttcatgtccttcgcccactttttgatggggttgtttttttcttgtaaatttgtttttgaaaggatcaacaaaactgatagaccgctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaacagtccaggaccagatggattcacagctgaatcctaccagaggtacaaggaggaactggtaccattccttcttaaactattccaatcaatagaaaaagagggaatcctccctaactcattttatgaggccagcatcatcctgataccaaagccaggcagagactcaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaagaccgtgacaaaattcaacaacccttcatgctaaaaactctcaataaattaggtattgatgggacatatctcaagataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaaactactttaaagttcatatggaaccaaaaaagagcccgcatcgccaagtcaatcctaagccaaaagaacaaagccggaggcatcacactacctgacttcaaactatactacaaggctacagtaaccaaaacagcatggtactggtaccaaaacagagatatagatcaatggaacagaacagagccctcagaaataacaccgcatatctacaactatctgatttttgacaaacctgagaaaaacaagcaatggggaaaggattccctatttaataaatggtgctgggaaaactggctagccatatgtacaaagctgaaactggatcccttccttacaccttatacaaaaatcaattcaagatggattaaagacttaaacgttagacctaaaaccataaaaactctagaagaaaacctaggcattaccattcaggacataggcatgggcaaggacttcatgtataaaacaccaaaagcaatggcaacaaaagccaaaattgacaaatggggtctaattaaactaaagagcttctgcacagcaaaagaaactaccatcagagtgaacaggcaacctacaaaatgggagaaaattttcgcaacctactcttcggacaaagggctaatatccagaatctaaaaaacacattaataaaagctttgaatccacatagatcactctcaacagaaagatgtctccagatggaagatgcagctggagatcaacagtgaacatcaaaggacatattcagtgacctccaatcttccctctgatcgttcctaggaatgggaggggcacagccagcatccccatatgcagaaaagtgataagagatcccctgatttactacgttcacttccccagagatgactacagcatttctgcaacctgtgttaactttcttcggccatttggacaggaaaatggaaagatactaaaaaataccgtaatgaaatactggccagtgtaatttttgaaattttctccaacctgagcatctcaaatacctttatctgaaattctactcttctataatatgcctaggatagatgtaccccatcctactcagcattttaaatagaagtaggttattccatcaaaagctcaaatgtgtccaagatacaaaataaatagtgaccatatgaactctctattctatcataacagttcctttcaaggtttcagacaaacatattatttccttgttttttcttcctacagtcactttaggaagggcctgagcataaagagtttgctagcatgcataccacaactactttattttccatataagcataatcagcaagtataactgtttctcaatttgttaaagcctaccataaaatcagttcaagtaactaaccttgactagtacaccatatgtggattacaccattttttccttctttttattgtagtttctctacgtgattttaaatgctagtggatgcccagatttagctagaaatttcacctatttatgaaaatgaatgagtgctttttctcacatagaggtgattttatacttatttgcccaatgatccacccaaaatcccacgtggaaagagggatcctggtataatctggttaagagtgtttcttacctctcttggcttactggcaatggcaacactgccatctttgttgtatttgatgggcgatcctccttcttgtaccagggtcccataccctgttggggtgtaaaatgcaggaactccagccccgcctgcacggatcctctctgcaagtgtgccctgcaagtgagcaaccaacaccccataagttcactaagcacacttctctatgtggacacaaacatttagacgtggttcctactatctagaggcttataattctaaaaagtagctagcattgtacattagcatacttcactaatattgtatgctagaagatcaattttaagaagttactgcccctctagaaccattctaaatccacattcaaaatgtaaccgcttatttgtatagtcatgcattgagcttccatacctctcaatgatctcttgacacatttaaatgtgtctatttttgatattctaagtcaattttaaaatctgaattatgaaactttagttatatatattaagtaatgcagttaaattttgttttatttcatgatctatgttggtatggcctaaattttattcaagttaataatgtaaagtgtttaaattttagagcttattttaaaccattttcataaatatttttatctacaaatcgtctaagaaaaaaaacaaagtgaaaaatacagcatactggtaaattggtttttaaaagccaagagtacatcaaattgtttcagagtagaaacagctgcaagcaaagttactttgtatcttcttttgatcatcatctttccgatgggtgactcttcttcctaggtaccagtgatttcaagactagtttccctggctctctcactctcaactgtttttctacccaggttttccctaaggaatcaactctggccctgaaccttgacacccttcctaaccttgacgcctactgtgatagacttgttacaacagtcttactagaaaactgactggctagtcagtagttaaaaattggggctggacaccatggctcatgcctgtaaatcccagtgctttgggaggtgaaggatcacttgaggccaggagtttgagtccagcctgggcaacataatgagatctgcctctttaagaaaaaaaagaattggttcatggtattaatgatgatgtgttcatattgtcccaaccttaaaaagtattttctactttaacaggactctaagtattcaactcaaaaaagaaactaacagttgggacttgagacattgagtcattcaagtaggtggaatattctggggaaacagagacttggggtataactgaaaatcttccagataactgattatctagccaacggaaagagatgactctaccttgtgttgtgaagttagtaacatttacaaaaaattaaatcatcaaaattaccataacactaccccttgccttaaaatatgttttatatataccctccctgaatactctccttctatcataccaggtaagggcctgaaagtggactatttctgcagataggccttctgtaggtgccaccagctccttaccctcacccaccaaagaactcctgatccccaccatcgatactcctccccctagccttcaggctgcaaaataagctgccagagccagtgtttactaacgggccactaagttggggaaggagacactgacctctcttagcctgaggaaaaactgtaaaaaaaaaaatgatatattaatgatgtacgtactttctgacgaaataaggagtaacataaaagataccaagggtaatcaaaaggttaattttcaatagttccacaacccaaagaatactgtatcttaacctaccatgtgaaaaatactgctatggaccgaactgtgttctccccaaaattcatatgttgaattcctagtcaccagtgtgactgtattgagatagggcctataaggaggtcatcaaggttgaaggaagtcaaaaaggttgggccctgatctggtatgattagtgttcctacaagaagagacacccagagagtgagcatgcatgctctccgccatgcaagaaccgtgagaagtcggccatctgcaagccaaggaggacttccaagccttcagaactgtgagaaacttctgttgtttaagccaccagtctgtgatattttgttatagcagcctgagcagactaagacatctttgttttttttgtttttgttttttcaaaaaactgagaaaattgagtaaataccaagcccagtgcaatgctatggtatgtacaggtaacggtgctatagagtgaccaggtgtgactgcaacacgagcctcagaatagttcccatgtgtgctttctagacaaacacaccatgatttcattactaatttttaaaaatctactaaattatgttattaccaacttggcaaagtcagtagcaatattttctgttgactaaaataaagcggagtggctcagttcaagagctgagagcagagcatgtcaaaatgaaagaagagcaaactgtagaccctcattttacttaaagatttcagaaagttttcctttctttatgaataactccaattagttaagagatgacatagaaaatgagtgaaaagttgctagattaattatagtaactgcttgctttgtagtaacatcagttccctgggaatctaggttctgatcccagcacttactcagatatagtcacatgcacctttcaagggcttcactctgaagtgtctcagcaagaccagatcacccataaatttctagttctaaaattcatagaaattggagaggcatggtggcttacacctgtgaggccaaggcaggcggctcatttgaggtcaggagttcgagaccagcctggccaacatggtgaaatcccgtctctactaaaaatacagaaaacaaaagtagctgggcgtggtggcacatgcctgtaatctcaaatctcagcttctcaggaggccgaggcaggagaattgcttgaactcgggaggtggagtttgcagtgagccgagatcacaccgccgcactccaccctgggtgacacagtaagactctgcctcaaaaaaaaaaataaaaataaattcctataaattaactttttaggatgattctcaaacattccagcaaatccttttgtatgcttctggcacaatacacattacagtgccaaacttaaaatcttatcttgcagcctggatatcttttagaaatatctcttttttcagtacacagtagaagaaaatattaatcctccagcaatcaacaggtgtgagttagaaacaaaattccctggtttggcaaagtactattccttctgccttacctcttttgcacaaagaaatttccacggagaaaaaaggaatttttaaagtaagttagtattataaaagaaaagcaaattttctcacctgtggtgtcagctccacttctaattcaccagataagtactgtcgttcaaattctgcattttctcccacatatgaagagaccatgcgttttatctgcttggaccgaagcaaaagccccaaaccaaaattgtcaaccctagaaggaaaatgaagggagcttaccaaagagcatctgacagaacactattacatctttttaaagagataaaactttgttaatttaaagaaaaataaatcctttcttataggcatttgatccacattcttagtctcccataaccccaaaacttttgcaaggtagctatccttttattttacagttgaggaaactaaaagtcaagaagtttaagttatttttttgtgggagcggggcatgcacagggcaaggtcttgggcagtaagggacatacagccaatattcacacccatgtcaaccctacagttttaccccgcaccttttgttattttcacggctgcagagtgattctgagttagaagataagcaaagagatgaattggttcttgtcctatgctttgaaggaacacataaatgcagtgacaatatactgacccaaaatgaagatttggatggagaagctctttcacttctaaaaaggagagaggggcattctggtatttaaaagagagattaacatgctcattgaaatgtggacccaaattataaatagctatgaacattttccctatatcataaatcttttgctcaagaagatttacacattcttaacaaaaacaagcaaaaaaaaaattaatcacaagccagtgaagagtgttaagtggaaacaataatcctgtatctgttaaattatatatactatagtttaatatctttattattttaaagctggcgctcaatttattcttagaaatggtatacacagtgttgactttattttttcattgggtgaaggtctccaggtttatgcctttctttatttctattatttttcaaagcaaaatatgcctagaatttaaagcaaagtcaatgtaacaagatagataactgaatgaattatttttccatttcagtcaccttaaagactgaagatcatcttccattcaagagtcagaaatattttaaccaactagagaaataaaacatttctaagataagaatacttgaccttaagctttttttaatggtgaaattttttaatgacaaaatttttttttaatggtgaaatatttttaatggcgaaatatcttttaatggcgaaatattttttaatggtgaaattgttttaatggggaagtatttttcgtagcaaaacacttttaatggcaaaaagtatgatgagacaccaccacaaacatgaagggatggctaaaaaagaaaaaaataccaagtctcgacaaagatgtgaaacaatcagaactctcatatgtgccaaggggaatttaaactgaaatgaccaccttggaaaaactgttagtacctactaatgttcaatatatccatatgctatgggtcagcaattccattctgggtctataaccaacagaaatgcatacttaggttcatcacaagacatgtgcaagaaaattcatagcagcactgttcattatggccaaaattggagcctcccaaatgctcatcagcaaaatagataattgtggcatactacataatgaagtggggtatagcagtgagaatgactcatctataaccatcagtaacaatggttgaatctcacagaataatgttgagctaaagccagacacaagattatactctgaaatattcctttaatatgatgttcaaaatcagacaaaacaaatctatgagaatcaaaagtaaggctaacgattaatattggtagtgggagaagagaacagcgactggaaggagcaggaagagggcttcctggggtactggtcatgttccatttatctatctgggcattgatgacatgggtgtgcagcttgtaaaactccatcaaactgtatttatgagatgttcacttttctatattactccatactatgcttcaagaaagccttttaagagacagaaatgtagtgataaggaccagagtgcttcctagaaacagaagtttttatttacaatctctccctcctaattcctttagtgctctgatggttccttccctacagagcttgtgtcatctacacagttcattcatctgaaactccgttactgagtgcttattctaccacaggtttgttaattcatctaaaactcccttactgagtgcttattctatccctgtgtcaggctctggagctacaatcatgaataagacctggtcctgggcagctttgaaactgagaaaataaacacgtaacctataattacaacagagggagagacatgctaagggaattaggcacaaattgtgataattctgaaaatggagaacccaacttttggggaggagaaagatagcagaaaaaatcttacaggaggtggcacttacacagacataggaaaaaagaaaacatctcgagaacagtgtgtggggtggaggtgtagagaaaaacagacagatagacagctttgcaaagatgcactcaggaaactacatgttcagtgttcctggagtatggactgagggcaacagcatgtgggaggggagaaggcaggaccagttgtgatcagccttgtgggatttcatcctgaaagacaggaagtccctgtaaaaagttttaagcggaaatataacagtatgattagctggaaagcttgaaagatgaaaggccgggatatcaatgaagaggctcgaagtagtccaaacaaccaacagtgagagtctgagcagtgggaatgggaatggagaagggagaaatcaagagggtctttgggggaaataattcataagacttgttgcccatcctgatgaagctgcagacccactccagaattctggctttggtgatggaatataaagaaagttggttgggggaaattaacaagcactagtgacgcctacttacttgatctggaaaggtgttaagtatgtgacaaaccactgacatttctcctgatgccacctgttctcccaacttcattccactctccactctcatactcctcacaccgacaagtgaccactccagctcagctgattccttcccaattctcagaatttcatttccaaacctctttcctacccccggcactcctgacacaatgaacacttcaaagtgtctaggtaacaggtaactgtcaacctcctactcaacgtgttttgcacccctagccttcaaatgctgaatctgataagatttcccatccaccatgggtagaaaagaaatagctgcatgacttactctcacttggttcaaaagaaaactaatgcctaagtaacataagcattttcaagagtgtacttttgagctagaatgcccggcaagttaagaatacatttgtccactagaggtcaccagaggcctaaggattccgttgttcaagggctgtcttcccattactctcaatgcacacaatgccttctgagtttttaacctactcctagtacctggctaggtccccacaattctattcccccaaattcaactccactgcagccttcccatctcacctcatggcaggctcaccttacagatcctcagcccaaaactaacgcagcgatctttgacttctctcacaaactccacattgaatctatcaggaaatcctgattcccccttcaaagcctattcaaaatctggccatttctcactctctccttggtactctgcactatcttgccagggtactgcaaaccctccctgcttcccctcccacacaacatggcagccaaagcaagccatataaaatgtaagtcagaacatatcactgctcttgctcacacccttgtgatggtactttcattcagagtaaaattaaaggtctccggagtggcctgcaaggtcccatgtgatcagttgccctttgatgtccccaacctcactccacccattctccttttggctcacttctcttcctctcctggcctcaccatccctccaacatctggacctcagatggctgccctgtagactaaattgaggggtccccttgccctctggcttctgattgggttcagccactctgaccgggttcacccaatgggaggcaccatcaagaggatgtgggtgaggggaaaatgttgggatttatattcctctggctctctccctgagaagttacagcctattggataaccccctccataaagctttcttccaggtcctagtaacagctccctgccttcactccttcagacctggggctggtaacagcacccctccaatacaaattccagtgttctttattactcatttttccctcatccctgaccattccactgaaaaggctccctttggtaaactcctcaaccactcagaaaattcaattacgtttgatatcatctacagcccagactaataaagttgtaataaaataattcatgaaggtagatatgatccattttactttctgtagtttaaaatatctgaaactcctacaggcccatagtaaagccagaatatagttggacactgattgacttgggaatttttctaactactgtcttctggatctctttggcttttcaacccattacccattttaagttggctctatttggagatcacatctctttattcatttgttagctctgagaatcattgtttatatgggctttgctttgtttttagactagtatcctggcatagcaatcaagcagtgcataagacgctagccccaggtgcactacctgaccagttcttcaggtcttgaaaatgctgtcagcttacaatgagagtgtttcttgccacatactttacaacccaaatttggcaagtgtatatcttacctattatcagacattgatgataaaaaattagtaagacaagtcccttacctataaaggcttacaagataaagaaaaatagatgtgatcttttgcaaatggggaacatatcatttctaatagagacatgtatattaaaccatcttatagctctttaatactaaagacaatgctgataagaccttcaaaaagatgggtgctttcctttagtagccaacattttttagcatactaaagagagatgtgatctttttcctgcatcataacaaacctgggtttcaaacattttggtgactagaaaaagtctaaggccaagaattcattaatgagacacattattataaagcaaaaagataccgcatcagagacaatgttctggaaatatttccatgctctgaatctgaaatttaatttgctgattttctgaaatctcattaattggcaattcttgtcaaaataagataaacaaaaataaagttgggatcacttaccaagttgtatttcttttgtttacttttcattttagacatacttaaatctggattagataattatatttaatatatcaagagtaccaaaaacaaaatgcttcatttaaatataaggctaatttatgacatacagtaatttccccatcccccacccaatctgcagtttcattttctatgtggtttcaattacccagtcaactgcagtccacaaatattaaatggaaaattccagacatataaaattcataagttttaagttttgcaccattctgagtaacgagatgagctatcatcatcctactccatcctgcccggggtgtgaatcctccctttgtccagcacatctacactgtatatactactctcctgttcttcacttagtagccatgatggtgatcagatagattgctgcagtctttgctgtgcttgtgttcaagtagtccttatcttacttaataatggccccaaaacacaagagtagtggtgcaggcaacttggatatgccagaaagaggtcataaagtgcttcctttaagtgaaagatctaagtaagaatgaatcttttatccattaaatttcaaagaaagagaaaaatatctgctagttttgctgtcatatctcaaactgcaaaagttatagccacagagcataataagagcttagttaagatggaaaagacattaaatttgtgggtggaagacaaacagaaatacattcccattgacagcaattgggttgagtattagccatgatttcagaacacaggcccctcgaataagggaggacttctgtagttacatgagacaaatgaaatctttcatgagctgagcacagaagttcaagtatacatcccaggaattggttagcccttcccagacaaaataactaaatcctagggaatgtccataatcagctcatggcctacatctgattattaactccttcagagctgcagcttcctcaacaaagaacaagggcacagcagaggggtcactgcctttatcttgaggttcaaagtcattggtacacaaccagacattttagagtgatagactgaccattgggctctcaaaaaactattatacctgactagtatagtaatatatatatatatatatatatgtaatatatatatatatatatacacacacacacacacaagtaattataggtgtaggtacatatgtataatcagatttctcagcctttgtcataacagcatctattctgcatcaagaattttatattgatctgtagtatcccttataagcataaagctatctggaaaactgaaagtgctgataatcaaaagtatgtataatcaagtcaaattaaagggcataagatatgtttaagagttatcgagttgtcttaaacaagttacttctctattttcagacgatctgaaaagtcagttaaacaagggacagatgatttctacaatcccattcccctccaacacacagtaactctgagactcagacttacaggctcaggacagtagggaatacataactactgtaaataaaggagattggtaatgtaatatacatatatatcaaagataagtaaaattcagcacacaaagaaaggctaaaagtctctaaaggaactcaaaaaggggcaagatcaataaagactagaaaagtttctataattggataaggatactttgaggatatacaacttaagtctaatcctgagagatgtggatagacaggaaagaggagggacagtctcccagaaggaaacagactcagaaaaggaaaaatgggcacaaaaaagtagcatcagttttacttcccaaataacctacactatttattctaaactgcttttataattggctaaaatgccaattgggtgattaaaaatgtaaaatccttaaagtctttaattgttgagagctgatgacttaccattttgtaaaaataaaaatatggcttttcctaacatagctaaatgtaccttaatgtgcatgctattattaaaatgatggcttatttctgaccactataatatgcaatcctattatcttaagtgctggctgcatatccaccttccaagaccagccatgtttttgtgattaatggtatccctttatttatgatctagaatgatggcattgctaaaagaaagggctttaaacagatttcaaattgatgcccaccttgctttataaatgatctaataaataacataaaacaatacatttaaattttaaaatgcaagacttaatttgaagatatatattctaacttcaatacattttaagtttagaaaaataaaagcacatcacattaagatataaagtcttaatttatatctttatactagatgaagcaagtctgctttacttatgaaggatggtaccaaaaacatttggataaatgtaaccacccctcttgaccttgttaaacactagattttgatgcttggacatattgctcatgtgaataggagaaaacttcatttcattgataaactctgtttaaatattaagaattggcatttctctccagccaattgtttttaaaatgcacacttaccctgcattgttgctgactgcagttagtccttttactccagttttcagtaaagcatctataagattctctggaattccacatagcccaaaacctatattaagcccaaaaaataaacaatttgtaaagggggtaacaatgttctttcagagaagtgtgtgttattctttttaaaagggaaataaaacaaagcacattattagatctactaagcaaaatacacagatatatctcagcagctaagtaaatggtcatatagctgtatccaaatgttttgcaccattatatcacatatcactgcccagtctttgaaccacaagtataagccaagtgcaaccagtttatatggctactcattcctcagtttgcacttaactatatatctattgttttcctgctttgtaaatcagtttttctacaactttttcaagaatgttaatatgtctgagtagattttgcatagttggaagcctaagcccaaaactgtcatttctttatattttccatgattactcaaattgtattgggtttaaaatgaacattcaatgacttacttgaatgagtggagatcaatgctaaaaataatccttgacattatttatcagaagcaggcagcaagttgggtgtgggtggctcacgcctgtaatcccagcgctttgggaggccaaggtgggcagatgactagaggtcaggagtttgaaaccagactggccaacatggtgaaaccccatctctactaaaaatacaaaaattagccaggagtgatggtgggtgcctgtaatcccagctactcgggaggctaaggcaggagaatggcttgaacccgagaggcagaggttgcagtaaactgagatcgcaccactgcactccagcctgggtgacaaagtgaaactccctcgagagtccaaacaagaagcagcaatagaattggcagtgggggaggtcaatacatgtctacggggtctctgaaggtgtaagcttatgagattaatgcaaacattttaagttaaaaaattgggatctagggatttttttcaaagctattaataaaacctgactactttgaagcttcagtttttcaaaacagaaacacacaaatacacatacacacacacatgcacgcacacagagaaagtaaaatattaagtgctaaaccttgctaaacttttaggaaggagacactaataaaatagatgatattataatatgtacaataaataatgcataataaaataattatcatttttatacatctttgtcattgtgatttgcctgcttcatttaaaaacataaggacattaccataacatgaaaacagtgttagtactcaccaccaaccaaaaccgtggcaccatcagggatgtcttttacagcttctactggatctgtataaaacttggtatggcgatgagcactggtggaaaaggaacaaacacatccctgaaatattaaaaaaaaaaaattgataatcatttggagatacagctttactttgtgtgtgtagcaatttattcaattgatagacaaatgataatttcattatctcctttatatatacacgtttttaattgccaggtaataactgtatataatgtatatatttatacaggtaatacatgtatatatttatggcatacatggtgtttttatatggatagtagaccccccttatccacagtttccctttctgaggtctgtcaccccaggaaagtacggtacaataagatttgagagacagaatgcattcttataacttttattacagtatattgttataactgttctattattagttattgtgactaatgtctcatagtctaatttgtaaattaaaatgaatgatacacatatgtaggaaaaacaacttatatagggtttggtactacccacaggtcaggcatccactggggttttggaacatattccccttggataagggaggatactatatacattgttgaacagctaaatcaagctatttataaatgcacacacttttttatggtaaaaacacttaaaaatctctaagcaattttctagtataaaatatattattaaccatagtcgccatggtgttccgcagatctcttgaatttattcctcctaaataaaattatgtatcctttgaccaacatctcaccaacccctcacccccagcctccataaccaccatttcacctttctgtctgtgatactatccccctcttcaaaagcctggcgctttaagtgactcatacttaaaagtaggatggatattttatccacagattatcactgaagtccccttgtaacagatgtcttctattacataagggaaagttctaactccatcatttgtggccacccaaaagaatgaaagtagaaagaaaagtccatatactggaattcaaattcatagcaatggtgtcatcaagcatcagtttctggtaacccaatcttccattaatcaacaagtatttactgtaaacccaccatgtgtcaagtcctgtactatttattccaacacagttaagtattaagacatgagcactgctctctaagaaattaaagccaatatgaacaaaacacatacctacagagttgggccccaggttcaatcttaaatgtcaaagaatgcctcctagagggacaaaaacaccttacaaaacaactcatcctcctatggggcttaaggtttatggaggctacataaaaggaacaaaccattatctacaaggaaggtaagtctagccttaccactgtgtactatttggtcccaaatgagtcacctagtgaatattcatgagcaatcagttgtaaacttttccctttcccctacttcatccacactatgcacaaaagaaaacaagaaagcagattctgtagcaatcattcatactcaatatcacctctcctttattctcactatacagccaggctaaaaagaaagaataacatctgaatcctgatatactgctaccttaacatgccagttatgagctcacatccactgcctaacagtctcccagacagacacaacctgaagtggtcaaggtgacagcataaatatccatcattcttttcttcccctaaaaatatgccagcacactgctcaaaccctgagaaataagtctaggcagagacagaaagggcttgagccacaaagagttttccctcttttctattcatctgcttctgttttaaacatatattttttaatatattagaaattacaagtgtgatagcctgaataaacaggccaacagaaggatcgtaagataaagttgaggatatctcctagacacacttaaaaagtgcatatatctaatccaaccaattcatttcacaggtcaaatttttgaagcttagaaggatcttgtactttacccaaaactgtattaaagcaagaccagatccaaggttttatttggccttctacctcagggcctttctactacaatatgcttctctccatgttttttgaaacctctcatactccacttctcattttttgatataaaataaatctttgtgagtgttctatttcttcctgtataactctgctgtcattacctccacccaaaagtgaagagtcaggcccttatagctggaaggggaagaaaattaaagagttcatccacagctcaacagtctgtgcagtaagatcaccctaactatttcaatatgctgagaaacacaaatcccacatagagaggaagttggaagaaaactcatttcccctatatacctatagaggctttttacattaaggtatccattccctcaagcatttatcctttgagttacaatccgaatacacttgaagctatttttaaatgtacaattaagttgctattgactatagtcaccctattgtgctatcaaacagaaggtcttattcattctttctaatttttggtacccattaaccctcactacctctcccctgcccacaaataaaagcatataactacaggcttgtcaagaattctatttttttgtttcatctgatagttttcactacagttagaaattaccaaagagcttgccacactctctgcaaaaaaatatacttcaaaagtattttagggaagacatgtttacccagataatcaaaagttaaaagcataaagtgaagatgttttccaggtaatctgagaagggctcaagacaatgaagaacctgcaggtacttgtttttttcattattcatatattcagttaacaatatttgttgacatttgatatctatttactaacaggtcaacttatactacaacagattgtatcctaagaaacccaacatctagtttaggagatagtgtgccataatagatcatgctcttgggatcaaaaaatacccttgcttcaaattccaattctgccacagttgtatgaatctaggaaaattacttaaccactgcatctctttttcatggggggagaaggtattttaagtttacaaaaagatgataattgttttctaggaatgtagtaaggatcaaatgatgttatatacagaagccctgttgcaggactatagaagatatccaggggatactagcttcctttggaaaatgcaaacttttcttcattctccactagggcagtaagatcaatttgtcatttattggagtttagttttaattttaattgtatataaatgtatatatttatgcaggtaacaaatgtatatatttatggcatacatggtgtttttatatgtacagtagacccccccccccaccgcttatccacagtttccctgaggttatgtatgtatataacatattctgatgttatatacagaagccctgtgcctggactatagaagatactcaggggttgttagcttcctttggaaaatgcaaacttttcttcattctctaccagggcagtaagaccaacttgtcatttattggagtttagttttaatttttaaccacctcactctaccctatacacacactccactgattttacaaagaatgtttttaaacacaattcatactgtagcaaattaacccaggtgatctttgttgaaggttttcaaaaagacataggccttagctttaagattactttcacatgaggtgatatttattttgtcaccttacagttaaataaatgacaaggaacagctgatattgtccaagtatcacagtttgagaaacaaaagtggggagaagttatatggagagaagtaaagagatacacgttataaagaaaaggcagtaatatgtgagtggatacactcacagacctgcagagcacggcatcactcccaagaggtagtgatgtgtgtgaaaatactttagctgtccagaagaggaccggtgtctaccaaaggtagaattttcaccttgaactaaacactgccaattatgcacatgtgacaagaataaatctcaaggagctcacagagagttacaacactaggcaattctctacagcagtggtgtgcattgttattgagggaacatacatgttcttctccaatgctggagggatactcagtgctccgaaggagcacagatgaaggagtaattcattctacctggtggactagaaaaccaaagtttgccaggtgttaaatacttgtcaggacagtgattccaaacaagggagccacatgagtaagagttcagcgatatgaaaaggctgtgtggttacagacatgcgggatcaggtctcatggagagaggttcatgaagatgaggctggagaagcagactgaggcagtttgtaaaaagccttacagaccacactgcagagtttcttttttcttttctttttaatttttttatttccataggtttttggggaacaagtagtatttggttacatgagtaagttctttagtgttgatttgtgacttgatcattccatgacgaagggacagcaaagcttttgaaacagatgtcacaactcaaaggaagcctgaattaagaaagtggtatggaaactcattatttctttccttcactcatttgtaccaactatacaaaatactggggctacaaagttaaaatattgaaaataaaacccagacatagcccctgctataatgaaacttacaaactagcaaagatagtagtcattaaataattacaaaattttaaacacaatcatagtatttaattggggagctataaggaagaaacagttgctgagaaagaatgccagggacagcactgaggaacatttcagaaagaggcacacatatgacacttggtgatcaattggaagtgcagcaaggagaagagaagatggttccaggatttccagcttatatactggatggatactggtgctgttaagcacagtgatagaagaacaaaacaaggaatgggaaagccactttatggctagtttgctttggatcagaaagagctttaagcaccaactgacatccaagtgaagttcaccagttgcaccagaaggactgcagctcaggagagtcagaggttggaaagagatttgggaaaagacagggtcaaggatgaatggtgggtaaagtgttagtggtactcttataacctttttcccactaataattttctatagtgaaaatagtattaaatgctccccactgcccctcagtaataatgaagaaaagaagatacctcccaatagtctattttcacctaagtccatgccagataactctgaaaggggcagtcagtccccagaccagcagcatcaacatcacctggaacttatcaatgcaaagtttagggccccacccaggacctattaaattagaaattctgggggtgggtacagcaatctgttttagaaaacctccaggtaatgctgatgcactctcaggtctgcgagacactgggcctgcccattataaaaatgttaaacatttaagaaaataactatctcgttttagctgttagttatgtttagtggaaaaactcaaggtttctgtttgcctggagggttctctcatccgtactttaaacatgtgtagaatatctgatctatgcagagtagtgtgtttgttgagggagactaagtgtaaggcataaatatggtctctgccatcggggaactgtcatctggttgaggagacaatatacacatctgaaaagttaaacaagtagataagtggtacagttcaacagaagcagcaggtgaggatttaaagtgctaaacaataagggctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaacaataagggcactaagagccacaagctaggggaatagtggaaggcaggagttagacctatgataatcaagcctgacagggctaagtttgaactctgtatgaacttttaatgagatatagcagaaccccttatttgcatctcgtccctctaagatgaggtttgctgagcttcggaaatggtttaatgatatactcaagatggaaaagacttgaagtgagtaaattacagttgggcaaatcagtaactgtcaaaagaaggaacgttcctgacctcggcccaagggtatcgctgtgctctggtttgtattagcttcagcaccgctgcaatctcactgaaggtcaagttcccttttaataatgctttatatatccaagtctatctgcagttataaaaatgcttcctaagaggcatttaagagtaaaatggtccagttctgaaccattccctagcacctaccgaaggagctcagtggctcctctgtgttctcagcggtcagggattggatgcaggaaagagcaatggggccaggcaggcacgcttcaggagtaagcaccgtgtgcatggcacgctgtcaagctcagacctattactgaataccaaggaagaggctcccgcgattgagacggcggggataaagccaccctcctggacctggcgctctggtcctgtaattcgctcctagggctccagacaggggtgggcttacaagcgaggacagtgcataaggcaaaaccacaagtcagtccacggtgggaatgcctccggataccactcggtggagagtcggcagtggggcacaaaaaggatttcaaagggctctgaaaaccgaaagcccctaacccggatacgaggggcctcgagagaaaggtttgtcctcccctgcagcccaggcgcgggccagggacacacctcggatggtttcccagcttggccggcaagacgccctggcgagcgctccagtctacggggcagcagagccaaatagggaggagaggatgggagcggcattccacacccgccgcacccggcatccagccccggtgaactcgagcagagccatggctaacccagcctcaggttctgggcctctagaggttcctctgcccagagatccaacatcgggggcgcaaacctacccgctgttgcctcactcctaaacctccatatactggcgccctcctccccccgttcagaccctcagagtccctatccaagggcgggtgccaggagggaagccgacgagcgccaaagggctcgggagcgctgccaggagtcctcccgccccttctcagcctctccgcgcgcttctttatcgcgtctcgctccatcagggaagcgactgcagaaccaagcaaaggcggtcatccgaggggccggcgaggccaggaacgcgtcgccgcgtgtccgtgaccagggcaccgcgccacggatgccagatcccaggctggagagagcgggtaggggcagagaagaaaacgcgggcaccactcagggtttggtccacgttcttcctgcccatggccttcctcttcccccgcactttaccttgtaccaggttgccccagatccgcgggcagaggcgcagagccgaagcccggaggagaggagtttgagagccgccatcttcgggcggtgaggcaggaggaggctgcgggttggagcgcgcgtttgagcgtcggtgcgcgactgcgaaggaaacccgggcgggctggaggctcgacagcgcgtcgatgacgtcctcccggcctttcgagccgcacgccaccggcgcgctgctggctgctgcttttaaaagaagtgaggctgggcggggccccggcggggagaagaggctctgtgcagccggggcggatcgcggggaagttcctctcagcgcctcaggtgtctgggcgtgtgcagctgtgttggcgcacacttgccgctacagcccttctgtcagccctttagcttcgatggggcgctggtggccgcctccccctaggttgtggatgagtcttggcctagggttcagggccctccggccgcgggaggatctcccgccaagcttgttgcttttccaagttagtgcctggcgtgtgtgtgggctgcataggggcacccctcgaggcccccttctcttctcccgcctggactgcgttcacgtttctaacatttctcagccccttctccccacatctggccttggcttacatagagtaagtttgctgtgagcacttgcctcgaactgtcggtcaagaggtgtgagcaacaaggcttgcagaggaacaagattaagactggacctctgtgacctgagtttagcacaccttttcttccccatcatccaagtttgcgaatttcgggctctttctcgcactggagtcccagcaaccccagagattactaaagatgcaaccataaaagcagtatattgctttaaccttaggcaagttagataacttccctaagcctcagtgtcctcatctgcaaattaggattgcttgtgatacaacgtcataacgtttctatgagttaattcatgcaaagtttatggccttattatgaggagtcaataaatgttaggcattattataagtttattccattgtagcagttcattgacatggcacgtacatattcgccaagccttgtcttttgaccaactccttgaggacatgagccacgactgatttctccagaactgtctttgcacttagcagagtggaaagaccaagtggaagctcaatagcattttatttgattaaggcctgaccaagttctgagaatgtgatgttagttttgaaccaaagcaaagcacacaaaaattaaatgagatcttagcttccttagcaaatacagtaaggtaatgaacagtgaagatgcagttcaaagtttgtccataaaatcatttgccctttcatggtattcttttaactctgaacttttttttttcctgtaaatattataattttagtcaaaatcagttaaggagtaagataccaagttagactattcaattacactggagaaattaacttattgctagttggtatttcaacacattttaagaagttggattggggggaaattcaagtactgtaactaaagtcccataactagtgataatttagcatatagcagctgttgtacctttaacttacacaatgtgaaaaaaactagcattccaattgagtctgcttttccacttttgcccattgcgattgggtctgcttttccacttttgcccttccacagggcacatgaaatggaaaaactgcattggcaactttgccggtggtcatatgactgactcttggctggtctcactttgttgctcttggctgaggaagacacattttaaatgttgcatgctatgtgactaagtctcctgagaaaatcaccctaattactgtatggtcaaaacacactgtactgtatttttgatgactgtgacttcattttatactttttaaataatgtgcaagtctcttcaacttgaataaattagattacaaattacaaaaaaagttcttatgtgctgatttcacttctagttacacaaaggcacttcaattttaattggtgtgcaaaattttacttcttttaaatatctgaacttttccgaactagtaaggatatttcccacttgctttgaaaggcagtttctggcaaatatgttatattctggaaacctttctttgtggaatcttacagtttaacttccacacttttaaaaactgggagaattggattcaaagcctttaaacaaaaggtctgattccagtcatgcaatgaggaaagatttttttgtttgtttttttgtatttttttttgtttttttgtattatgttatgatacgtatgtgtatgtgtgggtgtgggtgtacatacaccaagtcatgtgctacataacattttggtcaataatggacagcatatatgatggtggtcccataagattataataacatattttactgtagcttttttatgtttagaaatgtttagccatgtgcagtggcccacgcctgcaatcccagcactttgggtggccaaggcaagtggatcgcttgagcccaggagttcgagaccagcctaggcaacatggtgaaaccccgtctctacaaaaacagacaaacaaaaaaattagctggtgtggtggagcacacctgtagccagctactggggtggggtgggcagtggggactgagtaaggaggattgcttgagcctgggaggcagaggttgcagtgagccgagattgctcctctgcatgccagagcaagactctgtctcaaaataaaagaaagaacagaaaaatttaaatacacaaataactaccattatgttacaattgcctactaaatattgtacagtaacatgctgtacaagtttgtagcctaggagcataagccataccatatagcctaggtgtgtagtaggttagaccatccaggtttatgtcagtatattctgtattagcacaatgacaaaatagcctagcatctcatttctcagaacctgtctttgtcattaagcaaggcatgactgtgtggcaccattttatcagatacatgcaggtaatgtgtcagagtttattagattgtaaattattctctgttttaaggagtttcattttaattctcctaaaatatgatgcattagcatatctcattagtgcaagatatgacatcctattctcacagttgatggtgtactccccaggatgataaccaggggcatctgaagacttgtttttcaaatgttgattaactggtttcactagaaatagcagtttttaagtaggtcatttgagtcacttataaaagtgcatgcgtgcttcattttatcacaatagtcctttaatatatggagaacatagtccttcaaacaatttgcttctagtaggtttgaaggacataaatctgaaatttcacataaatctgtaaatctaagtattgttttatagtgcaagacacccattaatttgcatattttgcaagcttattttcatagatcctttaaaggagtcccttgtattaactagtgtgtatttaatatttgttcaatgattaaagaaaaaatagattgatttttataaagtgtagttttctcagaaaaaaagtaaaataaatgcatgagatacttggagagggcttaaggcctggaatgaaattgaaaattatgataagatactaaggaaacctaaaagagtaaaatgcaccagagtgatcttgtatacattcaagactgatcactttatttctgcttaaaacctgtcattggttttccccactgcctttgagatccaaagttcatacttaataacatgacatagaagaggatcatctcttctggtcttcctttcccccacacgtctgctttatatttcaaactatatgtgcctcttgatttttacacagtgaatttgcacaacctcagaatcaagtgttgacagcaaaataataaagagcaggaattctgtggttaggcttctagggttcaagtctcagctctgcagtctctagctatacggccttctgtggtgcagtagttaagcagggcttacagaatgtcaagatgtaaggtaatctctagatcaatatttgcattattcaggtgttaaaagattatacattattaattatttcccagatgctatcttagtccattcttgctgctacaacaaaatatcttaggctgggtaagttacaagaagaaatgtatttctcacagttctggaggctggaaagtccaagatcaaggcaccagcatattgaatatgttaaattaaattaaatttggccaaaagctgcttccatactttggaattctgcatagcaaactgcacctaagttagtgtttaaataaaccttacttaagagtatgttcttgtaacagatagctgagtctcagctaattacagcagccaggtttcatccaatcacatactaccaactaataagaccatgtccacataaggcaaatgccacattgcattgtgcccaaataaggcaaatgctgggccataatcaatcaagctgtttctgtacctcaattcctctttctgcctataaatactgcctgctcacattgctgagtggggctttctgaacctctactggttcagagtgctgcctgattcatgaattgttctttgctcaaataaactctgctaaagttaatttgtctaaagtttttcttttaacaagggtctgatgagagcctgttcctcatagattataccttctctgtgtcctcacataatggaaggggcagaagacataaacagttcccttgtacctcttctataagggcactagtcacattcatgagctctcatgatttaatcactctgaaaagccccatatcttaatactatcacactggcaattaagtgtcaacatatgaatttggggaggacacattcaaaccacagcaggtgctttggttactgaaaacataaagtaaactgaaaaatttacttaataaactgaaaaaaataaggcaagattcaaaccctggaccatatgttattaaaagctgctatttctttatacctccctctttctgagatatctttgaatcttaccccaactctccagtttcactcattctgcactacttcagggcctcagtttcagtttctctcatctgaattatttcagtttccttccaaatgaatttccattctccctcaatttaaacatacttaaaattattatttcaaatacaggatctggtcttctcacatctttttctaaaatatttcaagaaatgctcaaaggctgcaagtgaagtccaacattcaattataggcaagattttgtttaatctagcctcaacaaatcatgtggccttaagggctctgcagaggtacttcaggggctatgcaaacattatattttgaaattaaattttagattacatttttactattctatcaacactaacaaaaggagcatgcacactcaattgtgatctatctttgatttaaaagtattaaaaattaccagattgtggctgggcatggtggctcacacctgtaatcccagcacattgggaagcaaaggtgggcagatcacctgaggttaggagttccagaccagcctggccaacatggtgaaaccccatctctactaaaaataaaaaattagcctggcatatggcacatgtactccaagctactctggagtctgaggcaggagaatcacttgaacctgggagatgaaggttgcagcgagctgagattgcaccatgtactccagcctgggtgacagagcgagattccatctcaaaaaaaaaaacaaaaaacaaaaaaaaaaaaacagaccagattgtgcagttgggagacaaaccttagattaaaggttcctcatcatcaaatttcctatatttgaatatataaaatatgtcattgataaagatgtttgtagctctgtatttatctttttatcatttagacctctgcattttgactcacttaaatttatataagtatataatactttgaggctctggtcagagacatgtactgcctagaattatttcttatcacagcattgtagttgttcaaaaagagcatataaaacacttcatgataatattgtactataaatagttttagagattattttccattttggctacatcttgtctgacatttacatatgtgaacaagaggtaattgacattattagttattgaccactgaagcaaacatttcctgctacttttctttcaagcttctgatctactttaattgaagcatatactgaaattctgggacaagctgcagtgtgaatcagaactttcttattattgtgcagccaaacagaaataaaataagcaaaatatcagatataactccatggctgcaatatttagcttctccgaagagcttcattattctcattttttccatgtataacaggaaaatatttcacaattaaaatgataaaatgcatttaaactgtaaagtaccacttttacacattgtatatgttgggttctaaatacaattttatttgaaagggtgactcatattaaatatgtttgaaaattatggctttagctaaattcgactactttctgctccctgcacataccaagcaccttctgacagggagcctttgctaaagcctttttttctgtgccagctgagcaaactcctactcctctttcaagactcagatcaaatgtcactcctctgtgtaccttgactgttcacactccgaattccacctcttaaaaaactatattcttttactttgtgctctcagggcccttggtcacctggattatgagcttattaagttttgttcatttttgtatctatagtgtcctaggatttcttttaagcatagagcagttcaacaaatatcagttgtgttgacttgacttgggtaacccttttttgctgccttaatacaagccatgaacttaacctgtgtctctcagctcagctctttaaattgaatactttctttctaatcatgatgtgatagtagtaattatttacattttcattgtcttttacagcttactttgtgctcaccatcatcctttggcctttcttctctaacacagttcctgtatccagcctcatgctttgctgtgcctgtaactgtcttctccccacagataacctgtcattgaagtacatgaagaaaatagtcaaatagtgagttacaaattgtacttccctctttcaaatggtccctgtttccctcattattattttcttcccttgtgaatattccatttggttaaatctttttcacaataaagtaacccaaaccaagtatgatattttggctacatgatcccgctgtttatgttcccagacaaccagtaacacctgcaataatacatttcaaaaaaaatactgccaagagattgtgacaccctggctcagtagaatacatcagggtcacttataaatatccaaccacagagaaatgattcattacattatagtgcatcatcttgaaaaactattatgccactattaaaaagtaaaaatttcaaattgtatgtggaaatggttaggataagggtaaaagtcagaattcaaattgtattatataaggattacaaccatgtattatatgtttttgcaaaataaatgaaaagaccatctaaaagtgaggaaaaaatcaatacaatgagggcaagaatttaggtacttttatttaaactattgtacagcttttatttaacttttaaaagcactggacatatagttttagtatgagagttctaaatatacatgtcagatgtatatttggttgcttgaaagaggtatttgcacaccaatgttcattgcactattcacaatagtcagaatgtggaaacaacctaaatgttgataaatggatgaatagataaagaaaatgtggtatatacatacaacagaatactgtttagccttaaaacagaagaaaatcttgccatgtgtgacaacatggatgagcattgaggatattatgctaattgaaataagctagtcacagaggaacaaatactgtatgattccaataacaaggtatccaggagttctagtcaaactcctagaaacagagcagaatggtggttgtcaggggctatagggaggaggaactcgggagttcctatacagatttcagttacagaaggtgagtaagttctagagacctatacagcactatgcctgtagttagtaatactgtatcgtatagttaaaaacatgttaagaggttagatcccatgtttagtgttcttaccacaataatatatatattatttggttgccaacttttgccttctctagtctgaacctgtgaacccaggggaatgtttcaggataatagatgctgtgtttcacatcacatactaatatttcctttggctgccaattcagaaaatggaataacaggataatctttcaatatgcacttctctgtaggcgaatgagggtggtagccttcagtgaaataaagccattaagttggaaaaccaaagaatcaacaatatagaaatccctcctcacttgtaaatcattaatgaacattaaccatttactagtggctttgaactgtgacttgaaacaccgctactctctagccagatctatatctatgggttttctatctatctcagatttactctacagtcatttgttgatgtctaggaaaaacctcctgagtgttaaaatgataaaactgattatttcactggctactcctaaaacataatcagtacaaaagtattgaactgctattcactggaatgcagccaggaaagtactgggagaaaagtaagtgctatggtctgaatgtttatgtttccctttcaaaattcacatgttaaaatcctcactcctaaagcaatggtgttaggaaatgaggcctttgtaaggtgattagatcatgggagtggagttctcatgaatgggatcagtgcctttatctgtgtctttatcaccaaatctgctagtgccttgatcttgggctccccagcctccagaattgtgagaaataaaattgctgctgttcataacagcacactactgagtttatggtattttattacagtaaccaaaacagactaagataacaagggtcacagaatttgtaatgagcttttaatgaccagatgtggaagaaaggcaaagcaaattttaacagcactcagacttcattccccgttttcaataataaacttggatgaaaaattggttttatatcaatatcttatgacaattatgaatcttcactatttttattctctgcacgttttagagcagtgatgtaaaaacttttgtttgtgtcatcaatgtaaatgtatgtggaagttgtatcctacacgtacatatatatatgtaaagtatgtatatgtttattttttataaattaaatacatttactacagtacattttaaacacaattttgaaagattagttaaaaacaaatataaacagaccttgttttatttttttccagtgtgcccatgggttttcctgagtacttcctacagggtatgcagtccactctgaagatcacagcctaggaccataagtatgcagtgaatatcttaaagacaataaagctctatccacagaattctgaggatggagctgatgctggaaaatcagtattctcttaggcaatgttacatcatctccttataactatgctacatgctctcagtattatttatatcatctttccttcccttccacccaacagtctcatttcaagagatttaacctaaaaagatacaagaacaggtgcacatatatatatggacaaggttatgcatcacagcaatttttaaaacagcaacaaaaataatagcaatatggttaaatgtgtcaatcatgtattggcctataaaagtatgctatttcattagtctatagactaattgggctacagactaaccattaaatgctttccttcatgtggcactatactaagtgttaggaattcaattgtgaataagacaacagacatggtcccagatctccgggagtttatgtcttatgaggagatgaagactgaacaaggatacacgcattcttatgcagggtattgtcaatgagaaatacagagtgttaagaatctgtgtgacaggctgacccaagttgaggaggggtggtcaaggaagacttactgtaggaatcatctttaaattagaatcttaagaatcagaagaaatactaggtgaaaggagagtgggaaacattgcagttaggacaatgtatacaaatcattgacattgaaaaaaagtatggtgggtataagaaataaaatccagaatgagtaatggtggacagggtacaggttttgtaggactttgtaaattatgttaaggatctgttgacaaaaagagtcaaactctaaaatatttgaagataataattttgagccaaatatgagtgaccaatggcccatgacacagtgctcaggagatcctgagaacatgtgcccaaggaggtcaggctacagctggactttatacattttagggagacataagatattagtcaatacataaaagatgtacataggtttggtccagaaagaccaaaagtgggggtttccaggtcatcagtgaattcaaagatctgattggcacttggttattgtctaaaaactttgaaccaatagaaaggaatgtctgggtcttcaagattaggggctgtggagaccaaggttttatcatgcagacaaagtctccaggtagcaggcctctgagataatagattgtaaatatttcttaccagacttaaagaatctgttctatgagtaattccaaaagggtacaggatataatgatgcatgtctggctctcccttcatatcatggcctgaactagttttttcaggttaactttggaatgcccttggctgagaggaaggatccattcagatgactgcatggcttagaattttatttttggtttacattctctcccttctggccaatatttgccagatgcaacatcagtggccaccaaacttttattttgtcccatagcattgccagggtggcatggctgcctgccccaggtccatcctgcccctcagttgaaccccaatggccaagagacttagtgccaaaagacttatagctagattaaatgttctaggctagacaggaatggacgtggacaggcatttattaactcttacattttttttaagtaatataacagcgaacaaacaaaaagcctaaagcaaggatacaaaattgacttacctttaacttctatgcattgaactattgtaatctcagctttagttacagacttgtagcaattagcataaaaacgtagcataataaaacataagcgttggtaaaaccttttaagctaaggaatttagggattttgttatgtcacaatgctttttgcagtcttttagtaatttgttctaagatggctaataaaattttttaaataaatatatacatatatatatatgcatgaatcacacaactgggagtattatacccaggagactttgtcatgaggtatctttatagcctttcagtaataattttattttaattctataggaagcagtaaattgtttatagttgggatggatgaaaaggtgccacatagtagctcagaaagcaaagttccttattttccagctgtttaggcatttgtgtacccatccttgatttgcagggtctgaacaaattctattcctcaaaaccggcccttaaaatctcacatgcccaccacttttgcagtagtttctggacctggagggagagttcttgtatagttttagcagcaggagatttgtagtgaaaaacagattgggcccagtgggattccaaatgagtgtaattcaaaggctttgtcaaatcatctctggtcttcaaaataccacaattctggttttcttggaaggagtaaagctgtgagagataaataacattaataatttgacaattaaaaagagaatgtatgtgtcagaacagaaaaagtgacctattcgattagggtgctaacaaaaaacatggagaaaaattataacctggttcatctttagaggattattatagctaaggaataactcatgatttaatctgcaatcaaaagaaaagtcagggctacaatctagtaacaggggttatagttttcctttaaaataatttttctttccagccctccttttctactaaggaaaagttatagtaagaccaatttgtgtgtaaaataagttttaggcttattacacttggcctgacttttcgcataaagtgcaggaggaattgattggtcatataggctcttatcaagttggctttgctggaaccttacctaaaaatacttattctagccaaaaccttggtaaaataactagtgtctccaattgtcttattttaaaagaaaatactcttactaaatttatgcaaataactattgtcataaaatcacaagcagtgtttaaattttggagaactcatagagagaaaggtacatttgttcacagaaacatactttacccaattgctttaaactataactaactcactaaataccacatgttctcacttataagtgggagctgaataatgataatgttagtgacaatgagccacacgggtctagagcaacctcaattcttgccttttcagaagaaagaattctaccgaggaggcataaggcagaaggagagatcaaggcaagttttagagcacgaatgaaagttgactaaaaagctttagagcagggacaaaagaaagtacacttgggagagggccaagccagcaacatgaagaacaggtgcgtggtttgaccttttgacttggggttttatacgatggcatgcttctggggtcttgcatcccttctcccctgattcttcccttggggtgggctgtctgcatgctcagtggcctgccaaaacttgggaggtgagcatgcagagtgtatttactggaattgtttgcatgttctcttgaggcattattcccttaccagtgaaatgtccctagaaattcatatagaatgtcatataccagttaagctccacaatttttgcctcttactgtgcatgcttgagctcactagcccaactactgagatcttatcaggaagctgctgatggccagtttcaggcgtttttatctattgggagactgcctttccctggccctggctgtgaccaattactattgttgagacagagtttaataacctcctgaccatcacctgatagttgccagacaatcctggtggtgcgggggagctcgcctagcctgctcatgtcagactagctacttactataacaagaacacatggacacatagagggaagcaacacacactggggcctatcaaagggtggagagtgagaggagggagatgatcaggaaaaataactaatgggtactaggctgggtgatgaaataatctgtataacaaacacccatgagacaaatttccctatgtaacaaacctgcacatgtacccctgaacttaaaatgaaagttaaaaaaaaaattttactcatgtctgtaatcccagcactttgggaggccgaggcgggcagatcacttgagctcaagagttcaagaccaccctggaaaacatggcaaaaccctttctttacaaaaaaatacaaaaattcgccagatgcagtggtgtgggcctgtattcctggctacttgggaggctgaggtgggagaattgcttgagcctgggaggcagaggttgcagtgagccgggattgtgccactgcactccagcctgaagtgccagaatctgtctcaaaaaatttataagtaaataaaaatacatgactcaaaagaaaaagatttccttgattcttatttaaccagagctgcagccttccaaagaaaatatctctttggtcacctgggcactgccattcacaagccaagcagctttacacgtctttagttttatagtactagatggggaaacatcccccagtcagatacaatacccattttcataagatgtttaggcaaaggagtcacaaccagtttacataaaggatgtttaaacatctcaaatttcataatttcataatcctttcaacctttacatttttatgttctggtcccaggaaattttcttctctactgccagatcattttaccttttctggtgaaaaaaatttgggctcctagcagggagttgagccaaggaactcaggcccttttttgcagtctatatctatcttaatttgcctcaacattgccccaggcaatgtcagctttctcattataaccttcgccttttgatttttttttaaatttcttcaatccagggcaaatgcagacaactagtttgaggtcccataaatgttggggaaccagcaggggttccccattggtccacccaacctttgattgttattaaccccatccatttttattttattaatttcatttcttaataatcatctaaatctttagatgattattaagtcaaaggattcatcccttctgggacgtccccttctgggactagtcctttgactccctttctcctgtctccttttttgttttgttttgttaattatcctaatgttttattagcatctgtaagaatttgataaggcttctcaaacagttgtttgattcagtagtagtaatgtcacccacggtgcccatgtagaaggggccctcttaaccccagcatttatcatgacctgggtaataggcatatgaagtgggagaatatcccactcatcataaagccagtcccacacggcttgaatatgaagcatataagctgcttcatctggggtgttccacttggcaatttatagggatagttaggaattccccttctcagggtaaacagaaattaaggtggtgtttattctgtccaataggctggtcattctctcaggaataatctcttgtgcacctggatcatatgtactcatcagcaattgtttaatagtgagctgtgggtcatgcatcaacccaaacatgctcttttattctgttgcagttaaaactaaagatactgtccataaagtagtatttttacagtccattatagtaaaggtttctcaggaagctgaggataacaatctacaaaatgaaacaattcctttgcattatacactatggttttaatagttacttggtttttgcccttttcacacattgattatctttttagtaactacaggtctcagaggtaacttttgttaccctggcttaatttttccttatgtgggtagctttgaggctggtggcctgagctgagacagactctgatctgagcttcctccagccttagggcccaacccagcactctcttactttcattttagctattacagataacaataaataagagattgaatgtttttttttttttaattagttttcatttccttatgcattcagtaaactaactccctgggagtatgagtataatccatctctaaattccattgggaacttttactcttttgtaattgaatgcagcccagctgcagctccttaagatgtgtgaccatgtggctacccaagtgtcagggtttcttattccccacctttcaatttttctctttatccatttagttttatttatataatttttttctttattttaaagtgacagcctctaaactagaaaaaatacatttcttttagcaaaaatcacatccttgtgtttttatgaacttcatcaaaaacacttttaactcatccgctattttaactcttagtataactcaaattcccagtggaaaaaaattgaggtaacttaatttaacatgactctaagatttcaaaccactggagagaattttgagattaaatttatcaaattaatcttttcaagtataactatagtcatacaaactaaaagtcatcagaggtagattgcttttattagtctgataagcatttacttttcttcaagccaattgattagggctctcatagaatttgatagtgaagtatcacttccgcatgacacatataaacatgtagacataaggcagatcctatgagatttttcattttcctgtttttaaaaattctcacccttactttagactactaattttttaaaaaaattaaaaacaaacattgaagaagagaattaccaccacaggccttctcaaaagggagctgaagcagcagtatacagcagaagttaaactgaaatatcaatatgaagaatttcaaaaagaaacagattatatagtttaaaacttaaaatcttcttgtattatgagtaagtcaatttcaataaaatattgttctaaccaatcctttagttttgtattagtgtatttttaatatcaaagttgagtttccagaaagacttaaaatttccctttattatagccaacttaattatataactttttaaaataaattttttaactaacctattaaaatgtacacagaccatttacaacatgtttggactttctggtttatcctaaaaacccctctttctttaacaactagtcattttattttaggataaaaatttatcatacaagattctttctcatagccttttctaccaaaaatacttctttatatttataagtttctttacatccatctcctagttccttctaccttgttttatatataacctttaaatagtttttgaattagataaaaagtatttacattttaataagaacactgttttagaaaaatatttttctataatttttaattgaaaattacccaaacatttaatgaatatttattatttaaaataactttagattctaaatttgtatgacaagtttgtttgcaagcatttattccattacatttacccaattatttatttttaatagcttacctagattattcatgaaaactgtgatagtcatcatttagtgttatttccctgttaaccatttttatagcctatgaatttcaggtgtttacctatgtgagaaacttaaggttaaatatatgggtattttaccaataacttaggatttagctattttcattaaaccaacaatattaaaagtctcctatatcaaaaaatacacaagcaaagatcattctgttttgagctgggtttatacttttttaattcatttggcaagttttgacaccttatagtatctgtcagggtacatatgaaactgcttaatcaataaatgcaaacaaaaatgctgacaattcttaagacatctctaatattactttaccaataattttaaagccaggttatttattaaagattttagttaagtcacatgaacttaaaaaacatttgggcttattattcacttaatttatgactactccttaactttaagccaatttggtaccttgtggtaacaacacataaaatacagtatgtaaacataaatacatacataggcactcataaaaagatcatatagcttttacttcagaactccagccatgagatgctaatacaaactcatcagtttaaaaaaaaagtgattggatccaaacagtcgtttttatctcaatagaagagtaacagcagaaaagaaaatagagaacttaggaactctatagttagttgaaggtcagcctctggactccagattttcccttgatgtaatttgtccatgagtttaaagtgtgcacagcagaccatgatatgtacagagctagaaaaactggcatgccctggaacctttccattttacacaaacacttgcaagtagaggtgccatagaaccattgaggtgcctgaaagggggtcgttctcattatctttcttcattcttagattttctctttcttacctttttttccctaaaagaagtatctgagttgtggcttagggtttagtgtggcggatcaatgtgtgctgattgtgggcaggattccagtgtttcaccactgaatcatttttgccctcttacatatttcagtttctctctcttgaggtctagcacctttgagatggtccaaaacacatagtgatcaggtcttacatgtgtttcctagataaggctttttgaactaagtttttggggaggttctctgtagggccaccatatgtcatgggggtcaatgccccagatactcccattcagcctgtggtcacccaggggtgcctttccgctgagaggagcaaaatgctccttttcttcagagctgaggagctcagtgtcttatttatctgtgaaaataacacttcagtttctcatgccaatgcacagacaggtcaactgagtttaatttggggagaaaaaacaatggagaagaccctttagaatgcaccttcaaactggaaaccaagtggggggtctcaaaagggggtcattctccttatctttagaaaagggcaattaagaaatccctttagaatgtacctctaaactagaaattaggatcttacacaacaacttccttggggaaaataaaacccagctcagaataaaccaaggaccatcaaccagagagaggtccagggctcaggaggatgtacctgttccactggagaagattaaagtcaggacttcgaatgaaatttgctttcttctttgcacatttctgaatgattttattctgtgtacaaatcattttacaggggcaaaatatattttctataaatgtttacctctatttaaatccttttaaaatggcaggaatatgtctttttgtgcctttctaatgccctctgacctcttacctagtatttaggcttacctaagcaggccaacttttcaggtgagaaagtagaatcaatttgacaaaaaaaagtgcttctgaagacgtttgtgctaagacagtagtctaatagtttaggtcatgcttagctttacatcctctaaactaaagtttgggaagacaaacattctttcttgccagatcacttataagtaaatgcgtgtacccatcaaatcattgaggtataaagaaacaagataccctccgtctattaccctgctggatattatcatctaatccagaggtcaacaagatttttctgcaaaggaccagatagcaaatatttgtactattatgtgccatacagtctctgtctcaagtattcaactctgcctttgtaggacaaaaataaccataaattatatgttacaaattatgcaaggttgtgttcttagaaaattttatttacaaaaacagtttggctggattttgtcagcaggccatagtttaccacacttaaattataatccatcaaaataaacttttttagaatgtggaatattaaggttcagtctctgcataaaaatcaacaaccagaggagagacttgtgcacaacagtatgaggatctcatggacccactccctagggaaatgggttaaaattattttttgaaagactcaactgtatagagtttctgaaaatggcctaaaagacatgtagcaaataagaaatgtttattccagaaaatctgtaaaaatctggcagagcaaaaccaaacactgacattggcatttgcagccagagaaagtgaggcatttatttcaggactccaagcacggagaatcaggtaggatgcttaagaccagaattcctcagtggcctacatgcaggggttttaaaggcaaggaggcagagttacaggcaaagccataactcaatacatggaggctatacatctatttggtctaaagaggtggggcatcttgcagcaaggggtcacacgttattgggagatttaaagattctcggatttgtgattggttaaagaagcgaaggtttgtctaaaaacttgaggtcagcagaaaggaatattatgctctggactttgggcatgactgtccaggatccgcaagaagaagtttagaacaaagaacagtgctctaagttcagtcttcagttctcacttatctgaagtctgtatgccaacagatagcattttccattttgtggaggtctaggtttctgaaaaacaattcaggaacatatgttaaggtgttatctttagtttctatagggaagcaaacattttgtgactctaatttccttcactgttgttttaagctaccttcttgtttatcaagttgctcatttactactcaaggctagctaggtccttggaattttccttgaaggaactcaagattttcctttattaccatgcttatgggggcgtggaaggcccctaaaaagggtctttgctccatttcaggttcattgatgataaaagctgtaaaccaaaaataaaattttaagtcccacaactaacttaatggacctcccttccaactaaggggattccaaggaaacatgaaaaactattaatagttgaggccaagatggcaagagagggagtcagacatgcttcattataccctctccctttgggagtttagacacaactgaacagcgttagcattaaaaatagagatcctaagactgacagagcagactctttgtagcaatgtgttaccaactcaaacctgattgtggtataacatcatatgatagataagaggccctaaaagaaataaaagtattttactccaaaatgtatttctttttttgtttttttctttttcttttgctctgccaaccaggctggagtgcagtggcacgatcttggctcactctaacctctccctcccaggttcaagcaattctcatgcctcagcttcccaagtagctggaattacaggcccataccaccacgaatggctaatttttgtatttttagtagagatggggtttcaccatgttggtcaggctggtctcaaactcctgacctcaagtgatctgcccacctcagcctcccaaagtgctgggattacaggcatgccaccacacctagccccaaaatacgtttctttaacatattttggaatagtcctgcaagtctgcctcatgtggggaaaacatacattctatagaaaattcccttccctttccaggtattttcctgatctacaagtgatttaacaaggagtctgaaaacttttaaggcccaattagagacatttaccatctattccctctgaagcccagtacccggaagctttatctacataacaagaaccttggcttctataacctcctttatcttaaccacaagcatttctttctgctgacttcaactctataggcaaagcttaactctttcaaccaattgtcaatcaagaaaccttcaaatccacctatcacctggaagccacccccatcccttggagatgtcctgcctttatgggctgaaccaatgtattctttacatatattagtttatgtctttgcctgtaacttctgtctccctaaaatgtataaaatcaaactgtaactcagtcaccttgggcacatgttctcaggaccagaggtagtgttatgactcagaataaacctcatcaaatatttttcagagtttgaccttctctgtcaacaaagcaaaaggcaactggaaggtgattagtagtttcattggagatataaggtaaactgtaggtctgctagtttgttggagagaaccagaggaagaggcagctgtggggagatcacaaggggtcagaataaatctcaataactgacgacaggaactattccttcaaaggagcccctttagattgatttggtctgtggagctatttatgccctcaaggcattgctggaaacaacagaacactaactagaagttactagtgcttgatagttaagatgtggtcagggaaagacataatcaaaaagtgacctaaccacagcaactgtcatctaaaagtgactctgaaagtatcacaaaggctgggccctgatgggcatcagaggcttcacactggggcttgggggttgtggggatggatataaattctgttaaaacaatgctgctggtcactaagcaaatagcaataacaaagtatgggcagggggtgagaacagcactcagagttgctacagtttattacctaaaatgttgagttttcaacaaaaaaattatgagacatgcaaagacacagaaaattatgatgcttatagcaggaaaaaaaaatcaggcaacaaaactgcctgtgagagtaaccagatgtgagatttcaatagtagctattataaatatgttcaaacaactaaaggaaatcatgatttaaaaagtaacatgagatgaccatgtcacatcaaacagaggttacaaataaatagaaacaggccaagtgcagtggcccatgactataatctcccagcacttggagatgccaaggcaggaggattgcttgagcccagttgttcaaaaccagcctgggcaacaaagtgagaccctatctctacaaaaattttaaaaattagccagacatggtggcatgcatctgtagtcccagctactcaggaggctgagggaggaggatcacttgagccagggaggttgaggctgcagtgtgctatgatctcaccactgctttctagcatgggtgacagagcaagaccttgcctctagggaaataaaaacagaaatagaaataataaaagagaacccaatgaaaataatggaattttcaataaagtataatttacatgaaaaattcatacaggggctcaacagtagatttcaactgatagaagaaagaatttacaaactcaagcatatatcaatagattctacaatccaaaaaatagaaagaaaaataaaccaggaagaatgaacagagccacagagaaatgtgaaaaacatagggcaatgacgtatgtatagtggaggtactagaaagagaagagagagaaaaaggagcaaaaaatattcaaagaaacaagggctgaagctgggcgtggtggctcacacctgtaatcccagcatgttgggagcccaaggtgggcagatcacttgaggccaggagttcaagaccagcctggccaacctggtgaaacccaatctctactaaaaatacaaaaactaattgtgcatggtggcatacgcctgtaattccagctacttgggaggctgaggcacgagagtcgcttgagcctgggaggctgagattgcagtgagccaagatcacacccattgtactccagcctggaggacagagtgaaaatgtctcaaaaaaaaaaaaaaaaggaaaggaaaggaaatgaaggggaggggaagggaggggaaggaggaagggaagggaagggaggtgaaagagagagagagagagaaaaggaaaagaaaagaaaacaaaagaaagaaaaggttgaacactgaagaaatttatttattgaaaggcaatctggacaaccaggaagctcaataactctaagcaggaatagtgtaaagaaatccacacaaagacacatcgtgataaaaataatgaaagtcaaagatcaagagacaatctgcaaaatatcaagagaaaaatgacttgtcacttacaagggaagcttagtgatattaagagcttacttgtcagcagaaatagtggaaaacataagatagtggtataacatattcaaagtattcaaaaaacaaggtcaatcatgaatcctacacccaacaaagctgtctttcaaaaatgaaagcaaaataaagacagaccttccccaagaaacaaaactgaaaatgtttactgttgtcagacttgctatataagaaataataaagggagttcttcaggctggaactaaattacccagacagtaattgtcagaaaatatttgtaaaacatacctctcataaggtacttgtatctagaatatataaagaactattataagttggttattaaaatattaataacctaatttaaagtgggcaaaagatctgaatggacatttttccgaagaagatatgtaaatgaccaatgagcacatacaaagatattcaacataattattcatcagggaaattcacatcaaaaccaatgagataccacttcatgtggacaagaatggcttgtgagaatggccactaatcaaaaagtgacataataacaaatgttggcaaggatgtggagaaattagaaccttcatagactgctggtggggatgcagaatgacgtagccactttgaaaaacagtctgtcagtacctcaaaaattaaacatagagttgccatatggcatgcaattcaactggtatgtatatatccaacaaaagtgaaaacatgtgtcttcacaaaaatgtgtatgggaatgtttctagcagcattattcataataactaaaggtgaaagcaactcaaatgcccatcagctggtgactagatgaacaaaacatggtatatccaaacaatggaatctaattcagccacaaaaagaaatgcagtaccaatatgaggtacaaaatagatgaacttcaaaaacattatactaaatgaaaaaagcctgccacaaatggccatttattatatgattccatttacatgaaatgcagcgcaaatacagaccatttcctttattgtggaaagttgtattggacagagctgttctgcctgatagtaagggaaaaggtggtttcttttaggcttaaatagtttctaaaattaaatcttgtaagagctggcatcaaaccagtagacattaaattcttaggcaagaagctaggatatagattttttggtacagattagagacagatctgcataactgaaaaatcaactgaggagatgggtatgttagttttttattgcttcagtgacatactactacgcctttaatagcttaaaacaacacagatttattatcttattagttctataggttggaagtccagcctagggctcattgggctccaatttaaatattgggcttctttgagaaaataccaaatgatagatgttcctagtgctgcctgagggcccccccacacccggatgtcctggaaaaagaagccttggtttccacagaggtttctgcggcagcatttggtccaagtctcagatcttgtgaaggaattaaagacaagggatgccttcctatcaccaagctgtgccacctggatcaagtccacaagggagatctttctgttttccctacccattcagtagtctgagatcatctactatttcctgggaatattcctcaaagacaaggttttaaagattacacccctgcaaaagcagattcatgctgtccagctgaccaggaacaatgcatttttcactatcttggactataagcaacatatcatctgtgtgtgaagtgctccaaggaagtagccactgccatcaatgagaccgtcatccttgcacagctctctgtaagtcccatgcagtgaagctactggaggaacaagattggcaaactccacattgtcccttgaaaggtaataggcagctgtaactctgtgctggtactcctcacccctgccaccaaagaagctgctaataatggccggtatcctcaactactacattttagccacgggattgcaataccaccctgggcaacttcaccaaagccacctttgatgccatctacaagacctatagttatctcactccaatctctgggaagcctctgtctgcttaacaagaattcactgacccacaccagagtgtccatgcagaggattcaggctctggctgtgaccaccacactaatgtctttatacaagaaaaataaggtgatttaattaagccattaaaaattgctggtagtgctttattttttctggagtatataggttaagatatccagatcctaatacttaagacctttgaatgttactttgtatgacgaaaggaactttgcaaatgttattaagttaaggatcttgagatgggaatattatcaataataatcaaagacaggagacagtgcagactgtacttctgtagtgtttggatgttgggacttacatagagaatagaaaggagccagagagaaattcagggtcaagagattggagagatttgaagatttttaaggtagactcactcatttaatataaatgttaatgaattaactcattagcatttaataatttgacaaatatttaagtgttcactataggcaagtcagtggtgtgtgcaagagatgcaaccatgcatgaggtattcactctaccctcaaggagtttactatctgaggagaatgcaccagaagaaactgactagggacaagtaagagaactgttaggcagcatcaatgatccagctcaatttacagtggcagcaatctatgtgcaaatgaggctgttgtgccgcagagttcaccacctgaatggcagggcaaagaaacattgattgaagatttgctggattttacgggttaaaaggatatggaactgagagtgctgaaaagataaggaactgagggttttggcttaagtgatcaatcatgtgactcaagctacaaaaagagggaacagaggccagaagggagttaaaaagattgggagaaaatgttgccaaaaggttttctagatgaaagatctcttatggtatgagatcatgagagaagatgcagtcagagattgggctctagagtttaagatttctgagatccacagcatggcttgctggctacaaggacattggactgtcttaggattatggcaggatttagggtaaagataaataatttaaccccagattcactggctttactggatatgagcaaggaatccagaagtgtagtcagggagcttgacctcatagccgataaagcatggattaataggtgttcgctggaccaaatttccatctaattttgaaaatatggaggcatcttgtaatgttggagcaaaagttacaggaagtagagtgaaaggtgggaggagggtggttgttggaaagaatcttgggagagggagttcaggatagtaaggagatgaaggcatgaaagcaggttggagactgtaaagcttccactgtatgaaggctgtagggctaagaaatatgcttataattgacagacttcaaaggatttaacctgggcataagttgtgttttttgttgctgttgttgtttttgagacaaggtctcactctatgtgtaggctaaggtgcagtggtaccatcttagctcactgcagcctcaaacttctgggatcaagcaatcctaccaccttagcttcccaggtagctaggtctacaggcatgtgccaccacactggctaattttttaattttctgttttgacaaattcttgctatgttgcccaggctggtctagaactctagggctcgagcaattatctcacctcgtcctgccaaaatgctgggattacaggcagaagccaccatgcccattcataaattgttttaagccggagacaattatattattaaagccaataaagtaaaaggaggaaactttctagtttgaatacaagaaagagtatttaattcaggcagttctctgatattgtattacatgacctctttatttttatcaattaattgaagatacaaactaaaatttataaatgttgtgcatggccaaactacattaatgctgtctttaaatctccaaagttaatatgatcaacattgtgcaatggaatggagagaactttgacttcaacagattaagaatttagaaagtaggtgatggagttttcttgttaataggcacaaagcagtgttcttgggctttaactttgtgctaaattaatggccaattcctactgattttacctcttaataatatttattttatcatgtccctcttgccctcctatgctgatactatccttgtttaggccatcatcctctctctcccggattactttaaaagcctccccactggtctccctctctttagacttaaacctactagttcatcttccttaccaccagtgtatctttcagacatctaaccttgtcattatcctactgaaagccattccagtctctccactgtctacagctgagagtacaaactctttatcatggcatcacatcggctctataatgtgtcccctatcaactttttcaatttaacttttttccttgctgccagtaggttcccatctaatcaaatgcagtatatcctattttttaaaacagtaatcctccattaaaaaaattactagatatctgtctaaagtatatgcctgttctgtgcttgacaaattagtttcagagtaattaatcttaaatgggttggcatttatacatggttattccactattgacaactggattattttaggaattacatacagttatattggagctacaacctttgaatttgtgcataggaattgctatggatgaagtttcagatgcccagtatgggacacattttttaacagctttattgagatataattcacatcccatataactcattcatttaaagtatacatttcaatggttttaggatattcacatatattgcaacaatcacaattttattttattttttattattttttaatttttcacatcctcatgaggcatctgacatcaccacaatttcagaatatcttaccctctcctcaaaaaaaccctgtgtcctttagccatcatcttcgtataccccatctaccttaacgcagagcaagcattaatctactctctgtctctatggaatttgcatatcatgggcatctaatataaatggaatcatatgacatggtctcttgtgtatggctttttcacataccataatgtatttaatatttagattctagcatgtgtcagtacttcatttgtataacaataatattttattgtatggttatatcacattttgcttctcagttcattgacattgaggttgtttccaacttttggctattatgaataatactgccatgaacatttgtgtaaaaatttttgtgtagctatatatttgaatatctcttcagtatatagctaggaatggaattgctgcatgtctgagtctgggttgctataacaaaatacaataaactgggtggtttacaaaaagcccagaaatttgtttctcacagttttggaggctggaaagcctaagatcaaggcattggcagattccatgtctggttagggccctcttattagacaatcgtcttttatctgtgtcctcacatagtggagagtttgagagatctctctgaggcctcttttataatcctattcatgggggctccaccctggtgacctagtcacctccaaatgccacacttcttaacactatcatcttggggattaggatttcaacatatgaatctgcttcagggccagtgggggcacataaacattcaacccattgcactgggtcatatgattactctataactaacgttttgaggaacttccagctgtttttcaaaatggctgcaccattttaccccaccagcagtgtattagagttccaatttctccacattgttgtcaacgtgtttttttacctgagttttttattatagccatcctagtggatatgaagtggtatcttattgtggtcttgatttgcatttccctaacgcctaatgatgttaaacgtcgttccatgtgcaaattggctatttttttttttcaatggagaactacttattcaaatcctctgcatgtttttaattggattattatatttctactatttcattgtaggaattccttgcatattctggatactagtctcttatcatgtatatgctttgcaaatattttctcctattctgcaagttgtctttttactttcttgatagtgtcctttgaagcactgaagttcttaatttttagtaagtttaatttatctatgttttcttttgttgctgctttttttttcttggtgtcatagctaggaaaccatttatgctattatttcttcaaatattcttttgacttagctgccactttgatttcagatttcttactgccagagctgtgagcaaataaatttctgttgtttttaagcaacatagtttgtggtattttttttttcttacagcagccacaagaaactacctctgttggcctcatcaccttctctttctcatttttccccaaggaagaaataggtcatctgattgagtgtggctctagggagtatcccttcattcccctcccctacctgccagtggctgtcatcaatctgtggtattccttggtgcatcactctaatcattgcctccatcttatatctgtgtcttctcttctgtcccttctaaagatatttgccattggatttaggactcacctagataatccaggatgatcttatttcaagataattaaattagttacatctgcaaagacccttttcctatataaggccacatccacaggttctggggtttacgacatggacatatctttttggaggccaccattcaaccaccgcaattactctcatggtggtctctccatatggaaacatgggggaagggagaaaagttctactttaacttatgcttagtgtagcatttgtaaaaaataaaagaaaattaaaaaattaaaagtcatctatatgtgcacccattgtatgagtttattattcataattaatattctctcaaattttggattcataaacccagattaaaacaagcttgtctggcaccgtggctcacacctgtaatcccaacacttttgtaggctgaggcaggtggaactcttgagctcaggagtttgagaccagcctgggcaacatgtcgaaaccccatatttacaaaaaaacacaaaacttagccaggcattgtggcatgcacctgtagtctcaacaatttaggagctgaggtggggggatcacttggacctgggaggcagagccaagatcactccagtgcactccatcttgggtgacagagtgagactctgtctcaacaaaaacaaaaagaaaaatataaaccaaaactaaagctctactctgtgtactgttatacttatttttatttaataagaaattatgataatcttaatctgtcaatagatatggagataaaacataatttttaatgcctacagcatatcctgctgcataaatataccaaaacttattgaatcaatctcctctgacagatatctgtgttatttccaaatgttcacaattatgaacaaaattgtggtgaacctccttgttttattgagctttacacacttctccagctgttgtcttaggataaataactggatcagttatttttaaaggctttaatacataattcatccttcagtagtttgtataaaagtatattcctaacaacagtgtatgagactgagtgcttaagattttgggtattacccatctttttttttttttttttttttttttttgagacggagtctcgttctatcacccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctacccatcttttaaattgagtatattctagttaggatttttgcaaatatattcatgatatttgtttgttgtgtctccttttgtatcatttttgtcacaaagcttggtgtttaccatagagggctaaaaattagaatcacactcatagctagagagaaatactttattaggagcctggtaaatatgaaagagtcttaacgtcaggactcagtgctccttggtagttcaaacagacaagactggcttagcctgatagagccagaagaaatgtagcagagtctggagagattgagcaaagatggcaaggaagaagttatgggggtaagggtgattttattatgtttcaatattttacagttcacttaaactttgaactaaataaaatgcattaacaaacatgaagtttctacatttgaccacgacattaactagggaaagagaacataaaggaaaacaagaaaaagactttgaagtattggaaacacactccactaaaatgtttttattttttatttttatttatttatgttttgggacagagtctctctctgtaacccagacaggagtgcagtggtgcgatctcggttcactgaaatggccacctcctgggttcaagcaattctcctgcctcagcctcctgagcagctgtcactgcagtcatgtgccaccatgcctggctaatttttttgtatttttagtagagaaggggtttcactatgttggccaggctggttttgaacccctgacctcaggtgatctgcctgcctacatctcccaaagtgctgggattacaggcatgagccattatacctggcctaaaatgttttcaatagccacatttatggagagggaacagataaagctgtggttgtaataaaagggccttttgaatatttgactctaaatgtttattttaaaaaggaacccttgattcaaatggcgatccaagatcacttcgaaatcatgagcaagatctcccagacccaaatctcatggctagaaaatggatgacctgattacatagatcctaagatgtcttttataaaagcctgagaagaacagtggacctgagagtaaaacacttctgcagagataatttgtagatccacagtcaaaatatttcagctgtgcctttgtctgttgcccacatgtccaggtaattcttttaagtagtttaagaatggtaaattacacattttctaggagactgaaaattcctaatcaaaggttaattattttttgaaaattattttttgaaaagtttagtaaaatcttctgaaggcttcatttagttctacatcttgtagaagattcagaaggcatcaggtgtaaccttctgctcttttctctatccattgctggctccctactttcattttgaatttatccctatttccctatttttccccctttgtgtacagatacgatcattctccaccctaccttccagcacttgcccctcttcaactaccaccttctccatcccttgttgagaaagccttctctcaacttcttgtttatacttagattctttttttcctcacctacaattcccacactattgaataattgtctactcccacagaccacatcatatccccttgccatcttgcttgttgacaagagtgcatatgtgccaggcactgtatgaggcaccaaggacacaaaatacatgattcctgtcctctatatttagggtgaattgtcagaagaaactggtattacaaaggtcagttagagagtcattgtggtcaatcacttataaatcacaatacactttttctctatttttagtatttttctattacatataaaaaactaccttccatgagaaacaataggatggagattattcaagatatagtgtgtcaaactgagaaatgaatacacagagttaacgatttgtttgaccagaggcaagaaagcattcacagaatgcaaagtgaagttagacttgctgactgagtgctttgaaactcccgattgagaggatgaacctcatgcacaattagcgccttaagggaaggtcttgagatgaaagaaaaatgaaaatagttttgtggccgcagaatttactaccactggacgcaagatgtctaaagtactttaaatgtgaactccaagggaggtcagagataaattcgactgctaaaaatcagatttacaaaagcaatattcaaccatgtagactggcaactccactagtgtttggagctccccatccagatgtacaacaaactcttggagacttggatgtgttacacagggggccggtcgggtttccatttaggaccaggagattataatcactttattttagcaacctccttactacaaggccaaaactgacagtcctctctccagaccctcgcgtccgccctccagactgtgcttcccgcgccggacagggaagtgggagtgcggacgacaatccgcatcctgccagccagacgtcaccaagctgtcttccaagaggcaggcggagagagctgacttccgattgggtcagccgaggggcacggctggctccctattggcttacaggagggggctagagagaggcgtgtctcaacgtcacacccgcccctagtctccttgctgctcaggattatgggagggaagggaagtccaggagggaaaaatgacccggaaagacctttgccggcctgggccagccctcttccggagctgatgtctcctcccaccaaccaggagaggtccgccctaggccccgcccgtgccgggggatcaggtgattgcgggccaacacggtcacgtgaccggggcgcacccgccgattgtggccatggcggccgcagtctctagtgtggtgagacgagtggaagagctcggggatctggctcaggcccacatacagcaacttagcgaagctgccggtgaagatggtgagggagcggaggagagggaggcgggcggggcagacggcgctaaggtactggcgctcgatggctgtgagggctagaggctgaggcctgtgttcctttgggtcccaggccgcaggtggttacccgaggtctgtcgcttctgagcccctctgcgccatcgattgcccacttcccagaactcacaatgccaaggcgttgtcttcgaaaaccgcattattcagaacccatggaaaatctgtctagatccgtgctggtgtaaactgtctcggtagcgattggaagaagggcagaatctaaataaaatacagaagtttaaataaatggctaagatgaatgataacactcaaattagttatggtggtttgcatcctgtaaagataaaaagacatgtataacagttccactttttcattgctgcgttgtaatttgcgttttacgttttggattcaaaacaacattctatagaagagctttacattggtgtgtagactattctgccccatacatcatgccagttctcacaagggctctgttaagtattggcatacttgttttggaaaggtctaagctgttaggaaaaactgggctagggaattgcctcaaccttctgaatttaagtccaattcttttcattacgtctcagctgcctttaggttctacattattcctttttgagtttgagcaattactacagatagtttttaaaattctgtggactgactcatatcatcggactcataggaaaacagtggtggaacattttcttaagcgattgaatagttggtgaatttgttattaaatagggtctatgatgaaatgccttagtttcagtgaatattttttgccagattatcatttatcaggagtgttttgttttgttttgtttttagaggcagagtatcattctgttgctcaggctggagcccctctagtagtgggacaacaggcgcacaccatctcgcccggctaactttggcatattttgtagaaacggggttcaccatgtcatccaggttggtcctgaactcctgggctcaagcattccacccgctttggcttcccaaagtgctgggattacaggcgtgagccactgtgccaggccaggagtgtgttctttaaagacctacagaccaccctgaagccgacttatattttggtctgtggattcacatgaataattcttgggtagtaggagctattaacttgaaagttatctatgttacctctaattccagattcacttgaaccagtccaaagagaccaaagaatgttttttattcacttatcactgaactaaaaagccattctcatttcccttggaagagttctttaatctggaatgaatcagagctggaaataaaagtcatgtgctatatatggaattcttgtttgaaggctttatacttctgaaaatttactaaaataaaatgacaatgttagtggtccacattatgagccgttgatcagcatggaaatcagttcaatcttaaaaatattacaagatttatgaactttaattaaaacaagatttcatgtacttgaattgaatttggcattatttttccacgcaacaagaataatatacattcaaactttgttctttaatgtaatgagtatatatttatactaggatataagggtttgatgatttccattgtcttcttcagattagatgagatacagccagacattatttcatctaagaatgcgtctttaaatttctagccaatttttgttaatttatttctcatcatacaagcacaatctgtttactctatggaagtacgtcatgagggagtttttccacagattatataagaatcagtttcatcttttgctttgccagtcattactttgactaaatagttctagtcaaaatactgcattttatgggcttttccaaagtgtgagttatgccaccaccacacccctgccacagtaattatgtcatcaatttatgtgacatactctttcagcaatggtttagtgagttcaatgcaaatctttacattgaaaataatcctgcaagttaaacaaaatatcaacacactctctaaagaagcacctaaggcatgtcatattccatgtaatttcagtttatagtagaatctttttctacattgtgtggatgtcacttctgggctaatgagaggtggaaggacagtgctaagaagtagatttcaactcaagtgaaagtggatcttacagcagtcaaaatgcaatctcaggctttacctgagaagacttaaggcagcagtcacatgattgccaacagacataacctgatggtgcttttgctccaacaatgaacaccttatctgtgtaactcctgaggctggatcaggtaggcctacaccaaatgctacactatctgttcattggcccatgaagaagaaagggatatattttagaatatcagactatgtttcagaagggaagcactgagaggtaaactcagagagtttagtgtcttgattatgggtgtatctaaatttgacttcatgaagtgctgcagaagggtggatagtaccttgaagtggacacataagaaaaggtgaaatcacagaagcaacaaagggattatgacattagagaaagggaaaaaaaatcaggagatggtgaaggcggagggagggtgaattgtgattagaggacttattagaagtatttagttccttttcttccaggttttgaggaaatgaggtaatttgtttctaagtttttaaaggaattaaatacacagatgtattatgtaattttaattgtagtagatataaacaattataaaattgctcataatgctggcattttgtaaggaatttgatttggtcaatcatggtcttttgaataacatttgcaactacatttatgaaatcttaagttttcagtggaagccctttctgtatatttatgtatattatttgtatattccagtaagttttaaatttgtttaattattttgagtgcattatcataaaagaagcataatgagaatacagactgcatttaagaaatggcaagagtgactctagaaagttttcagtattttgctttgtaggaaaaattttcatgataaatttacttaattaggattaggcattatgagatatttcatgttttagataagatattattactataattctgtttctccatatgtcataatattatttcatcttgtcatttcatcttcatacataatgtgttttttgtttaaataacactctgaaactaggtgaagtaatcctcatgtttttatttcttatagatcactttttaattcgggcctctgcagcattagaaaaattgaaactcctgtgtggagaagagaaagaatgttcaaatccatcaaatcttctagaactttacacacaggtactgaaagagtggtggactctggcattttatgagggcaggttgtttatttagatgattgactccaactttaggtaaaatgaaatcagtttattctatatttcaagtgtttaattttgtccaaaaaactatgaataaaacacaaaaacttaaaactttgaggtagtatgaaaagaagtaagatttattagatgtgttaataagaaaagtcaggaagaaaatcttacagataacggaattgttttcctttagagataattgaacaggacactagtgtgtgcaatgtccaatctcttgaaagtttcagagggagcaggggagtatataagggccctgactttttttttttcccctgaaatttaccttccctaggattctcaatattattctccctgctagtgtcatgcatatctatgtgatttttctattcacccacttttttttttaactttcctttccaaatcaggctgctgtgtggacaacacctttttttcttggttttctgaaacactgctgaggcatgctaacatcaagaaatgtaattttattatggtaactaacatctatatagcactttgtagttgatagagtgttttcatgtgccctttttggattgctaagggataataaaactgaagtggttacagaaagtacagtacacttagttaggcttccaaagtgcccatttatagcatttaaatgcttggtgctgttcttcctgttaggaaatttctaaagatagcttctgccttcaaacaccatggatgagtaagcctaacagctactcacaaaccacagagaactgttttaagtttggcaggtattttgcttggttttctttctgttcagaagactctgtgcttgtctgtatgtgttttatgtcatctcatttttttcacgagagtgttccagacattttaacttactggaataaggcaaaagacctagagatacagatttcaattttaagatcctcttaaaccctattgatggttctgaatcaacagatcacctttcatatgatgatgaaatcatatatgatgatctctccttactggcttaggcctttcgcacgataacatttactcctcatgttcacagaaagtaaagcactaactgggtgctaggtaacgtttctagtaccttacatatgttaattaattttttactccaacaaggaactttgaaaggtattttagtccaatttatcatttagccaattaagaaactgaggctcaaaaaaggtaaaattgacttgtctttggttagttaagtgattagtggtagaactgaccctagaacccagtttccttagtcttagttcaatagattaaaaaaggaaaaaggattggggagttttaatatgctttaacagcatctctaataattaggaatactgggggcttagtgtttgagttgcatatgttgatggtatgcttcctctattgggtggcaggatacatacgcccctcacgctggctctgtatttgggaacacaaatcctttgaaggttcaaaactggaagtagtgaccttaacttgatacagcaggcatttagaaaattttcaggggttatataagtagtagaatataataattacctttttcataattatatatgattaaattctgtaaattaaaacaaagctctattttcttttttgagggaaagaaagattatcattaattcagcactttagtgaaatacctatgaagttttctttaaaatctttctcaaattatatttacatctagacattttgcctacttctcaaatttacatactgagctagaagatttaaatgtgtaataaagcacctatgtgtgcaaggttagactgtaagaattgttttttttcaattttaagtcattgatagatatctttctttttttttttttttaggctattttggacatgacatattttgaggagaacaagctagtagatgaagattttcctgaagactcttcttcacagaaagtaaaagagctgattagttttctttcagaaccagaaattttagtaaaggaaaataatatgcatccaaaagtaagttttacattcctgttaattatgatggaatattgctggtacttgctgtcctgctttttggagtctatatttttttcttcttgattgtatctttgtttcttaaattaagattggaagagggagataaaagagcttaacacttcagaccaatgttgcaacaaaagtatcatattttactaaatgtatttcagaatatttgcataatagaattgtaatagctgtgcctaatcattttttttaatatagatattcccatttcgaccccctttacttttgcagatgctgttttcttgaaggtcactattaatctaattaccacgtctgttcttacagtccttattctctcgaacatttgctccccttcttaatgttgatcaccccctccctctgagaccctgcatgcttcttttccacttcttcatctctgaaatgtcttctcttgctagcaactgttctgccttccattctagaaacacaggtactagccagggatgtctctttcatcaccgatagtctctattctgtctttgcttgataacctgttcacaggctttgtactgtcatctctatttggataatcctatgatttgtatatctagtcctggatactctttgaagcaaataatttctcatctttaactgcctgctgactgtttacttagatatattttttttctctatttatttatcaggggaggctgtggaaacatctccaaatttcaatgacaagccactttaaaaattttgatttattaaaattatttttgggtgtaaattttcattattttattccagcggtagtagaaatagatatgatctcacttcaagtaatgtatttgtgaaaagttacctttttaatgagatgatgactgcttatattgcaaacctgttaggggaatttgctagtaaaaatattttttaaattattttgtaaaactactagtaaattgaagttattttaattttcatgtattaatagaattgcatatttataattgattgaaaataaggcctccctgtgtaagcagctaaacaaagggaacattttgtgacttgagaatgtttttaatcgatgagtttttgaaatttaacttcaacttttatagacatccagtttccctttttagctatgtctttttttgtgtgtttcagcactgcaatttgcttggggatgagctactggaatgtctctcttggagacgaggagccctgctgtatatgtattgtcattctcttaccaaaagaagagagtggctcttaagaaaatccagtttgcttaaaaaggtaagaagacattccttacacatttttcattgttgacatttagaggtttcaaaaagctgtctttgttgtactactaagagtagtggatcaaagggtctgagtttgtattctgtgtcttttatttactagctgggtaatcataaataaattgggcttgttgtgaagactaaatcagataacatgtgaaagcactttgtaatctgcgaagttctttttttaaggatttgtattgttttaaatataagataaactatattaatttctaaacttttaaaaaatttttgtcctgaaagaaacacttgactgtgagcctgtcagcagatcacttctaaggaactcacatgaccctgcttctagaaaattgtggccctctgattcacttgaccattatgactgaatcattaaatccaaaatatgagtcttggtattgtatcactaaggattctaacttgggttaaatgtacacacaatttaggtgggcttgaaatgcgaggccacacttgcagatataaaagtttgatcataatatttctaaattataaccacatacatgtttttaatacattgttgttgagcacatctttattatctttattcttttcttcctctgataacatctttaacaagtatattactgaaatgtgtttctggttaatgtcttctttttttttagtactcttttttactactagagcatttcaaggggtatatttatattagcagagtcttgggatggtgggtctttataccattgaaatagaatagctgtaagctatgcctatatattaaccaattttctcttgagtaaagaatggaaaatattagtatttgaagtttatatatctctgcatataatactttcaattctttggctctgacttttatttagtaccttcttgatggaatcagttacttgctacagatgctaaattatcgatgtcctatccagttaaatgaaggagtttctttccaagatctagacacagctaaattactgagtgcaggtaatgtgatctctcattaaattttctaagtgttttaaagcttcttaagattttaggaagtttgttagatttcactctgatttaaataaatgtcaaggtagattatagacaaaaaagtaataagtaataaagggtttatataaaattcaaagataaaatcttttgatgtaatacagaaaaatatttctaatcccttgtgtttagtaattttggaagttatgtattgtgttccttctgctcattttgcatcctcacacagccctgtaattagtctgttttcacactgctataaagatactacctgagactgggtaatttataaacaagagaggtttaattgactctcagttccacatggctgggaaggtgtcaggaaacttacaatcatggtggaaggggaagcaggcatgtcttaaatggcagcaggtgagacagagcatgtgtgagtgcaagaaaaactatcatttataaaaccatcagatctcatgagaattcactcactatcacgagaacagaatgagggaaaccacccacatgatcccgtcacctcccaccagcttcctccctcaacacctggggattatgattcaagatgagatttgggtggggacacagagccaaacatatcaagcctctgtcagcatattatcagtactagatttggctacttgtaaccgaatggaagtaacttttcaacaaggtagacatttagtgatctttcgcacagtaaaggtccagagctggtacagtggctccatctcatcatgttcttacctttttcctccattcttctttaaaaccagaccccctcttcatggggaggcactttatatagaacataatataaatgatactttccagactgtgcagcatgcatctctgtttaggacattgcttttattctcagtatcccaagatgttcctggagctccttcaatctcacctgtgtttcaggctacaggaatggcaaaagggaatttcagccaagtctgttcctttagaccatcattctcagaagtttcttacaacctccatttcactggccagaatttaatcagattactttacttagctataaggaaacctgggaagtatagtccttaacctgatacattgccatcccaaataaaattaagattctttactaagaagggggtattggggagaatgaatactggttggcaactataaatttctgccacaagcgtctgtgtacttgaaaattctaggaactgaatatagagcatcatctgggttttagacttgtgtgtgaggagagaagaaccacttacttttaccatctccttataaatggaagaactgagatccaggtaaatgcaagtgaattgttcaaggtcatatagctgcaagtaacattagatcacatgtgtaaacctttttatacttcatctgaagttttgatgggaaaaaaatgaaatgtgaagaataattagagtacctctttggaaatattctagtatattaaatatgttttaattcttcctgtttctttgttagcctctcctggattgttctatttgaaagcatttcatagaaaaaaaatagtgatttaagtgacctgatggccaaaaattattactttctgctcatttagacaaatattttattctaaaacaacttattgtgaatacaaaaagctccctcagtgggcatgacattttgacaaacataggatatttgatgtaattatggcaagtatatactagttattagttatttcagataactaggaaccaatcagaggcattgaaaatggcttttaaaaaatttctatttatacacatggactgattaaattgaattcttaatgtgggacactttaaaagaaaaaggtgggggtaggcactacagctcatttagaaccaaagggagtggcacaaatcacctgttttcctaattctcccatttccagttataaagtaagacattctcataacctggagttttttcttcaggaagcatgtaatattggtggcgtctctttgtcatactttgaatttactagctcctagtttcagttggttcttcaacaagggaattaaaagggtcagatagggtagcattttccaggcaaaaagacacagtataggcaccatagcagtttgctacatactgtcctaagtcctcttagggtgtcggccttttgttctcatctaaagaagtttgcgcttgaacctaggaggcggaggttgcagtgaaccaagatctcaccactgcattccagcctgggggatagagccagactctgtctcaaacaaaacaaaacaaaacaaaacaaaacaaaacaaaacaaaacaaacataagtttgcctcctttaggaggccaaggcaggatgatcacttgagaaaactggcgccaggagttcaagacatagtgagacatcatctctgcaaaaactaaaaaaaaaaaaaaaaattagccaggcgtggtggtgcatgactgtagttccagctacatggcaggctgaggttggagaatcagttgagcccaggagtttgaggctgcagtgagccctgatcgcacagctgcactctagcctgggtaacagagtgagaccctgtctgagaaaaaagaaaaaaaggctgctttgcccaaatgtatctatctgaacacgattagattagaagccaggaaacctacttttcataggctgaattactcctaagtcctaatttgagaggctcaaattattttttgttagtccatataaaatacaattctgagtaattcttagcatttagggagaaaagttctatatgagacatcaaattttctgtggctagatcttggtgataatttacctaattttagataaaactcaaaactgtgtatggtttttgttactttttctaaggtaagataatcatattgttgtttagacattatctgtatatcattaaattttatgcagtaagcccttgtatctcacctctgagtctcattcttctgtgaaatggggccagagaattttaatctttggacatggccttatcagataaaagggttataaaaattgcattgtcagaataaacctggaatcacatggaggtaaataaaaaactgtccaacttttacaccctttgtttatgcccttaataccactgaggagcctcccacccctacaaatcagagctggtatcacaaaaggttgtatgagtgggaggagtgtgatgaagagaggttgggttaatgggtacaaacatacagttagaaagaaggaataagttctgaaggcaaaagtttgagaaccactatttatcatatagccatttgtattagtccgttttcatgctgccaataaagacatacccaagactgggaagaaaaaataggtttaatggactcacagttcctcgttgctgggaggcctcataatcatggcagaaggcagaaggcacttcttacatggcggtggcaagagagaaggagagagaagtgaaagcggaaaccccttataaaactattagatctcttgagacttattcattaccacaagaacagtatgggggaaaccgcctccatgattcagttatctcccactgggtccctcccacaacacatgggaattatgagggtacaattcaagatgagatttggatggggacacagagccaaaccatatcaccattcattcagctattctgctgagcctgttgtttctcttgctactctttataagcagaaattgaggtgaagtgaaggtgaaaactgtaggaacaaattttgatactttaaaaagcttgcaatagattcaaacagaaactaccactattttgaaagttgaatttttcatatccagtgccatcatagtcacttttgttgaatcatattaggtgaacaacagacattgtgatgctcatttatttgaagtaatcttttctaatcacagaagcacattagaatccatcatttattttttcttcaatggctttaagaagttacatttttatttcttttatgttctttaggaaaattcaggaattaagtaggggatgcaaactccttatttttcagatttaaaacctgagattcaaagagctttggtgacttgcccaaagacacaaagccagtaatttatacccagatcttttttattctaggtttatttgtctttctgccaaattaatatactttatgcaccataaatatttaattatataattgcctactggaaaaactacccataagaagaaagagttcaacttttgatgaaaattctgcagcatactctctttttttctggtaatacaaagcatcttggaaataacacctttaataatttaaaattgtatggactctcaggcatgattatgcatgataatttcttagacttttagagaatataagaggtctaggatacttgactttagctatatgaattatcctagagcataccccaaaataaagggtgtgtccatggatgtaattcagggagtttataagtactctgaaattgactgcagaatttggggtgtatattctgggagaagttctattccttaaattagattctcaaagaagttatagagtggaccccaaaaaggtcaaaaacacctaaatggttctctaaaaaaattctctggtactctgtttttctttttgtaatgggcctcctttatcagtaaaatcgatattaaaaaatgctaattaaatgaagattgtgttagtcatatttggcttttgtgttactgttaaagtgagaatagaaaatgcttaatgacaaaaggaactttaattagagtttagttaataactacggtttctttttaagcttttaattctaatctgtcaacctaaatgactttcccaggaatatttagtgacattcatctgctggctatgatgtacagtggagaaatgtgttactggggatcgaagtattgtgctgatcagcaaccagaaaatcatgaagtggatactagtgtgtctggagcgggctgcactacatacaaggaacccttggatttccgagaagtaggagaaaaaatcttgaaaaagtatgtatctgtgtgtgaaggacccctgaaagaacaagaatggaatacaacgaatgcaaaacaaattttaaacttctttcatcatcgctgtaactagtaagttcatctagtccttttcaaatagaaaaacaacaaaacccatgaaatggaaaagagagttccaaaaaagaagacctgttgatactgaatatgagaacattacactgcataaagatatccagcttgggtaccctactaaaacaacatcaccatctttttcattatatattagtaaacctatgaagggatgattctttaatttctaaagtgttgttcaaactcaccttaaaatacagatgttatgtcactaataatgagtagtaacccaatttagctttacaaagattttttctattactttttttttttattgtggtatatgtaacacaagtttaccatttttatcatctttagattatttttaaatctcactaccttgaagtttgccatgcttcagaaattaaagtcaagttacttcactgctttgaatacatactatggatataaatgtaggcaaaatgaaagattatgactaatattcagattccattttcaataaggtaaataatgaaagatctcacaaaggaatcattgtgtttaattattttgccatgtattactaattgtatttaaaatttctacttcccttaggcattttataaaaatttaaaaattatttttctattttgtttaaaagacaatgcatggcttttcaagtgagtaatgaagataaaaaccaagctaggttagtctaccattagttcatatgtttttgtagcacatcttttcataacatactgaaattttaatgttttttgcctttaataataggggtgagtgttaaaggccagagagcctaacttgatatcttgctcatggtctttctgtctacctcaactcctgttgtcatctttggatgatctttctgataccttgctgataccttggacttctgcccagtgactttattacattccagcagcttactcccgtggccgcactttgaatgtcaccaccttgagtttctctttctggtaaaatttcagtaactgataactgccctcttttcagttttttcacttccttattttattgacttttctctcctttatgctcattccacattcttcagttccttcttacccccttttcttgactgctccccttcctcctaaactgtcagcccctttcaggctttcttccctatccaccctcagctttatgggatactatatgaactaatctcaccagttattcttctttccctggtcttttagtctagtcctttggcaagccctcaacctcagattaatcctatttattatctaccttttcggggatgctgagttctttgtgatgggtagtccttcaaagtagaatcactacaagtgtctcacttcagccttagaaaagccctcaatgtaaaccttatgtttgttactagggtggcctctctcccatttcccgctgtggctgagccaaacttcattactttccttaggccctctgcccctcccctagcatatggctctttctcctattgaacagaaaattgagactatgaagaggtcaacttgtatttaccaactttactcattttcccattttagaggaaaagaggttgcctgcttcctatcaaaggcgactctgtgctacatgttggtttcatcttcgctgtctctctcatttccccacaaagtgttgtctcactttctgcctaccttttaggtattgatcttcactatatttttttctctctctctcttttttttttttactttacatattttatacaatgtcattcataactatggcttcttttaccacctgtaataacagactgagtctcaaacctgtaacttgtatcctgacttatctcttgctttctaaaccttgtttctaactgtctatcaaatatcttcattagacatcccacagtaattttaagctcagtgtttccaaacgtcaagtcctcatctgttatataaaatcctttctgctttgtaagttttctctttttgggattttccgcagatcagggcaacacagaatgactaccttcccagccatgtctctgcagtcatcctgtgtaatcatgttctagtccagtgttgctcaaacagttaaaatccaggctgcttttggtaaacatacaaattctgatatagagcctctgtggcaaagggaatttctcagttcctgccccagcccccttgtttatcattacacagctaagatttttatttaacttagcattttagcaagttttcttatgaaaatacctttgtgctttctaagtataaagatttaaattatttttaatacggtttttagaaccacagactatccctctttttagagcatcctgatcaattgcaagtacttccacttcttccctaaatgcgctttgtgtgttttccacctcagtagccttgcacacatcattacttctgcatccttctttgtgaccaagtgaatacctacctacctcttaggactcagcttcagtgattctgttttcataggctttttaaagcccttttcagtcaaattagatgctcctttgttctggtcctttactcttcccctcccatgttgtcgcactgatcacactgctttgtaattattttctttattgttggtaaactccatattttaaaaatttacctgtatacatagtgcttaatgcatggtaggcccttagtaatgtttttgaattaatgaggcatgattctaaatgccaaactttgcacaaaaagttgttgctattggattccaaactgctatgccctctataccagtggctgacaaggcatatagggatatatgccatcctgagaggagtaaagtgtttagattctgaacctgagaaaagagaactttctcttaagaagttggaaacttcattttaccttcgtgaccctggtagaccacttggtctcactggttggtacaattatgagggtagtactgggtgctttttatacaactttccatcccccacacagttggagaataatttgtagaccatggcagttaaaatgctttttactctggtgtattatagaataatgaacacatttttatatatgttaaagcctgctaaatcattcacttagaatgaagtaacctcaaggtaccaaataccccacataaggaaagtactacactaaattcactcaactattgtatgcctaccatatgccagattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcattaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaatttccaagtaaactgttattgagcatatacatttttaaaaaaataaaaccatacacccctacttgttgcttgttttatatttggctgttgcatcagaattaaaacttttatcatctcagtttactattttaacttctgaatgttatttcttctggtcctaataacttttaaagatggggtaatatagtggttaggattctgagctctggagccagaaggcctgagtttaatcatagccctgccatttataatactaactgtgtgactctctttaagttatttaatcttcctgtgctgccttatcttatttttaaggcagtaatagtacctacctcaaggatattgaagataaataagttaatattcagagtgctttagttcagtgtgtagtatataagagcacaagagaattagctatttctagactgtttcccttaatgtctagttctgtatataggcatacctcatttagcatgctgactcattagccagacaattgaatgacaaacttgttggccaggaaagcactgccttttccttagttcaagtcatgccggtctttctaggtgggaagcagacttcagagaagaaatcaggacttggataggcatctcaaatgttttttgtggatatgactggaagaaaacatccaattaattttcaaaacattttcagccctccctcaaaatatatataaaacccactgtattgagatgtactagtcatctaaatatgttatacatatcctatttaaaactggattttttaatcagcctgattgccttggcttctgataccttttggtctaattcttaactcacaagtcagaagcattcaatgaaatactggttatttaaatttaaatactatacttaaaaataggttattctaaatccttgtatagccacatgattgagtagtatgtacctgtaaaaatccatgaggtatatttctgtttaacgctacagagtggtcttattaagtaaaaacaaaatggagaaggtatatatatatatgtgtgtgtgtgtgtgtgt

SEQ ID NO: 335 - DNA, 608360 bp, Homo sapiens
aaggcaatgtgaccacagcagcagagactggagtgatgtggccaggagccaaggaatgccagcagcctccagaagtgaaagaggagtctccacaggagcttctattaatggaaggggctagcccagcgaacaccttgattttagtcccttttagtcactttggggctgggcacagtggctcacacctgtaatctgacaactttgggagactgaggtgggaagatgacttgagcccaagagttcaagactagtctgggcaacatagcaagatcctgtctctacaaaaaataaaaaataaaaaaattagccaggcaggttggcatgcacctatagtcccagctattcgggaagttgagcccaggaattcaaggttgcagtgagctgtgtttgtgccactgcactccagtctgagtgacagagggagatcttgtctcaaaaaaaaaaaaaaaaaaaagtcattttggactttgggcctccagaactgtaagaaaataaatttgtgtttaaaagtcactaaacttgtggtaattcgttacagcaacaacaggaactacacaaaaactaatacagtaatctggccatgccccgatagtgtataatattaaagaaagtgaaattatggttctaatgtttgttttcctgaaaacactacttttatgaccagaacatgagcatagtatgctaccattgaaaatttatctgacataatttgacacaaaagtagaatccgttttaaatgtattaccacaatgcatttgtcctgaagattgtgtttataacacattgcttttcagtatttccaaaacattatacgcttaacgctgaagatctgaaaaacacaatcataataaaagaaaacatcccacaacccaaagatataatttgccggtatacttcctgatatttttacatatacaaatggcccctaatgctatctagtttccagttatggtaactaaatggtcacattaacactttttaaaaaagatctttcccaattattaagaactcacacatatttgtccatcttagatcacttaatcatcctatcatcactgttttaagacaaaaaaaatcttattacttctaggaacttcatctcaaatagcatccccatcccctctctgactgactttacctgtataacttgcattctattaagcataagatgattaaattggctgcaaaagccagaagggacttttaatgaatttacacactaagaattgtgacaactatgtcttgatccaatatgaaagtttcttagatgttgaatctccattaaaaattattccagaggccaggcgcggtggctcatgcctgtaatctcagcactttgggaggccgagacaggtggatcacgaggtcaggagatcgagaccatcctgactaacacggtgataccccgtctatactaaaaatacaaaaaaaattagctgggcatggtggcaggcgcctgtagtcccagctactcgggaggctgaggcaggagaatggcgtgaacctgggaggcggagcttacagtgagccgcgatcacgccactgcactccagcctgggcaacacagcaagactccgtctcaaaaaaaaaaaaatttattccagaactgtcccccacaaaacaaaatagagttctaaaatgggcaacaatgcccagaaattgccagaacataaaaaacaagcacagagacttggtataaaactcaagacactgagaataagattatttggtgacttctttgaaatcaagatgatataaaagtcaatacctatgtcagaagctctgcatgtagtgagacacggcagatgccacacacacatacacacacacacacacgagaaagggacaatgaataatggagaaaactctagagagggacaaaaggaagaaattccaattccaatcataggttgagcatctcacagattcctaaatgaacaagagtggaaagcccacaacagatctctacgaaatatcactctctgtatcatatgattatgtctaaattgactgcccaataaaacacatatacttcccatctgatcctatgaattcagacatattcatgtaaaaacgtctttatatattgtcacatgtaattatacaaatttggtgaatatcaactggatcatgcagtctacatttgtctgtggtcaggagcccagagaagcagcacctcagagaacatgacctcacttgtgcttaaatctgtacctctcacactctgggaactcaccagagagctataaaggactttcaggagaaaggaggtcgaatttcaagggtggagagaagacccagggcacagggaatattattcttaaatctgtctaattctccaaggagcaaacctaacttgcccccatcctctagctgcccagagttcatcattcctcaattttgtttcaatggaaaaaaaaaattgtaatcaggactggatttgcctggaaggaaaatgcagagccagagactacaaagatttccattgcagacaattcccaatctagggaatgtctccagtaggagctgtggtgaagcctggtctgttccggtcaggccactcctgtgataaccctcagaaacattacaacccacagtcaagccctgtggcaacaagtaaggaagaaattcacctgttgttcagacaacagctgctcctttgagctgaagaatgaaatattaaattccagcttctgagaaaatcaaggaatgtgggtaagaaaaaaatgaggggacagaaaagagggagtgcaggtagatgtcaaaaaaaaaaaaaaaaaaaaaaaaactaaaggttgacctcagaaacacagatattacaaatgttccttcctatttctccattttattaatacgagcaagtttcaggtgtctacttcctatcatttcatgatctggaaaatggatctactctgcgggtacaataagctttaaaaatgactacgcagttacagagggcttcatcacaagatcttatttatgcactgaaactccaaaaatatctcacaataggagtaactggcgtattcaacaattatgtaaataaataataaaaagtctcaatcaggacaccaatattaactccctaatcaccaattttccccctcatttgatgagggtaggagtagagatgtgcaaaatgggtgaggctgctaactattgaacattctctcctccaaagttaagggctctcatgtgaaactttatgggggcctctgttcaggtcttacagtaaaagtaaattggagagaatcatcaagaagccatcaatactcttaaaaatacacacatctgtccatagatggtctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaggtgctgggattacaggcgtgagccaccgcgcccggcccatagatggtcttaatatgtgcctaggtatatgagtcatgcagatatctaagaggaagaaactattctgcactattctgggtgacacgatatccacagctctgatgacattgttctctccacacagagaagaaactataaatagaaccctaagcatcatgttccacatatcaaagaaggagatacaaactatttttggaatacaaataaagctttagtaacatgaaataaaacacctgtcaataagagacattaatctattctacaaaaataagaactttttaaaaagaaatatggcctttaatcagagatgatgtaatgacatatcaaatcaatgtcaacaccctgagaaaagccatctcctactgcacaattaccctgccattctcagtcgaagactgtcctctattaaacattatctggacttctttcctttgttttatggagtgagtttataaacgcttgttctccgtaactagtgatttcaagtattctgttttatctaagaagtacaatgaaggtcatgagaagtcctctattaacactttatctggacttgctggcactagtgtaactattttctacaacgttctatttcataactttctagtactgccacagacatctttctaaaatacaacctgttcataatgctcttttgtagataatggttcagtgactcctccctatcgccaactttaaacctacctccttgacaaagcttatctggtgtgcctgcagcctcaccagatacctttcattctattctcttctctcccctccatgcctgtctagaaggccgccttcacctagttaactcctacttgtcctgcaggaaaactggaatggctccactgggaaacagctggatcttccaagctctataggctgagttttccagtacttccttgtataaacctatattatgatacccacctttcaggtttgtaaatctttacttttctgtaccccttctagactatgaacaaggacctgatgaagggtagttactaaaatgttggctgactctaaaggaggtgctaattgcctcacactaaaaagagggtaagaggtgacatggaaaatttcacataaagttggtgccattggaactggatcttgagtgatgaacagtagttttgagatgttcaacagaaagaaagggcattcagatcaacgagaatcaaatgaacaaaagaaacatgaaaaatcacgtgttgcaggcatgtatgtgtgtgctgatatgtacatacatctttctaattactcttcttctgtggtggtgaaggtgcaatctataccaccaatataagcctaatcagcccaactaggccacaaacttattgggaagaaatggtcatttctatgtaccttccccacaggcaatatatagacaaatacaacctatgtgtacccatccctacccagcaccatctaatacatatggtataaagaaatgacactgaaataataatcataaatacctattcattcaaggaaaaaaggtttctatttggtgaaaaacagacatttgagttaatctgttaagagtcctaggtaattaggaaattactgggggaaaagaatcctattactgtaattccttttaaccaagattctatgctacaggatgaagtaaataagccagggaggtgagctgcaacataaatcagccgactgtcacatgagtctctttaatattacaaaattgagggagagaaaccattcagattactacgaagaaacatttaaaatgagctcattaaatgcaaattaaaacagaaacattgaataagcactgggctacaattaaaggctgcagaaacagcaggtaagaaacaattttcattgatcaaagaactaatagctaacagaataaagtattttgcattaaaactgctttcatgaatatgaagcatttcgaagtaagaactcttttttttgcatttttcaaagaaactttggaggtaggaatggatttacatatcttaatacaaagtactttcattgtatcattttcaggcaatgaaactatgaggtttcaaaaaatgcagacttcaaaaacatcctcagaaatagggccaaaattgtaaagggcaaagggtcattttagagcctttggacccaaggaagaactattatataattacataaaatcttctatgcaaaactttagtagagcctatttttgacacaattttacctcattataaacagaagctttggggtacttaggcatagagctggttttcatcaacttatcaaaatggcagggcaaagagcagtacacagtatattcaactagaaatataaattgagactttaaaattcactgcacacaagcttgaaaacaaatatgcagatgtgtagccaaatggtgaagtcggaatatacattcctgatggcaagggactttttctgttgtgttccctcgtttccctggcacctagagcagttaagggtacatagcaggtgctggaatcactggatctgcttttgcaaaactaacgcactataagatgagaatgagaagttttcttctaaattaatttgaaaagttaaaagatactgtttttcatctgtcaagacggcaaaaataaaaaatcttcgatggcacatgggaggaaatgggcactcttatacacactgaaagggagggcagggccaccaaggacagttgtgcagcttgtacactgaaaggcactacccctagggtgagagagaggtgggggaccggagatccaggaggcgttctgctagtgaaagctgagtcagtctcaggaaggacgtcttttggcaattttcagcccagaggggcagggcagctctttactaccatgttgtattagtggaggctttagataggcttgtaaaattgggcaacttattttggaaaaattttgaaatacctaggaaaatgtaaaatctacaaactctttaactcaaattgtcatacgatttttattttacatctatgcttacatgtgcaagtaaaaagatatggccacaaacacttctgacaacagttgtctgtaaacctaatgagtgcttatttattggtaaatattttcataattagtgtatcctataaaagactaggcaggaatcgctgtggagtggatctggacatgcagatatgtaaattctcaaagagatgctaagtgaaacaaggtatagaagagactatgttccaatgaatggtttttgtcaatcaaaaatcttcttaaaagtctaagacactgaatgtgtatttcaatactgacaacattgttgtatatataaccatgcactctaatatctgctgttactcaaatacctaaatccagttctacagaacatttagaacataccacaaatatccccactaacattccattttaaacacaaagaattgctcatttttaaaaaagtcaaaatatatttttaatagaggtaccaaaaattacatttttctaaattgaattcttttaagcttttctattctgctttatatcatcttgaagtccttctccacactttccacaaaggcacaatttttaaccgacttcaattaaattatgtttctgtagctgcctgggtcagggcattcaacacatcaatcacaatgcaggtgggaaatgtaagtacttttgaaacagtcctcatgccaataagggaatcttcggttttgagaaagtaaaaggaaggtacatgtcattagcagtgaggtcacagtcagtcctgtttactcctattctaccaggaaacccatctttacgtttctccttaaactaagccaggatttaaataaagtggcagaatattattcgcagtaaggttgaggcgggaaattaaagaacaataaaattaaaaagaaagagaaataagttttcctgttttaggctaacttgttccagaagcagcaacaggcacagcctagacccaggaaaagtcttgataatattatctaatatgctctggagactctctcagcactccctcaacacagggagaagaaaaacaaattttcctttgttttacagaatgagtttatagactcttgttctctgtaactagtgatttcaagtattctgttttatctaagtagtacaacgaaggtcataaaaagcctgagtaggcctgaactacagctgcctgggcaccacagagaaggttataggataagcctgtgcccaggcaaacctagaaaacgaacatctgggttgcttggcaatggtcatctgcaatcctgtctttgtcctgcctctgtatccctgctttcacgccactgtaagcttgcttcaagctagcccacctccgtttgtgaagtgtgtataaaagtcaagtactgtctttattctgggcccagtcttttggatgtgagtcagctgggcctgagtacactcaataaagattctcctgcttcaacctgaggtctccctcatactcccgaatcccgcaacaaggtgagtgtaatagttagagaaagcataggcctgaaaggagcaagctttgagaagcactcttacctttaacagaaaatcccagatacatactatttacattttagtgatcactggataaagtctataatgtctttcctggctctgaatttttgtcacaaaaacacaaaacccatcactccaaggcttccttttaatggttttcactttcacctacctttagcactgttcacgacacccaaatcccaaactgaccattcagatgtttactgaaatgtggctaatgaggctgggcgtggtggttcatgcctgtaatcccagcactttcagaggcgaatgcgggaggattgcttgagcccaggagtttgagaccagcctgggcaacattatgaaactccatctctacaaaaactataacaaaaaattggcaggcatggtggcacacacctgtagtcacagctactcaggaggctgagatgggaggatcacttgagcccaggagttggaggctgcagtgagctgtgatggtgccactgcactccggcctgggtgacagagacagaacctgtctcaaaaagaggaaaaaaaaaaaaaaaagacgtgtgtctaatttcagaattaggcaatgcaactagttgaatattttattgcacattgtccatgatcttatatgtaaggcacatttcctagggaaagcaggcatggatttaatcatttatgttgtactgcacacttatttgcactatgtaaaaccatggctggagtgagagaaataacacttttaaaaaccaaccttatattctccatgtcattaccagtaattgataactgtttaatcatcaactccaaagatatttcttccttattggaagaattccagataaaactaaacagaactgtccaaacacatttcatcctaataaagttatttatataatcacttattaggtcataacttataactgagtaatgttctttagatcttaagtgcttgtctttatatagctttacaataaatttgtttctcttaaaattatctgtgcactagattaagttaaattaaaataaaatgtatttaactgtcttcaaaataaggtataggctattttcttcctgtagactgacagcacagatattggaaaatctcttctacttggttttctgattcagttcaaacttgtgcttgcaagtgaatcttacgtaaatgtcacctaaaaagagctcaagaagactcataaaaaatatttttttcgtaatttgattaactttcaagtcattcaccaaaagtcagaccatgctagaaagggaagaaaagttggacaacattcttgttttaccacaaagaccatgccagttagctggcttgattctcccactgatggggagaatgtttacattttaacaataacttcacaaataaacagatgtaagaagtgttttcagtgcataaagatcatatactttataaatccacctctcatctttcttctggacagaccacatctgacttcgaacgtacttactgcaatcaaaagtgttttgtaaaggaccctcctcaggaataaacaagctcactaaaccctccatacataacctggagaaacctccacaataatgaaaccccatctagcactgtttttcaaacatatggtgcatttccattaattttcagggatagcccctaaagtaacttttggctcaacaaccctggaagagaggacctttgctcatcttacacatcaagtgttcatgaacaactctgatgccactaagtttcgttcacaaacttgcacctcggtcgttcttttacaaaaaaaaaaaagaaaggttattttgcaaaaggcaatagatttaatcttggctactatttactcttaatgtttctttcatctcagccctccaatgagaagtttaaaaggaaacatccgagggagcaagtttagatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgaggtgaggggcgaaggtgaggggcggcggcggggcgaaggtgaggggcggcggcggggagaaggcttcgggaccccacacggtccgggggaccgcgaacgaggagcgggggtgcggggccgcctggcgtccccgtcgaggcggtcttcatgagaacgctcagagcaggggcgggcaggcgagggcttcgaacgcacacactggggccccggacccgcgtcgctgagctggggagcccggcggcgcgggccggggacggcacgggcactttggccccgtcattgacagttggcaccgggggtcctggtcggccgaggcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcgcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtaagtgatcttcctgaattaaatgcactcgctctgaatcaggggacacgagatttacagaggttggccagccttaggatggactctgagccatgtcctgggtggtctttgccaaaaaaggcagttacttggcaagtagcaaacggtgccccacagtgtgtggggggcaggctaggttgttagaatcttgggcaagtgatgtactctgcccatttataagcaccttcctgataacttatggtttctggaccgcccaaaattactcttaagctatttacacgaggaaaaaagatcccctttacttactaattcctaactagccccactcagcaaagggccttatagaaggtgagttcttagaaatcataaactcttgcaaaatttaacatgagctgatatacaaccgggaacataaactcatgaaataatctataatgagaaatttcttcacttcaacctaggaaattttagaatatcctagcatttgctctaacaacacttgtctcttacaaaatgatgtcatcttcttagagtactgaaagccaacttaatatgaacactgtttcctgacaggccttttaagatgatgtgctttaaacaatacaagctttagctcatatatctctgctactaatacaattcatatttcatctctattatttgtagtaataaaaataaaatattctaagtatcattagagaaaaaagattaaaaatatatacaaatattttagctgtctgcatgatagtatatattttttaaaccttcctatttgttaaatagctttacacttggtatgctaagacagattttgctactgagtaagcaactgtctgggaatgaggcattaaataataaatgcatctttcaaatttgtgtaatttacaccctgggaagatctgagttattacatggcaattcattatgttaaatgaatagtgttgttttccagtgtcacattatttcctttgcttataggttgcaaacctgataacttattcctaaacgacatacttaaaatacatgaatgaaacagattacctatagacctctaggccaggttcccatgtggctatgcaaaacgatatcctaattattgggaagtgtgtcaggtgatttacagtagttaaaattcttggaaatggactaaaattctgcttgttgtaactaattctttttcatggaatttcacataaattggttctcctaggagtcaagatgatgcatttatcagcaataccataaccattcaggttaatcatttagtttttcttctacacaatatttacaattttgatgttttttaatgttatactttaattttttttttactggttggggttcttttctgttttttcctaaacctgtattcataattcttgtatcatattaattctttaatataatcttacacctaaagagatagttctgcaaaatctgatgtttctgtattgccaaatgtaataagtatgcctacatgacttaaaaaaaacattgattatgaagcaggcttctttataaacaacttaattgagatccattatcttctctttttatgttctaaaggaaaatcttgtactagcaatacctctcttgccattggaaatcgtaattcttaaatgcaaacattatttatccattcatctatttattcagtcaacaactgtctctcttttttttttttttaatacccagtgtttgctaagcacagttctggggatttgggatcagcaaagcaaagtccctgcccttagtactccgaggaaaaccaaaataacaacattcaaatcttgataaaagaaggctggacaataccgtttatacaaaataacttcagtggtacaggaaataaaaattttcaatttcataaccaatatttacatttcaccatttttatctttagcagtatagacttctcagcattataaggtgaaaatgtcctcatctctttctgaaggtgtattttgattcaggacgtgtatgccaatttccagcttttcttaattgcaacctcatgctccaagagccaacaccctccaaaccacttttccagttagataagtcaacattccaatgctcttccacctaaaacatgaagaactgtatatatcataaggagttatacagagactcctgatatttctctgagtgcgatagtgatacaagtacataaacttgataataaatatgtttcatcaaatgggctgtgcaagcagaaatgcttatttaaacaatctggatatgagagtgcaagattattgaaaaaataatgataaatgtaaatggcaaaatttttaaaatctcaatgtcaaatatttttcttcaatagaaactagactttctttccatgaaatttttgttgcattctataagaaaacaagcatcacaaaagccctgcaatgaaataatattcaaattcacatttttatagtgcttgcctataaagagatatgagatacacaacttgaagatttcatagttcattttcctttaaaagtcttgtttggggtgtgatagagcccatgaccagaaactagtaacccagtattttgttgtctttatcttgtcagatactttctgtgctgaacaagcttatcacgaagcaagttagaaaatcgacccagggttatggtgacagagaagttgagttcagcctaagctttctattacagctttccttctcaaaagactatagatgctttatgctcaaagtttaggggaatggaataaataatttttttaatattaaaggttgagtattcctattccaaaagtctgaaacctgaagtggtccaaaatacaaaactttttgagtgttgacattacactcaaagaaaactcttttgagcattttggatttcagattttcagaactggcgtgaccatcagtatataatacagatatagtcagctctttgtacagattctgcctccatggattcaactaaccttggattgaaatgtttgggataaaaattttatctgtattgaacatgtacagacttttttttttgagtcattattccctaaacaatagagcatagcaactatttatggagcatttatattgttttagatattataagtaatatagacatgatttaaagtatataggtagaaatgtgtaggttacatacaaatactacgccatgttatatcagggacttgagcatctgaagattttggtatctgcaggaggtcctggaaacaattcctcatggagactgagggatgactgtattccaaatttgaacaaaaaacaaaaacaaatccaaaacacttctggtcccaagcatttcagataagggatagttcaacctatactttacatgtatagtgtgttttatatttaccaatcatgtgctcatttaacacgtagtggtaatcatcaatatttataaattatatattaaaatattaatttggcttctgtaacactgaccaaataacaatagcttaattaagatggaagttgtttctctcataatagaagttcaattttgtaggcaatcccaggaggttgggcagcattccccatgaggcaggtgcaggggcataggagcatgtttgttctttgcatcctgtaaaatgacacctgagacaaggggggctcgagaccaccagggtcaaatacctgccctcaagaaggaggaaagtggaagcagagagcttcccattatgtgcatgacccagacacagcaccccactttcattctcatccaactggccagaacctagtaataaatacacctacattttccctttttgcaaaagcctatgaaagcttgacccatgaagcaactcccaagcccacgtacctgtctcctcaggaaaaggatgaaggaagctatgtagttccaaaagggcatcatctccaacacctacttcaggtggaggagagaaaaatgggtatggagcaatctgcaagaatgaggcaggaagaaatgaagagcaaacagcttcactatgagggcatgtcccagaaacagcaatcctcactcctgctcaaatccattgccaaaacctagtcttatggccacagctagttgcaagagaggctgggacatgtagtctttaactggtagctctgtgtccggctcaaactcacaatgttttattactgtagccaaggaatattgggggataattagaagtgtctagctccagtgctaaatgtgctacattattagtgaagaaaaggagagagacaagtaaaataattacaatacaaataaacagatgtctctggcagagaagtactaatgatgaagggaccaagtggcgatgaactaatgggtgccctcatcaccttttgtctaggcttgtacaatatcatccacctatcaattggttgactccctcaatcaattatcagtacaattacactaatctttctggtacaatgttctgctcctatcactattcagagcttttggagcttcccaattcttatagaaaaaaagtcaagatacttccccagggccagcaaggtcttgtgtgatctaatcccattctgtgttctaaaatttcatctcccactgttctcatttgcttcagtcaatctgaaccaaggaaataaactcatattctttatttttgtgtttctgtttatgttgttccctttgctcgaacacccttctccctacatatctgcatatacaaattcattctatcatcaggtaacacatatctattgatcacagactatgtgcaaagcactgttttaaatgctaggaatttagcagtcagcaaaagacagaacacatgctgtcaagaagcttatatttttgtggccagcaaaatgccaactgctttaagaagacttctttaattctcccttcctgtcacccacatagaaagttatcctttattcattgtgttctactttgtattatggtcatttctgctcatgttttatctccttatgtaaattctccgtgagggcagtatccacatctaagtcactttttaatcttaaccagaacctaacagtgtattcaataaatatttgatgaatgaaggaaagcaattctaccctttcttcttatctcatattctcctactttcttattataattgttatttgtctctattttgaatttttttaagccatcctctctaattgtggagcccagaagctccctttaaaacttgagaaggccgaatcatggcattcgtcacctcaacccctcaggtggctccctgcctcactcagagtaaaagctaagcttcctctattgggaaggccctgtgtgatctgcccacccttgctgctttatgcaactctgctggccctgcctccggaactcagttagtgccacgcctttgcccttcctgtttcctctgcctgaaatgcattttaccctgtgtgtcctcatctcttgatgcttcaaatttctgtttaaaaattagctatttagtgagcctcttcctgaccactctattttaaacttcagacccttaacaatcccttccatccctgctccagcactcccatctcccttccctgttttatatttttccctctaatattaatttagttgagcctgtgtttttcttctaccagagagtaagccccagaagggcaggaatttgtttatttcacccattgctgcatcctcacctcaagaaaaatttatggcacatagtagctgccatttatcttattttgatcagttgaattaatgaaagactatattttatactataattagacaatcatcttcaaatcagtggctccaaagaaaatgccaatgatgttatatagatattaaatctagaaatgagaataatttgcagctgttttatgcagtatcataaaagttacacatgttcattgaaaaaagttaaagtggtttggcttagaaaagctttttcctgtctaagatgatgagaaaaaattcagtctttttttcctggattctgttttacttttaattttttattttgaaagtttgcttcaccttaagtcattttgattttggaaggtataaattttgacttattttccctaaatggccagagaattgttacattaccctttatatacttaaattaaattatatcaaacatcttcctatcaaatttaggaattcctatccaatttaaataatatatcagtgctgtttttattatttcaagtaactttattaataattgattacttaatgtcatatatttattctttcatatataatagggctagtgatcttcattccatttggcttttccaaccaatcttatgaaaaggcagagtagactgtgtttttccacttaatgtataaatctcaaacaatttactattttgtggttgtttagagatacttattaaaggatagagcaaggactggaacctagatttctaggtttttcttacaacagttctctcacatattgtaagtgaatcacttggtgaatatcaaaccaaacacactgatacaaccaacacccaaatccagaaacattgtcaacaccacagaaccccatctgtctctttgtagtcactacccaacattcccacatgctaaccttcttctgactttggccaacagactagtttcacctgtttttgtacttctatacatggaatcataaagtatgtaattgttttgtgtccagtttctttcatcaacattctgtttgtgagattcacccacattattgcatacaactatagttgtaagtaaatccttcatgtttatccctgtctagtattttcttggatataccataatttatttatccatcgcttcctcgatgggtatttgtgtgacctccaatttagaactgttacaaatagcactgctaggaaaatttttacactttttttggagaaagtatctacgcatgaccaaggacatatttctgggagtggaattgctggaccctaagtcatgcttgtttggctttagtaactaaactaaagctgttttcccaactgatttttcaaatttaaactctttccagtgctatatgagagtgctgtttgtgctacagtctcaccaataattaatattttctttattttgcattttaagtattccagtaggtatgtaatgttatatccttgtcatttgaatattaattttattgtgactaatgaagttaacaacttcttcatatatttactgtccatttggatatactctttattgaagtgtctttttaagacttttgactgtttttctcttggcttgatttggttttttatttatttgtagtacttttttccatctatattctaaatgatatgaggcacttgtctagtattgtatgtattgcaactacagttacccactctgtgagtttcctttccattctcaataatggcttttattgctctttttaaagttacatactttgtgaagaaaaatgtttacctcaaacatacttgtgtatttcttcataatgtttcctcaaccagtttcaactagctcacagtgaaatacatatacattaagacacatgacttggaaaataaattggagcgattggaaatgaaatagaataaacaacagagaaataataaaataaagtgtaattaaagtagaaagcttgggctcaagaaaagaagcatcaattttgtcattcataagagtcagtatatttatcaatggatgttcaaatttaattctgagcttcttggcatctgttgctgaaaggagaacattatacacatctcattatcacaaaaggagaagcccatcaatccctatagggaactgaagctttctctacactgaactctctgagaaattggtcatgtcacattttaaatacatgcaacataccatatctacatttttatcttttgcaagaaatgcagtgaaaatatcatccacaaaagatttcagtgagagctaagtacacgttattaaaatgtatcttggcaaattggattttgcctgatattaaattgttgtagtacatgtacgtagactttcggtggtccaatttgatctggaaatggaatttacagtgctcacagaaatgtgtagattgtatatattttagttattgttctcagttcatttcatgatgggagcaagatagctgcgtttttgtagttggcagggagaaaatgtgtaatatgataagagcacagagctgaacgacctgagagggtctgagtccaggaaagtttcctgaagggaatcatgtttggtgaaatataacagttgagaaggacctaggggagtgtgcaaaggctgagagagaccaggctcccagctactgtggttttcaatcttattttctgcctttttttttttgccataaataattatgttgtaagttctattcattatatacatgttaaaaattatttagattgcatatatattttatatattttgagagcatatagagtgtatatacctacctgtatgtttgtatagattgcaatgtacataattataataccttatatggaattttatggattccttctaatatgctaatattttacatgttgttgaaagctcataagcatttaaaaggcttcataaaattctatgctttgaatttgtcataatttactttgtctttcacttaggttgttttcaagtatttactattagtgtatacatagggttgaaattagtatctttctataaaaagttttttctgtattttacagtatttccttgaaatacaatttctgaagtagatgtactgggtcagagagcttatcaatcttaaaaccccaatcaaggttttattaatactgccacctgctgtgcttgaatgtgcctattctagctcctcctgtggcctgcctaaggggcttttgacttcccggaccttgcctgctgtctacctcctcatctgccagtgttgagggtcaggatctcagcacctctgaaacctattcatgatacaaatgagggggttgcaaacatctaaggctgtagttctcagattgcaaattgtaatcacttgaaagattcccatttaattcttctaagtgttctggggttgatttaattagtctttaattaggggttgagaacatctgggtacatagtatgatggggaagatctcagaaaactattttctagatggctactcaattttcccaaagacatttattatgtaatattttattccccattgctttgtgtgttctttttctttttgtgtgtttcataattctacataatagagatatttgagaggaatttttaacgaatgtccacagttttaattattgtggtaattaaaccacaacttggtaatatgttttagaaattggtggggctaatttatcctgttaattcccagaatgtttattttaaattttaacattttaccggtttaatcttccaaatgaccttttaataagatgtaaagtcgaacatcattttgagttggaaatgatcatataactcactagcaaataatgatcattgtataacagtcttcacttatagtaatataatttatcattccatgcttataggtatacattttcctaataaatatttttatatttattttataccaagccatctcactaaccaatgttttcactgaattgcatgtattttattttaatcatgttcttctacattttgaaaaatttaaatctacaaataaatatagaaatagaaaaagaggcatttattcaccatctagatttaataaacaatatttttaattgtaacattatattcttataagtaaaacaataacctcactaagagagccacagcttaatttgtactctgtcctttcattcctagaggcaagcaggatcctgaaatttgtatacattattcctaaatatgcataatgaatatatatgtattcgtatatcctatagatagatggatacagagatagatgcagagatatagagataatagaaattcaagaactgttcttcaggttactttttcatctgagctatttggttacagtgcaggtttctgtaatgccttcaggtcatattcagttcattaatagcagaatgctatcagtgtacgtaagacgttcagatgtgactttccccatcttgttagtattttgtgtcacaaagtaacagcaactgggtacaaattatactaacacagctaaatgcagagtgacacagagtaatagtgtcatagattatacctgtttgctatgggttcttcttcctagttctgtttgtgcacttgctcttggaagcatctaatgtgaggcaagcccaatctttgtagatccttacaatgtccctatcattttttcaaaaggcatagcactatactgtatttactccaatatttcatttttaaaggtaaggaatgtaatattttaactgtggtagttcattttaattagaatgattattaaatgctctggttacaaagttgcatgtatgtatagagctttgtaaacattattttccccataggtttccccatacactttgatatttctagttagccattttgttaaatggtggttctccaggaatgcatgtcctgttaatagcaaatttgtttacctgctatgtcatattccattgtgtgaataaaccagctttttagttcattctcatactgagggtccgttaggtttctacattgcagtatcataacatcctattgtaggattccttgtgcatgaaggccaaagttcaccagatttggaattgctgaaagatgaggtataacttcaactttaatagagtttgtcaaatttctcttcaaagtagtatataaatatttatattgtgaccaacagctaatgagaattcttttttccaaatgcttgtttccaagatcataaattgttggtatcagactaaaattgtaccaatctgaagtatatgaaataatatcttgttttaattttgcatttctctgattactagtggtcatgtttcctttttataggagttttatcatgtagatttcttcctctttagtgtgcatattcatagcctttgcccattttttctgttacattgtcagtccttttgttattgacatatagctgtacttaacatactctagatatggatatgttctggatatggtatgtacatattttcttgcagttagcgacttgtctttatacttatttttacatctttttaatacataaattttaaatttaactttaggtatttatacttatcacattcttcctttatggttttggtgtttttaaaaaatttttgtcggccaggcgtggttgctcacgcctgtaatcccagcactttgggaggctgacgcaggtgaatcacgaggtcaggagattgagaccatcccggctaacatggtgaaactccatctctactaaaatacaaaaaattagctgcatgtggtggcaggtgtctgtagtcccagctactcaggaggctgaggcaggggactcacttgaacccgggagccagagattgcagtgagctgagatagtgccactgcactccagcctggcaacagagtgaggctccatctttaaaaaaaaaaaaaaaaaaaaaaattgcctagtttcaaaagaatttttttgatcctaatattgtaaggtttcttctatgtgttttattcttataatgttcacacatacattgttaattatttaactgcaaatttacttttaagatgggaggtaaggctttcttttgatcttttccatatggagagccaccaagacagtaccatctatgaatactaactgagtactctgtattatgtcccattagtctctttgtctgtctctgaaccagtatcacactgcctttattgttgtagctttacaaattttgtatttagcgagatgagttcccccaatttgtttatatcctagttgacgtcgttgctttcttactatctataggaattttagaataagcggtcaagtttcatgaaaatttccttggagattttaactagaattttattcaaggtgcaatttgtgggacaatatcaatcatcttttttttttttgagacggagtcttgctctgtcacccaggctggagtgcagtggcgtgatctcagctcactgcaagctccaccttccgggttcacgccattatcctgcctcagcctcctgaatagctgggactacaggcgcccaccaccacccccagctaattttttgtatttttagtacaaaaaatttagtaacacccctgtgttagccaggatggtcttgatctcctgacctcgcgatccacctgcctttggcctcccaaagtgctgggattacaggcatgagccacttttttttttttttgagatggactcgctcagccacccaggctggagtgcagtggcataatctcagctcactgcaacctctgccccctgggttcaagtgattctcctgcctcagcctccaaagtagctgggactacaggcccgcgccaccacgcccagctaatttttgtatttttagtagaaacgggggtttcaccatgttagccaggatggtcttgatctcctgacctcatgatctgccctcctcagcctcccaaagttctgggattacatgcatgagccaccacgcccagccatttcaattttttatattcttaatttgctaagggtgtttttcttaattggaagtagtattgaattttatcagacacttgctgcatctgttgtgatgattataagatttgttcctcttcagtctgttaacgttaattatgtgaatacatatattctaatgctgaattatccttatattcttttacattatttaatcatgatgtatttagcttaaaaaaacaagcataaattattggtgtctctgatttaccaggcagcaaagtccttcctagtgatccaccacaaggtgcttttgtcatatcattccaagatgaggtactattgctagggtagtcttttcaaaactgtgtgttattgctagggtagttagtgtcttcaagatcaggtattattgctagggtagtgtcttagtaggctgggtctgtcataacacaataccatagactgggtggcttaaacatttatttctcatggttctggagactgggaagttcaaggtcaaggtgccaccattttggctcttggtgagggctctcttccgtgcttgcagatagccaccttcttgctgtgtcctcacatggctttcctccatacatgtttgtgaggagagcatctctctctctctctctctctctttcttgtagagccactaatcctggcctaaaggccccattctcaagacctattctaaccctaattactacccccaaagccccatcttaaaatacttcacattagggattagagcttcaacacattaattttggggaacacaaacagtcagtatcaggtaagagatgggattgctgtgtttggctcatctgtcaagactggaagaaggaccatctcttggagttcttggctgccagaatgaaacaatatttctataaactaaaagaaatcaaaaaccttcctttggaaagaaaactaaatgtgtgtaccacatttgcattctacaaaaaatatttattagattttaatgatttttttacatactcataatttttttgcagtgagaacagttaaatctactctcagtgattttcaagaatgcaattcattgtgattaactatagtcaccatgttgtacaatagatctcttgaatctatttctcctatttaactaaaattttatgtcctatcaccaacatcatcccaactccctcatctcccagcttctggtaagtacccttctactctttgcttctgtgagtctggcttttctagattccacgtatgatatggtttggctgtgtcctcacccgaatctcatcttgaattttagcttccataattctcacatgttgtgggagggacccagcaggacataattgaatcatggggagtggtttccctcatactattctcgtggtagtgaataagtctcacaatatctgatggttttataaggggtttcccctttcatttggctctcattctctctttgttgccaccatgtaagacatacctttcgccttccaccatgattgcgaggcttcttcagtcacgtggaactgtgagtctattaaacttctttttctttataaattacccagtctcaggtatgtctttattaccaataggagaatggactaatacaacatgtaagtgagattgtgtggtatttgtctttctgtgtctggcttatttcacatgcataaatattctccaggttcatcatagtgtcataaatgacaggatttctttttttttctcattccctcaagcacttactctttgtgttacaatactcttgtagtagttttaatccttctctttttaaggctgaatagtattccattgtctatatatgctacactttctttaactattcatccattggtggatgcttaggttgtttccataccttggctcttgtgaataatgctgtaataaacatgagagtgaagctatctctttgaatactgattcaaagagaatagaaagaagatattcaaagaatatcttctttgaatacaggttcaaagaagaaaagtggaattgctggattatatggtagtttaaattttaattttttgagggacctccgtactgttttttatagcagctgcaccattttgcattcctgccaacagtgtgcaagggttcccatttttccacatccccacaaacactagttatcttttgtctttttgatgataacggttctaacaagtgtgaatatctcattatgcttttaaattacagtgccctgatgattagtggtactgagcattttttcatatatctgctgggcatctgaatgtcttattttgacaaatgtctattcagtccctttgcccactttaaaaaatttgttcttttgctattgagttatttgagttcatgtttttcttttactattttgggtaattttaaacaattattttcattgtaaaagagaaaaattcttatgtagagtcttaagaaaatacataaaagagaaaagataaatctcaaatctcattttttagtgttaatcactcttgaattattcccacatctctacatgccttttttgtttgtagaattggagtcatatcatacatatatcatactatattttacattttagtatgaccaatatattctcattgctaatttattaatgttttttccttgattggatttatttatgctttggttttctttgtatgctatctctcgaactgacataccaattcttccagttttgataatggatttcttatttctactctcacatatttttttcttttgctttccattattaaacttttttactgagtttttgaattatttatttaatgcctctttttaacagttttattgagatgtaattcatatacatataattcactcagttacagtgtaacatacagtggcttttagtatattctcagagttgcacgtatatcaccacaatcaattttgaaacattttcctcatgctaaggaaaaaaaacccttaattatcatccaccaaatggcttattggtcccagctctaggaaattgttaagctattgtctctagaaatttgcctattctagacatttgtcttttgaaatacttttgtttgtaatagaaattattgttcttgttatttaaaagatatgtaattgtatttttgcttccctcttttatatggttgttacttatgaggaattatttttcctattggttggggctttctgattatggtttgattatgattttaaaaaatacaattgttgcttgatggttatttagtttctacagtctaagctgcttgaagtttattagagttttggtctagaataggatcattttctagaaatgttcctatgaaaacttgaaaaaaagactttttttgtctgtagttattctggatcattaaatgcagatcatttgtttcagtgggaaagatatcagagacatctatataaagatattattcctggctgggtgtggtggctcacgcctataatcccagcactttgggaggctgaggtgggaggattgcttgaggctacagttcaaaaccagcctgggaaacatagccagacccccgtctaaaacattttttaaataagccaggcattgtggcacataactgtaatcccagcttcttgggaggccgaggttggaggattgcttgagcacaggagaccaaggctgcagtgagctgtgatcatcactgcactccagcctcagtgacacagcgagaccccatctctttatatatatatatttcataaatataagttgtgtatagtaagaatttggtcagtcttaggcatatttgaaataggtacataagttttggtattcccttctgtttattttctatatccctatttagtaatccataaaaaattgtttaaagattttaaaaacatgactcactgctaaaaatcaaatgatatcatgtaatgtttatggcttttgtgattttgatcagtaagtagaaaatgcaaaagaaaacaagttataaacaataatcagaaaacaatggagaaaatgtcatcaaaatgtattttttcgtctttttttaaccatatcacagaacctagcaaattcatgtttcaggagctctgaaaatgacctgacaataggtaacaatatttatttatacttccttttgggcccagcattctagactttttctatgttatttatttcctggaaaatatatatttatacattcaatggataactttcatatttaatggccttaaaatgaaattttttaaaaagattcaggaagatatatatcattttgcttctgcttccttagtaagaattgacttaaaaatccatgtgccatatatacactactgaatagccataaaaaggaatgagattgtatcctttgcaaggacacagatgaagctggaagccatcatcctcagcaaaccaacacagacacggaaaaccaaacactgcatgttctcactcataagtgggagttgaacaatgagaacacgtggacacagggaggggaacaacacacacaggggcctttcgggggatgtggggtgaggggagggagagcatcaggacaaatagctaatgcatacggggcttaaaatctagattttgattgataggtgcagcaaatcaccatgacacacatatacctatataacaaacctgcttgttctgcacatgtatcctggaactttaaaataaaaataaaaataaaataaaaatctctatgcgacattgagggagttgtgaggacacatacttgaccagacagtggtcttatattggtgaaaagcacatcaaggtttaataactaggatgactgctgattttgtagtacctagaaaataagacaagagacattgagatttaatacttgaggtccaacaactgaaactttcaagcctgtgtgaggtaattagttagtctgtggtagtgaagaagtgttctgcttagggagagatttatttttaagttttttgtgtatatggaagaatcatagcctaaacacaaatttaagatattattattcatgaatttgcttctttttcaaagttactgtcattttgggaaaaaagtgtaaactgataatatcatacataataattatgttgtataaataataatttatattttagaattatcttcctaaaccagttcaagttagccattgatgtgacatagattagagaaagtaatactataaaaaaattatgtaataaatgccaaataaaataataaatacaagatagatcatggctaactaccttacttttgtggtttttgcttagaagaaaatctacagagaaatatatttcacaggttgtctattctaaattaaagtagctatgaataaatagtcccagagataagcagtaaatcctttaccaaattttctgtgtcctgcaatttatattttaaggttattttgcatgataaaactgtaacattgttttaaaattgagtaaaatgacacagtgttaaatattttcacttgagcacaaaaattttttgaatataacacggtatttaaatatagtttagaattttatatgatgtagtgattatagacagaacagtaacagttgtataaggtaaatactagtaactttaaacggtaatgatggatgcctctgtttatggtttatttcccattgaaatttcttaaggaaatgttatatttgctgatgatttcactagatggtacacacattcacacaaaattatcttctgtcattattaggagtaaatatgaagacgttttaggcagtcatcaaatataacttttacatacaaagaatgaagcataaatagccagtgtcttggtctcccctcccctcggtgctttgcacagtgtcatagacataggagatgctcagtaagaagtgttctggattttttaattctagcttagtgtgtgaaagtgattccgctcagaatgtccatcccctgttttacatttctttcatattcataacttacaggaaaaaagaggtaattaattgactaggatcttgcagatatataaaaggacccttctctgtatcacacttggccttcttatttatgtgcagaatttgattgatttgaaacttatcaacacttgatactgcaacaaattgacaagaatgatgttttagtaaaaccaaagaaaccagaaatgttgggaggtgtgatgtttaatactgagtgctaattggattgaaggatgtaaagtattgatcctgggtgtgtctgttgctaaaggagattaacatttgaatcagtgggctgggagaggcagacccatccttaacctgagtggcacgggttaatcagctgccagcacggctagaatataagcaggcagaaaaatgtgaacagagagactggcctagcctcccagcctacgtctttctcccatgctggatgcttcttgctctagaacaacatcggactctaagttcttcagttttggaactcagactggctctccttgctcatatatatatatatatatatatatatatatatatatatacacatacatatatatgtatatatatgtatatatatatgtatatatatatataactataaatatatatgtaaaactatatatatatataactataaatatatatgtaaaactatatatatatatatatattccattagttctgtccctccagagacccctgactaatacaggaggttatcaaaagcatgtatcagcaccagtacactgggtatattagacaaaattgaaatgcttctagtgacctacgtagtacaaacaccaagtttacccagagctaatgcagggaaagccagaatcaaccaatcaaccagattgagcgagccaggataggacttaagctgaccaagacagaggagacagtttaaggtgatttcacatagacaataattttactcagaatccagacctagatcccaaggtaaactaagatccagccaagagtattagtaatgggagacggggctcaggaaatgtagagattcatcttaatccacaaatatccttaaaattcttagtctcccattaggagacacctgggctaacatcatattttctggaaagaagggagaacattctggagtgcagatgataagtgggctaaaaaatgatttcagactgctgtgctgatgttagcacttttcataacaatttaagttttactattctaaaataattaattcaacctattaattttactctatggttttttaaccatagatctcacctctctaactctagtcaatcactcagtgataagtggcatttgtcattaaagaaagtgggttggagtgaatctgctgaaacgtattaaaatattggaaaaccaagtcagaacttgtattcagggccggggctgtggctcacgcctgtaattccagcactttgggaggccgaggcaggcagatcacctgaggtcaggagtttgaaaccagtctggccatcgtggtgaaaccccgtctctaataaaaatacaaaaaaattagccaggcgtggtggcacctgcctgttatcccagctactcgggaggctgaggcatgagaatcgcttgaaccccaggaggcggaggttgcagtgactgagatcggaccactgcactccagcctgcgcgacagagtgagactccatctcaaaaaaacaaaaccaaaccaaacaaaccaaaaaacttgtattcagtttatagtggaaaatccatatcatcaattttccattgtcagatttgaaaatctcttctcaaatcaataattattttctaaagtatcaatgagattcacgcacacagttaacaggtaaagtatagaaaatggcttttctgaacctatcaatccctgaccgcagcctactcccctcccccaggttcacatcccttcacctctaccacatttaacccttttttatttcaaatattaaaataaaaccatttcaaatctctacgtattatgcttatactactacttttttcaaaagcttaattgaagtatcaacaataaaccatatatattatagaatgtgataagccttgacagcaatcaagataatgaatatattcatcccctctttttaatccctcacactcactccttccccccttctccagttagccaatgatctgctttcttttactatcaatgagtttgcattttgtagagtttacataaatcaaattatacaggatgtattttctatggatctttttagtcatcagaattattttgagatgcattcatttgtatgtaatactttattcctttttattgctggaaaggattccatttatatggatatagcatactttgtttaaccacctgctgttgacttgggtggtgtccagtgcatgattgttaaaaacaagtacatactctgaacattgttgtacaagtatttgcatggatgtatgtttatctcatttggctaaatatctgaaagtggactagctgcaccgactgtcaagaaggtgagaggatcaaaactccaccatgtcagcttttcctcggctggcacatgaagttattaatggcaataacaagaatatccttgccatccctgagacatacgaaagatcttacagggatatagtttatacttattacagagtatgtataatcctgcttattacatgaagatcattctcctggggcacaaaataaaaggaaacatatttctttttttatttttttgagacggggtcttgctctgtcgcccaggctggagtgcaatggcgtgatctcagctcactgcaacctccacctcccgggttcaagggattctcctgcctcagtcccctgagtatctgggactacaggcatgcaccaccatgcccaactgattttgtattttcagtagagatggggtttcgccatgttggccaggctggtctcgaactcctgacctcagatgatctgcccgcctcggcctcccaaagtgctggcattatagacgtgagccaccgcacccagccaaggaaacatatttcttactgtaataagtgtaaactgtatcactgaatatagtaatactttcatattatgggaacattcaccattgatttatatatgctattaaatacatagtttctatagaagctttattgaaatgtcatcagattatgaaaaccaaatccccataatttttccactcatgtatatttacatttgcattcactgtctccattgttgattacccaatgtgtactgatgtttctccttacaaactatgatagtacttaacattttgcttcatttgttgatactgatttgttccgtgtacataaaacttaaatttatgtctgccttcacttattttctttcaaagataccttaggagtctttcacattttataagaaaccataaattttatttcagccttaggccaaccgctggctttcttgccaacctagatgcatatatgcaatttagtctgtgagttttgaaaatttgaatgatagcacattaaactggaataatgaaccaataaaagtttttatggcatttggaaaaattacttctcaaacattcacactgtcattttactcattaaaattattctaggatcataagttagaccatgtattcctaaggcttgaaaaatcaacagattatttctaatgatcattgatttgacctgactgcaggatgataaaatcttattttggaaagctagactaggcatttgtaattatattttccatcttcaactaatagagtaaaattattggaaactctttaagatagtgtccacaatgctgtttacagtttaagtgctatgatttgccacagttattatcttcatatagtcactgccagtgtgtgacattgggtttcatcagtaaataagactactgccacaacttcagagggttttcagagagattaaattaaatgttattgtgaagtacaaggtacttgctcagcaatatggaagtcacaggtattatgtgctcagatggtaggtagttttgtatttttcacaaatctattaacatataattgtcctgtcctataaaccagacctttagggattttataggattctaatctttttcttgatgctttagccactagtggtcgtgagttacgtgctcaggaaggcatgtgaatgcttatgagtgagtaaggtactattcatgtttgtctaatgacttcattggcctttaccttcgtttacaaatgcacttaattcaataaggaagagtccttctcctgaaggttttacactagtcaaagatgtttccaagccatatacattatttttatttgtgtttatgcatatgatacaagccattttagaaatgatttttttttttactctttagaaagcacttcagagttagcataacatctaaccatattggtatttctgttttctgttataatgagtgaggatgatccttatttttaaaagaagtaataaaaaatcaaagaagaaaaaatttcatatctaagcattttagattataatttggcaactgtgcattaatccaaacaaatagagcctactgagattattcatgttcccattagtcactcacatattggtgtctaattgtcatttgtttctgctgtaattcagttcaactgatgtaattaaataccattcatctagcagcagttctgaaatcttttttttttgtaagacatgataaaaagtatgagttttctataaaatcaagtttacattcagttggaaattttccttttaagttcttattctcaaacttaattgtcaatatcaaatagagcttctcagatgagggatataggctaatttcaaattttctctgaactacaaatatgctcttcattttctctagtctaggcctaaattgctgtgcttgcatttgtaatcagaaattgattgtgttactgtggaaactggaagagtgtattgctggttaaagaaaaatgtggtagaagaactgctgttattataattgtctgccatcttaaatgcctatcattttgaacaatacattgataacattttcacactccaaccccaaaatgcttctctccagaacactgctttgtggtcagtattagtcttctgtatcgatctgacataaaatgccttggtcacatttctaatttgtttctatgttgaactataatttttacatggaatgaaattagtttccattttattcatacttacatggcacatcttagggaaaaaacatgaagtatggtaaaatatcagttatttagaagccagtcatctgaaacatttcaacttctgaccaagaagacacgaaacaagttccaaaaattcagatgaagaatttttaacatctgatgctaaagacagcctcgaagaagcaaagctctattttacacacatacacacacatgcacacacacgcaaagcaatattatgcattttactgtgtgaaagcaaagatgaactctgtttttaaaaagtttgccttttgtatatgagaggcaagtatgtgaagactgaccaaaagaatgaagaggaaatcaaaaccaggaagaggaaaatgaccctcagtagaggcaagagttgggggagttaggattggagatttccagcacatattctgttggaccagtatccagtaacatcaagttcctggaattttctggaggtttccattgctttcctgattgtgacaaggacaaatgcagaaaattatctgtgactttatagtttaattaaaatattcccaaagccccacaagtcttgtcttaggaaaccaatgtttcccaaaaggcatcaacctgctgaaaaaggttaacagaacatagcatctatgtactttaaaccctggctgaaaagagactgaatgtggtggcacactttagctctagagtgttgaggacgagaataatgttgtagttactttagtttgattttcgtatgtagtaccagacactaaacaaatctgctttagcagaaaaatattaaaatacataataatatgtgtgacatagtctaaataatgcattgcctgtttaatgtattgttgagatttgtatgctagctctttggatcctcctggcttgggttcttcattccaccatatactttatttttctttaggcttttatgtatttatgtatttatttatttttatttaaaacttattaatgttattttgattcacaaaccataattctatcattttgggggcacaatgtgatgttttgatatatgtatacaatgtggcatgattaaatcaagctaattacatattcatcatcttgctcaccatttcttatggggagacacttgaaatttactctcttactttgaaatacataacacattattattgattatagtcatcctgctgtgcagtagatctcaaaatatgtttcttctttctacctgagactttgcacccttcgatcaacaactcctcattccctccctctccacccccaccccacctcagcctttagtagccatgatacttcctacttctatgagttcaactttgttatagtctacataaacctgagagcatgtggtatttttctttctatgccctgataatttcatgtagcatagtgtcctccacattcatccatgttgttgcaaatgacagcattttgctctttcttaaggctgaatagtattacatttaatttatatcgcaattttttatccatttgtccattgatgaacacttaggttgattccatgtcttgactattgtgaatgatatggtttggctctgtgtccccacccaaattcatctcgaattgtaatctccatgtgtcagaggaggaacctagtgggagatgattggatcatgggagataattcgatcattcccccatgctgttctcatgatagtgagtgagttctcatgagatctgatggcttaaaagtgtgtagcttttttcactctctctctctctgtctctttcctgccactatgtaagacatgccttgcttccccttcaccttctgccatgattgtaattttcctgaggccttcccagccatgcaggagtgtgagttaattaaacctcttttctttataaattacccagtctcaggtagttctttatagcagtgtgaaaatagactactacagtgaataatcctgctatgaacatgggagtgcagatatctctttgacatattgatttcagttccttatgatgtatactcagaagtgggattactgggtcatatggtagttctgtttttagtttatggcagaatcttcataccatttctcataatggcaatactaatttacattcccctcatcaatatgtaagagctcctttttctctgcatcttccccagaatttgctttctttcattttttgatacaagccattctaacaaatgtaaggtgatatctttttgtttttaatatgcattttccaaatgattagtgatgctgagaattttttcatatacttgtcagccatttgtatctctttttttgagaaatgtctgttcaggccctttgtccaatttttaatcaggttatttgttttcttgctttgagttgtttgagttccatataccatcagatgtatggtttgcaaatattgtctcccattctgtgggttgtctcttcggtttgttattgtttcctttgctgtgcagaaactttttagtttgatgccatccatttgtctattttgcttttccttttattgcctgtgcttttggagttatatccaaaaaataactgcccagaccaatgttgtggagcttcctcccagtgttttcttctagttgtcttaccctttcaggtcttatagttaagtttttttttttatctcttttgagtgatttttacatatgatataagagcctaattttattcttctgcatgtgaatattcagtggtctcaacaccatttattgaagagattgtattttccccattgtgtgttcttggtacctatttcagaaatcagttcgccataaatgcatgggttttcatgtctgtttttatggcagtacaatgtcattacgtcaattttttggaagagttggagaagtattggtgttagttctttaattgttttgtagaattccacagtaaagccatccagtgctgggctttcctttggtgggggacttttacaggcatgtaaaagtcttattcaatctctttacttactactggtctgttcagatattctatttcttcatgattcagtcttggaaagttctatgtgtctaggaatttatccgtttcttctagattatacagtgtgttggcatataatttttcatactggtttcttatgatcctttgtatttttgtagtatcattcgtgatgtctcctctttcacttgtgatcttatttatttgagaaagctttcttttttttctaattcatctaactaagggtttgtcaattttgtgtatctttgcaaaaacctgttagtttggttgtttttaaattatcttttagtttctaatttgtttattatttattctctgatctttgtcattttctttcttctgctaatttagtggttggtttgtatttctctttttagctccttgaggtatgacattagattgtttatttcttctttttcttcttcctcctcctcctccttcttcttccttttcctcttcttctattttttgagacagagtcttgctctgttgcccaggttggagtgcagtggtgcaatctcggctcactgcaacctctgcctccctggttcaagtgattctcctgcctcagcctcctgagtagctgggattacaggcacccgccaccatgcccggctaatttttatatttttaagtagagacggggtttcaccatgttggtcaggctggtcttgaattcctgacctcaaatggtccacccaccttggcctcccaaagttctgggattacaggcatgagccatggcacctagccctttcttctttttttgatatgaacacttatcactataaatttccctttcgggactgcttttgcttcattccatacgttttggtgtgttgtatttccatttgcatttgtctcaaacatttgtcacaaaatgtttttttttaatttcctttttttatttcttctgtgacccagtggtgttcaaggagcatattgtttaatttctgcatatttgtgtatttttcaagattttttctcatccatttcttgtttcatgccattgtgatctgaaaaaaatacttaatattatttcagtcctcttaaatttgttaagtttggttttgtggcctaacatggtctatcctgaagaatgttagatgatcacttgagaaaaatgtatattctgctcttgttggatggaatgttctgtttatgtctgttagatccatttgttttaaagtttaattcaagtccaatgtttctttattgatattctgtttagataatctattcattgttgaaagtggcgtattaaggtcctctactattatagtattgcagtctttcttttccgattatttaataattgctttctgtatataggtgctctaatattgggtgcaaatatatttataattgttaggtcttcatggtgaactaacccctttatcattatgtaataatcttctcgtcccttttaataattttttttacttaacgtctactttgtgtgttataagtgtagctacttctgctcactttcagtttatatttgcatgaaatatctttttccaggcctacattttcagtctatgtgtgtcatgactagtgaagtgaccctcttataggcagcatgtggttggatctttttttaaaaatttatttagattctctgagtctttctattgggtaatttaatccatttacatttaaggtaattattgcaaggtaagggcttgctattgccattttgtaaattttttttattgttgttttgtagttccctttttactttctctcttgctatctttctttgtggtttgatagttttctgtggttgtatgctttgagtcctttttaaaagtaatttgtagaattattctatttgcttcgtagtcaccatgagacttacataaatatcttttccttataagaggccactttaagctgagaacaactttcctataattgcatgtaaaaactctaaaacactctttacaatacaacctttatcatagattaaatactcatatattcttggatttttttttctggactcacgattctgttctactgtctatttttctatttctgcaacaatactattttgccttgcttattgtgaatttatgttctatgttgctatttattataaatatcaaaattttgttatagttttactttatattttcttaatatgatcaatgcaatgttctatttccagtttatttgaagtttaaatcttaactaggtgttaactgttgaggtgatcatcagtttgctaatattttgtttgtgaattttatatttgtgttcataattgatactgatctataatttttatttgtatattattctttttgaatatcactgtctactgtgaaaataaaactggcattagaagattaaagaaacattatataaatataacatgggggccacacactgtggctcacgcctgtaatcccagcactttgggaggctgacatgggtggatcacctgaagtcaggagtttgagaccagcctgactaacatggtgaaagatgagcagatcacctgaggtcaggagttcgagaccagcctgactaacacagtgaaaccctgtctctactaaaaatacaaaaattagccgggcgtgttggtgcacacatgtaatcccagctacttgggaggctgaggcaggagaatcgcttgaacctgggaagtggagtttcagtgagctgagatggtgccactgcactccagcctggatggcagagcgagactctgtctaaaaaataaataaataaataaataaaattaaaataaaacatggttgctacacatgcatgaggaagtaagatacattggcttgactaatgcataaaatacactggatatcaataataaaaagaccaatattctgtagaaaaatatgagaaagagatatgaataggcaatttacagaaatgaaaacaagaatggcccccaaaaatatgagggtgaaaaataccatgtcaaatgaaatgaaaattatactcgaattattctctcctatgaggttgtcaatagtacgaaagtctgaaaacttactttaatggcaatgctgtaggaaatcaggcactctcatacatttctggtgggagtgcaagttggtattaattttatggatggaaaatgttgaacatcaattaaatataaaccaaattaaaaagatatagtggcttgggtgtccaaatactacagttttattattagctttcttatctgacagccgtgtaagattttacatgtcattatttttcttgatctattaccttttttaaaatgaactatttgaaatgtgtaatttttatagactttacaagctctagactctagtgatatatatatgtcacacagctgatatctgcacatgaccctaaatatgcataaatttatgttatccatgaatgaaagaacggctctttttcttaatttcttttttcttgactatagcatattttcatcctgtgtataggatttacaaatcagtttttacctgattttgaactgttccatcttcaaccagttgccatatgactacttggttcattatttgtggtaccatttttgtagataaaaatatgtagatgataatatgggtttgttgtgcatattcagaagcactgtactgtaatcattaagaacatggacaagagagccagattacctggcttggaaatcccagatatactatccatgtgctgagtgcattggttcatctctttcacagttttctcacctataaaagaggttaataagagtgtatgcctcctggggctatgaggattaaataatctattcaaaacactaagaccattacctgctaaatatacatttgctatttttattcatatgaggatatagatgtctatatcatgaattgaaaataagccatttttttgaaaagcagtatacatttctgaagtcttgaacatgaataatatttaagcatatttcactaaaaaatgacatgattttgacccactatataaaaaattataagattttggaaagttcttcatattgtagtgtttaaagacttgaaacccagtgtttctagccattgaagaaaacttagactacttctgcataaattgacatggaattgcctttattattgatctgaataaagtgggtggaggaacattcatctgatgaggagaagcagctccctagaacacagagatattcagatgttttccactatttacaattcatcttgtttattaacctttaaaagcagattccgttgaagaaaacaaattggcactacaaggagtaagaatgcttttgttagtgagggactcacagtgcctttccaattcatacattgtcttctgatgagtgtgggtattgggctagaattttggcatctgaaagtacatctatgtgagccgtggctcacataaccatggctgtaggttatgtgagctgtgagaattttcaaattacctcagacttctgagaatattcttggtcattgagaaaataagcagtaataaatgctccagattcacatccacatctcacaatgttgaaagaatagtgggtatcatttatttaaatgaattttacaatatgcttactccattatttcattttcttaggaattattctcccagctttactaatagttgtggtgactcatatctttctcactactttgaccaggtctgaatatactttggggtacaagagatgtgtattcgttggctatataaaggtggtcgatctgctaaggaatcttagatggccagagttactggaaattcactcaatagaatgggtgattatataggaactattatttttgctgttaatataaatgcatcttcaggtatattatttgtgtttgacacactgttctaaaagtccgatattaggactgtttttcttaaaaataaatattcaaatatttatgattgtgccttagctatggttgccagaaatagagcctgaagcaggaattgtgtgcatagatttgtgcaaggagcaagtgaagcaagagggcagagagaagatgagcaaggatatggcttcaagtaaagttgagcctcaacttgatcccacaaacagattataccaaagtttcattcctgattgatttgaggcaaaggagggaggcttggtacacgagagctcttcttgcagcagtcagtcgtcggctactgatctgactactccaagtgcggtgtatgactcccaggtgcctctaggcaaggctactccagtatgctaagcacgatccttcagaaaaggttacaggtgtcagctgtcagccatggcacacacaggagtccctgggatctacatgggacatcaacatccaaacataaacaaaggcagcactttcatcacatcacatgtggactactgcagatggagtcagctctgtggtgatcagcagaaggggatttcaggctgactgaagcaccaggccacgctgtcagaggcaggagtgagtgtctaatgtttaaggagcattgtgagaggatccttgtgagagaagggggacagtggcagatgaggagctcagggaaataggaaagaaccagggtaccaagagacttgtgagccaaactaggcgcttatgttttatgtgtcaggcaaagccgatgggggtgtgtgatggtttgatgtgatggaggaaccacacggaggtcagtgtggctggaggaaagtgagccaggtagagctgagatggtaggaactgagatgagatagtgggacgtttagaaagtgtgaggctgtagaggtcttgggaaggcctttggcttttacctctttttccccaggtgggacgggccgttgaaggattttagggtggcagtgacatggtgaaaggatcactccagatactccgcccagagtataccattgtgctctgtggtgaaacagggagaccagttaggaggatttttgcagtggttgaggcaaaaagagatggggactcagatgagggttgtcatagtggagatgtggaaatgtgaataaattcagggtagatggtctaactgccagcacttactgatggcttggccgggcagggtctagggatttgtgggatcacatagcagagtagaatcttctggccttctttctggccactcttcaccacagggcccagtgtcctcatggtggctgatgccccagcccgcctcgtgtgattagataggatagatcagatttccctaccacatgtgcccctagaaactcagattcctctgtttaacccaagcaaagccatttagctccccaccttatccctgagtccaactctgcttatccagaaatgaattatttgttggcagtgctaaacaaaatgccatctgtggttgggtcttaaccctgtagcaatatagatgagctgagctggtagaagttgtaaaaattatatttcttttttatttcttactacaattctttttaaatataaaggcgcaggatcacgatttatttgcttgtcagtatggagtattctattccctttagaaagcataggaagttttggttttgcatgtctcagtctgctctactgtctgtgctatgcagtgtgccagttatatctcttttaatattagagtcccatgtattagatgataatattctaatcttataggtggagaatttgagtcacaagggttaagtgacttgctgaagataaaacacccagtagagtgaatttcaaaacctgagtgaggctgggcacggtggctcacgcctgtaatcccagcactttgggaggctgaggcaggcagatcacgaggtcaagagaccaagaccatcttggacaacatgatgaaaccccgtctctactaaaagtgcaaaaatcagctgggcatggtggttcacgcctgtaatcccagcttctcgagaggctggggcaggagaattgcttgaaccagggagatggaggttgcagtgagccgagatagcaccactgcactccagcctggtgacacagcgagactccatctcaaaaaaaaaaaaaaaaagaaacccccccccaaaaaaaaacccctgagtgacactaaatttacatgttataaagtctctaaacattcaaagaaacaagcagatctaatgccaagttccacgtgggcagggagctctgctgtcatgttcattgtatcaccatccttgatgacattaactggactttagtaggttctcaataaataataaatcaagtgaatgaggcattgtccgtgtggcactggaaacatggaggaaggagaacttaatcctgatggggagctttggtagatgtggtatttcaagggctctctaaaaccaagaaagagttcagcaggttgagaatggaaatccttttactccaaggtaagaatacacagtgaaaaaagccaaagagttatgtaaggcatgtttctcttctgtggaacaaacattgggaattgacattagagagctcatctatgatggatggcttaggaccttgacctccttgttaaggagtttgtacttcatctctgtccacacaggtgagcctttgggggtgttaaggagtgaggatcatgaggtacctgggattccttttctttagtgttgtactcgtgatttttagcttaaaaggccagaagtgtatagggatttttaaaaaaggctttagaaaacgatgtctattttggtcataacagcacttaatatggcagggataaccatggatgttgactttgcgttctttcattatgcatgctatttcacattatgtgaataggtggttatttgtatcttgttgcatgctaaatatatcagatttaaaaatcaattttacatatagaacactgactaatcaatttaggaagcagattagttttgcgtttttcagagctctattgatttgattataatgttgttttacaacaaagtataactttgatttatgttcagatgttaagtatttatactagtttaccatatatgtgcactatgttgtttctttaatgacactgaatgggccaggttttcactttaatggcatttaggaatacatttaactaaaaacatccactcaaatgcacgtgggttatgtttgcatgaaatcaattaatgatcctggcaggttctgtgtttttctaaattttaggacttgcctcacacaaatcagaagtatccagactttcaaatttacaatatccattcaaacttgaaatgcccttgattaataaaaatacatgtgacaggagagtatagctctgcttttaagctgttagagagaacataaaatgattatggcttgcagtaaatgttattatggacctgagatgtttcctcagggattcagcaatctcctgcactttctttaagactgaccctctctccttgagaagcagcaggaaggagggatgtggaggcaagaccgctgtcaggtcacctgtcacaacgctgacaaggctctgatataaaacctaatttacagttgaagaagcacatccattatccttctgattttaaaatagaacatacatcagcaaaatgataaaagaaagtgcttaagaattatgaatgtcaaggactatttcctatcataaagtcacaaccctttttgaatattaccttaaattatagcagagtttaacgatattcacaggctctgttctctgaaaatgagtatcacagtatttcaactattgataagctaataattgtgtattaactatcgactgtctttgagatcaagatctaggtagatggtggcatcagtatttagatatttctttatgaaatagatgtgcaccagaactttgctacaaggacttaaataatgaattattttctgttgacttatattaaaagtacagcgttgttttatcttcatttataattaaccttcagtcggccatgtttcttccttattcctgattcatctttttcctgttattctcaactaaagacggatatcaaacaaatcctggaatgtatttttaaaaactcgactatcttcttgaagtgaaaataaactgttaaagtgtctgctctaagaccttggattttcttttaaaatggggtgctccaggcccggcatggtggctcacgcctgtaattccagtattttgggagggcgatgtgggcagatcacgaggtcaggagatcgagaccatcctggctaacatggtgaaaccccgtctctactaaaaatacaaaaaattagccagttgtggtggcacacacctgcagtcccagctactccggaggctgaggcaggagaattgcttgaacccaggaggcggaggttgcagggagccaggattgtgccactgcactgcatcctgggtgacagagcgagactccatcacaaaaaaaggggggagggggagttgctccatattattgtcatcataaatttcattgcaaaaattatgtattttaataattggtgttatggattagataattttaatctttttagcattgttttaatattttcttataactgaatcaacacaaatttaaatgatttataatgggctaatttattagaataatatttgagatttcacaatttagaagcagaaatgttgaaatagcctattctagcaaaaactcagcattatccttaaattacccatgtccatatttagagatagaagatataatttcttatctattaactattttctgcttttaaaactaattgttcttcccatctctgctatatttgaatggactatccttagattgtcttcttcatgtctgagaattttatatttaaatatatgtttaatatacaagtaagaacagacattaaaaaaacctctggaatccaaacttttttttttttttgagacagagtcttgctctgttgcccaggctggagtgcagtggcatgatctcggctcagtgcaacctctgcttcctgggttcaagcgtttctcctgcctcagcctccctagtagctgggattacaggcacctgccaccacacccggctattttttttgtatttttagtagagacggggtttcaccatgttggtcaggctggtcttgaacccctgacctcgtgatctacccacctcagactcccaaagtgctgggattacaggcgtgagccaccgtgcccggcctggaaaccaaacttttacatttatattcatatatacatacctatttatcatcatcatcatcatcatcttgttctctctacctatctattcataaatctattatctatctttgtatctacttacctacctacctgcttgcctgaatattagtcctatctgagccaacaaggctaagatgcattttgaatttgactcttggccttttgtaagtctgccaattgtagaataaatgtccagcacgcatgctaaggcctccttattcaagggagagggaaacccttgaaaacattttactctactctgactcagtacccagtactattttccagtgcaactctaccccctttcctcgcccccaactaaaccctccaggtccataaaactgtgggagccttttgtttatggctctctcaacagtgagaccacgtctacatctgctgatccacttgaccggtgacctgtgtccattccatgtgggaacatggaaaagggagagtcagagctttcttgattttagcctcttgtttgtaccattatcgtaagtgatggtaacatagtggtaccagtttggatgtattttagatttttctcttctagaagagctattaagattaaaataatctctttttctcaaaattttgtagaacatttctggagcatttcggggggcatttctttagataaacatgtataactatttaatattttatacagtgattggattctttaaatgctaattttgtagaacatttctggagcatttttgggcatttctttagataaacacatataactatttaatattttatacaatgattgaattctttaaatgctatgggagtattcaatcttggtgtttcttcttttttcttttttaagaagttttattttatttttagttgacaaataatatttgtgtatacttacagagtacaatgtcatgtgtcaagatatgtggatacactggaatgatcaaatcaggctcattagcatatctgtcactcaactatttatcatttctttgtggtgaaaacatttaaaattctctctttagctatttaaaaatatgtaatacattatgattaactatagtcacagtgctgtgcagtaggacaccagaaattactcctgctacctatctgaaactttgtccccattgaccaacgcctcctctttccctgcccagcctctggtaaccaccattctactctctagttctatgagcttgacatttttagatttcacatgcaagtgagtgcatatggtatttgtttctctgtgcctggcttatttcgcttgatgttttctaggtttacctttctcatgttgtcgcaaatgatagaatttcctgtttattttaaaaatggaatagcattccattgtgtatttataccacatttaaaaaaatctattgatggacccttaggttgcttccatatcttagatcttgtgaataattctgcaatgaacagaggagtgcaaacaccttttcaatgtactgatttgagatcctttgtgtttatacccagaagtgggattgccagatcatacgataattctgtttttgtttcttgaatctattttgtttcttgaatctccataatgttttcaaaatggctgtacgaattttgatatttcttcttgagtcagttttctaagttatatttttctaaagatttttaatctgaattttcaaattggttgcataaaattatttaatatgttcatattttaaatttctgatctatctgtgatagaaattaagtcgggcatctaactcagtagtttttcttttctaaaaaatgtaaatataaaaggctataaatttccttctaagtactgattctcacactttttttctatagtatgttctttactgttcagtttgtgaaatttttaaatttgcattttcgtttattctttggcccgtgtgttattttgaagcatttaataatttttaaatatatacagtttttaaattattgacttaattgcaacatggaaaaacacacggagtctatgatattgtgaagacatactttatggtgtaatacatgatacagttttataaggttttcaggagtactacagaagaatgtaacgttattgaattgtccatatgttctatattttatatgtgtgtatgtatgaatttgttcatttaagagttttttttgttctacttaactatttgacttagtaaaggagagagctgggctaaagttttccactgttatgatagatgtgcttatttctttcagttgttatatatttttatttctatatttacataaagttcagaatcattatatccttctggtgactataatttttatcattatgcattgacccttttttctcttaaagtgtttcttcttccttaaagcctatttgccttatatatctatttcagctttcttttgtttaacgtttacttggaatatatttttcatcttttacttcaatattttcatatccttaggtgtttttttttgtttttgtgattttttttggtggctgtcttaaaaatagaaaataagttgggtttcatttatcttatacattctgacaatttggggagaatttaacatatttacatttattgtgatcattgatatgtttagatttatttctgccttatcagtaaagaattttgttttcttattctatgactatttttaaaaattattatttttaactgattactttgttacttattatatggggtttccccctcctttttgaggattaatacatgctatttctattcttttagccattatttttgaatttttactacacatattttccttaataaaatctaaatttaaactagttttatttatttttcaaacagtgtaggaaatgttagaataatcaaactgcaatcaccactcccctgaattaatctgtgtttttcactattttagttttttcctttttaaaaatcccacaaattagatgttatgtttattactttaaataggtgattggagagatgtacaagatgtttagcattgtatttgcataccattatttttgcatcttattcttctgaaatcattttccttcttaaagagcatgatttaccattgcctttaatgaatatctcctggtgattaactgtttatgctcaggtgaatgttttcattttactgtcatttctgaaagataaatattctgggtatgtaattagaggataatagtgattgtctctcagtacttcaaatatattattcaacaaccttgtggtttctgttgttgagaagtctgctgtttttctaattattgttctttttttgatgatttgccttttttctctggatgtttttctaatttcctctgagtcttttttatcagacagttttgctttgatctcttggcattgatttcacttattgtgctttcaatacattagaaacattatttattgcatttggggaatttggaaaatcacagccattttattttcaagtattatatctcctatatttctctaggacttaggtaactgttaggctttctcattctctgctctagatattttatattttaatttttaaaatatttcaacataatttgttcagctatattttctatattatggattctctcttcagccaagaaagtctaagttgatcaaagtttttatggactttttcactgaattctgaaatactaatatatggggggtgttacctgtccttctaaaatgcctttgaacctttcttattttcttaaagcagattttctaactataacctaaatccacacatttgactgacaatgctcactttaagtccaaattattttgggaatttaaactcagaagtgagcttaaactttgatatttgtgggaagactctcttggctacctttcatggctgttataaacacttcctgtttgtatagcactctgtgcttaaccctgttgattaacttcctgtgtcttacaattgcccatttttctgtcttaatccaactctatattgcaaactgagggctcccttttcccaccatggtaaatgtggaggcagcttcctggaagaggccttgaggtcacatcacaaacagtaaaacagcatatgggggagaatctcctcggaagaggacagactaaacttgtaatctgcacaccttttatttaaaccctctcagtatattaaagtcctccaagaaagacagttgtcatagggagtggtctagacatagccaacttttcctccatgaaaagaataagcctttattttgttcagccactgggagtttcgaggtggttttttactgctctaaaacctaacttatcctaataccggggacaaacgttatttactctggtgacaaacattatttctattttacaagtgaggataaactgttagggaggttaaattacttgttcaaagctcatacgtgttgtagcaaggactaagtagtcttaggcatagggctcagctttttaaacctaccttgatggtttttgtgcctcgtctatagggatagtattttctactccaaagtatatgccatgatgatccagaggatattgatcatgcactggtaagaagaatgtctctgtataaacaaatgttggtataatataaacattgataaattgtgagcagcgatctttaccttagctctgaatgtctaaatttcacttggaatttttcagtagatttatatgaactcaagcattatcctacttaaaagaaggttagcaaaaaaaaaaaagaaaagaaaacttatcaaaagacttttttaaatccaaaatgacactatataagtgtcatataatttataggttaaggaagctatagataatgatatcattatgactgattcttattgattacattaaagtgatattaggcatttcggatttttcagatgtttttcttgaggcctcctagattttaaaaatgataaacttatagcagttttagtggccctcattatttttatgagtgacttcagggctatcacaaataaatgaaaagtctatgcaatttcaaggcaaaccaattaatgcccccttccacctaaattatctcaatatttcctacagataggtcctagagtaatgctgctaaggctttttaaacttgaattccacagatgcaatcctttcagactttaaaaatgtttattctcctcagtgttatatattccaccaggtatccttttccaagataattctatttcaattgaaaatcttttaattcattgcacaattatagttgagcatttcttggcacaactacccagatttgcaaggccatagctcttaggtgcctatctgactgaaccttgaacctatggcatccattgtagctggtgataaaagttatatcagctccattttccacagttcttaactgttaagaacaaccctctctagctttctcataaatcaactttgggattattggcatatgagctttgttcaatttttcaagccacataaaatagattttttccatttcatcaatcacatttcctcaacttttgctcttgatggccaactgcaggggcagttttcagaggctctgtcactcatttggtctcctcatttctgtttgattattgttatatacacctgcattttcattgcaggcatcctcctcttctcagtagggctttgattactcacactactttttgcttaacagacttgattttaatgagctaaataataagaaatctgacaaaataagcataaatatagcaaccattttctggactaataaacaacttggtgccctagtaattccattggtaatgtaaagatgtgactgcatgttggtaagataaagatttgactacctgtataattttatattgattaggtttgataggcttaagtttataaatttaggtattttttgttgtcacggttttatataagggattttttttagttctaggggacaatccctaccataaaggagtttataatcagggcactttttcaaatattcctgttataactcaaaataaaattacaatgaaatacattagtattcttaatattcatagaatacaaactctgaaagtaagattagaaatatttcttacttatgatgaaataaccttgttattaccattttagttactttatgatgaaataaccttgttattgccattcaagttacatcataacttaaattcttgggtagaatgtcttttcagagtgctccaagtaaagactatttgaattatctatgcaagtacctactaatatttaaacttttgatgatcttttcacataatggaggacaacgggttctatagataaacacccacatcagtggtccaccattcctcttccagggttatatttcattgtgttctgattttaaagcaaattagggagtctgtttttgccaattttcccatgttgctgtggttctgagtgctgtgattatcaagacgatagaagtggaaggcgggagtggaggtggcttctacagtcttcagtgcagcatccactacagagttaatggcatttttacgaagaccaggtgtattttgtacttttttttttggtacacgtttctcaaactatgttaaaattaaccatcaatatcaaagtatactgtcaagaaaaaaagaaatgcttatgatgaatattcatagctgttagtatctttggaaaaggtgggtaatcatttttaaaaatagagtaattttctttggaatacataactctcaagaacattttgatagctatatacatctaagaaaagtgtattccatttattattctgttaattaaatatttgttgatcattactgtgcatgaaacattctctcggatggaggtaagtggagctcctccttgttaaggagaatagtagggagatgtgacggctgcacaaatgactacatttccaagcaggataaaataccctgctctgggggaccaggagaaggggaaatcacttctaatggaagttgatgatagaaagaatttgtgaaaggcttttgcatgatattttaaatttgataaaaagataagatggaagggcatgtgcaaagtcacaaagagggagaaaacagaaaatgctttccatgaataatgagttaacctgggttgttaaaaatgtatggaaatactgtgtaggcatgacagatgaaatccaaaggatttgtttccagtccatcattagcaccactaaaataatagaaattatttttaaaaagcatacatctaaaatagcatgagaataactacgagagcaacaaagtgttggatgcggtaaagcttccaggggtgtaactgaggcaataatcaaagaaacctgaaaatcgatgtgcaataaagggttacaagatatttaaagaaagcctctaacacaaagagaaagaccaaagcaaacaaaagttttaaaaatccttgcaaagagtaaaataaaatttgggaaacaattttcttggagaaataaggaaaaagaaattatccttaaagcaggaaaaggaggttagaacacattttgaaaagtcaataggagggagagtcctaagagacaacaatgaaaaggcccacagggctcaccttaccctgacccatgaattccaagtattgagagaccatggaggcatttgagcaagtggtgaatgatgaggagttttgtcttaggatcattaacctggcagcaatacaaagagtaggctagagaaaagaggcagagagctaggacaaaagttactaaggaaaggaaccaggggtataaattccaaaagaggtggcaggaatagaggacagatttagtttttacagaggaaagaatatgagggaatgaaaaagaattggatatgtagacagaagaagtacagggaattaaagtgttgagagttaataagactcaaacttcagttttaagcctttgcatttgagatattggtggaattgcagatagaaattattatcaagtattatagagactattggtttctaaagactgagagatgaagaatggatttagaatcacggaggtcaatggtgatcttgcagggaacagtgtggctggtatggtaggggtgaaagcctactggaataggtttaagaggctttgcaaagagaaactagagataataggaatactacttgcaaggaatggtgccacagaaggttgatagctggctgagaatgagttcaagagcagactttattaagaaagaggggagaatttctatcttatttgtgttttccagttgggcagcagagaatatcctaatattagaaaattttacaaaattctgtcatggttttcataaatgattatagcttgcttttcaaaatgcacaaactgattgcaatacaaaataagtagcacgaatactttaaaaatagatgtagatattaataatactagataatttctggttagtatttacatcatggaagaaaatataaatttagatatttggtatttttacagcttgtcatttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgtcattttttttaattaaatagaaaccttattttaggtctttacaggaatcagcatataaatgtaaagacaaatcctggcttcttgctggaaaatcctttaagaaacataattttcatggcatcttgtggtcttaatccaggtaaagctctgcttttaaaaaaatgaacaaaaaatataaactgcaccaaaattcaatattttgttactttgctgtctccatctttaagtgctcaattttattcataaaacaattgaagtaatttaatttcaaaccatttgggttttgtcatatttactcccacattacatgcacgtggtagatatggatggaaagcttttgacgaatggtatttttttcaattgactgactaaatctagaaacaagatctcctactgccccagtgccagatgggcccaccccactctctccgactctgaagtgatcaaatgctgtatgcaggaagctgtacagctttgccaattaatagctgcagactcaattatgaacaaaagggcagccagcctttagtagggaaaatcaacttagtagggaaaatcaaaatgtttagccaaaaagcatttaattgtgtttctttaataatgaagtcccctttagatatgttcataaatcaggaatagttaacaggaaaaatgatagatatgtttgtaatgctacgtagttatggaattgctttcccatagatcttttctgattgatcattatgttgggaattttttgcatgtgtgatagtcaaataatggtatgggagaaaagtcaggatattctattaacaagataatcattttatcctattcttgtgtttacatcttctctgttgccatttaattccccacttcaaggctgtttcattgtctccatctctactgtatttagttaggcttttttattcttaatgtttttttctagctttcttgtagtctgtgattagaaacacataaaatttatctgattagttagtgggaattaatcactcttctactactgaagcaccctgctttgttgtattcttttattattccagacatcagaatgtaatattttaattctatatgaccatctgccctacccgactagaaatccctgaagactggagctgcctctcacctatctttgttttgctggtagtcagtgagcacggtgctctgcatataacaggactcagggtttacccaacgatggcctcagtgtttatgttccccatcacaatcctaacccccaaggcaatgatattaaaaggtgcggccttggagaggtgatgaggtcatgagtatggaggcctcatgaatagcattagtgctcttctaaaagaggccccagagaatttgttctccccttccaccatgtggggacccagtgagaaggtataacatatgaaccagaaagtggacccgcagcagacaccaagtctgctggtgcctaaatcttggacttcttagcttctgaaacgatgagaaataaatttctattgtttaagtgacccagtttatagtattttgttatgacagcctaaacagattaagaccctaatcaagagtctacatttgacctctgtgcttacctgttactagtaatcaaaacattttagactttgacaaagataattgcgtaagtgttagaggtatatacttatccattgttaattttaatcaattttacataatacaaatgcattattacatatgcttttcacagaacttaaatgccctttgataactatgtacttgagtcataagtaattatgtaatttgtctgaaatgcttataataaatagcataagagagatttaaccataaaatgtaacatttatttacatatctatttttcaaattatgtgcacatccaattttgatatgtgtaatgttttctagtgtctatcatggttcagtgatgttttatcttcacttctgaatcattttgaagcagattctgtatatcagcttcttttccttgcctattgaactttctgccatgtagttagtcttagctaacacttacgtattttaacatttaaaaaatccttagaaatcaccttgtccacccattttcattttaaacgatgaggaaacaggtacagagaagttatagggcttatataaagttagtataagtttgtcttatgataactctaagctcaaaggtagatataggttttgtggggcttgaagctgatataacttgggaagccctttttaagaaagggaatataaaattaggtgagaaacttaatattgactaagaatgagaaaaaaaataagagcctggcagataccacaaataaaatccatccagaaaataacactgttacattgtccccgacatctttgcaatatttttctctgtatttattagctacatattccttggtctttacttcgtgacagcaattacataatgtcattttctgtggaaaacaaagacagatgatcagattctcctgtagcattgtcaatggaaacttgctttttactattgacagttaagtttctttcagcttcacaacttattattgctgttgccacatcttcgactcccatctgcctgtcctcattcaggtcacacaagccctggagcaacctgctccctggttgttttccagcaaacaagactccagaccctcactgtcaacaatgagctggctataaacctgggtctttgtgctcctcaaagcagggagcagagcagcaaccccctcagatccttctctgggattaaagatagcgtccagattctgaggcacaagccaacaggggatagtgctggccgcccattctcctgccctgggcctcaacatcagaattgaaaggtgacccaggctccaacctgctagcaggtggctgatactgggtctcctgagaagagcatttggtaggagcccatacaagtgaggggcttggagcttaagcttggttaatttcatagtcagtctgcttctgcctatggcaaatccttgcaaaaggccagacactgtttttctctttactaagaatttacagtattgtaactgacccgctaagtactcaggtaaaaatatttgtgattctcctgtgtctccctaagccacatctctctctgggtttttaataagctagcattaaaaggcataagaatgatacgttggactttggggaaagggtggcagggggatgagggataaaagactacacattgggtacagtgcacactgctcaggtgctgggtgcacctgaatctccgaaatcaccactaaagaacttattcatgtaaccaaacaccacctgctccctaaaaacctattgaaataaaaaataaagttgaaaaatagctagcattaaatcaaccaactatttctctgggtgaatgttctgtcgcacacttgcacaaaccctgatctctcttcaggggcctcttcaaaagttcagtatcagactcacttggctccctcgtgccggctgtgtgacgttgtttttctccacttcgggacatgcagttggccatgtgctcacaggcctctgctgtgttccctgtggcaccttcgcagactgagtggcttggcatttggctgatgtaggccatgtgggcacacactcagcttattgataacatccctcagacactgccatttccaacattttcattccggatttcagaattcccatcacaccatcccaaattctactaagtgtcagaccaggccatgctaccctgtcctttcagggcttacagagactttggtgagatgttggatttggtcatggtgctatttattgttattattaattattagttttttaatcacagcctcctatcctcaagttctaggtaaaattgccaaagtagactcctttgagttttgggatttttttaatttggtgcctgtgatttcataaggaaatattttattttatacttttactgtagagatgcatttaaagtttaatattaacatattctggagcatcttaaggaagacagccttataactgaatcctgccatatggttcaaatgcagctgatttgaacaacatttactgcacttgctttgaactaataaaagaaaaaacctccctaccttctttctttccttccttcccaccctccttccttctttccttccttctttcattccttccttccatctcctttctcccaaaacatatttgtagtgaacacatcctttgggccaaacactgttttggcccgtaagtatgtagttgtgagctaaccgacactattcaggcctcacagagcacacagtctgaatgtgtaaaatacgcatttgcaacaactgcaggtgaatagtgtcatcgtttgccatatgaatgaaggtttttcggtgttttggggggaggaaacaggtgtgagaattgcacgatgcacggtggcagagcagcgctgaggctaaaggaaaagtgagtcagcacggtgattgtggcgttggttctgactcagtggcagtggagcagcttctgccccatcaaaagagtattatgtgatgggaagggggctttgtgctttttcctgttttaaatacaagatctgggaatttgatttgttcctgtggttgtataagtgctataagcgtaagaggtattgccttgtttttatatggtttgtttatttttatttatttaacaaacacgtttaaagcacatataacctgtcaggggctatactaggtgttttacaaatttcagctcattttatttacacatattttaggtaaaagcaaccaatacaaacttagaggttgcggagaatatatatatgtatatattttttacctttatgtactcactcaagtttaaaataccttgttgaagatgaagtccctggtgaaaatgtagagactcagggaaatctaagtggcaaatattcaaatgcattaactttccccaacaaaaagcatttccttgcctcagtctctgaaccaagactcttgatttccttctggagaagctccttagttcctaatacagaccggcaggtggagcagcacgccctgaaccctccagcaagcctgggcctgtgtggcgctcagagcgagcctagcggggttgacccctgaggttccaacactactttatttttatttatcaacttttattttaagttctggggtacatgcgcaggatgtgcaggtttgtttcataggtaaacgtgtgccatggcggtttgctgcacagatggatccatcccctaggtattaagttcagcacccattagcggttcttcctgatgcgttccctccctctgctccactgacaggcccaattgtatgttgttcccccaccccatgtgtccatgtgttctcatcattcggctccgacttataagcaagaacacgcggtgtttggttttctgttcctgcgttagtttgttaaggataccaacttccagctccatccgtttccctgcaaaggacatactctcattcctttttatagctgcatagtattccacggtgtatatgtaccacattttctttatccagtctgtcgtcaacgagcattcgggttgatttcatgtctttgctattgccaacactatattttaaaagaaaatatttctacttcttgaagggcatgggccttatctacagtgctgggttgacctggttacaagaaatccacagaaaacataatctgatatttactcccattacaatatggtacacctgtcatacttcagcaagcaaactgtaaagggagagaaaattcacttttatttgaactgctctttactcctctgaggcttccctggtttgtggcaaacaaacattgtaacagcttcacctagaattcaaaattttaaaccatctaacaatgttataacagatgagtcttggagcttggaggccagggaaaagatagtcatgagcaaaaccagtcttccttctcttagaataagtattgagagtatttatttgtgcatgtcaattcaataatgaatacgaatgtgacctcgaaatagtatgtagtccatttctaatcaagatggaacagcagttcttctgacctgaaacaactttagacaagacgtatgaaacaatgacactcaagccattaaacatcaggcaatgaaggacagtaatcctcaagagatgggaaacagatgaggtgagacctacaattgcctcaacttactgcctgggaaaagttttcagagggtggaagcctagctgtctccttgagttcagaagatgaagcttagaattcaaggaagttaagtcggctagaattcacaggacagtatgacacaggaatgagatgtacaaagagaactcaagatctgcagagggtccccctcagtgcatgtgtgtgaggaaactaacagaggcaggggaaagaagcacctaaaatagtaaggtggaacaggggtcaaggctcaacaaagtaagaaatagttccttttcccaatagccagagtggaaaacttaatatttcaaggggcattgagtagagttctaaaaaggatcctcccacactaagagggaaaaatgaaccttggtaaaaatgctaatttaggaccacctaacaaagcttaaaggcaagactttaatatttgggctcacattaatcccaaatattctaaataagttaaccatgttccagagaaatttcaaaaatatttatagctataaattaaccatgatccaaagaaatttcaaaaatatttatagctatactaaaattcttagcctgtaaaaagtaatatccaaaatgtctggcaaccaattaaaaattatcagacatacaaagaaggaaataaatacagcctaaaataaagagaaaaatcaatatattgaaactgacccagaatttacagataatagaaataggacattaaaatagttcttatgactatacttcatatattcaaggagctagaagatacatcttacattttaatagagacatagaaaatataaaaagatccaaatcaatttttagagttgggaactacaatatctaagatgaaaagcacactggatgggatcaaaggcacgttagatattgcagaagaaaagatttgtgaacttgagaacagccatagaaaatatccaaaaggaagcagatagaaaaaaaattaagaaaaaaagaacattttttcagcagtgagacaactagaattgacctaatatacatgtaattcaagtcactgaatgagagaggagtgggagataaaataattgaaaagataatgaccaaaaaatgtccaaagttggtaaaaactatgaacccacagatctaagaagctcagtaaaacgcaaacacaagaaagatgaagaaaatgacaccaaggcccattataatccaattgcttaaaataagtaataaggagaacatcttaacagacatagaaaaaatgacacaatgtaaataaaggaaagatgaaacctatgacaccttgggaaagaaatgcaggctaaaagactgtggaagagcatctttaaagtatgcaaaaaattatgaacctataattctttattctgaagaaatatttttttaaatcaaggtgaaataacaagttgttttcagatatacataagtcaaaacaaattctcaccagcaggcattcactaaagaaatgttaaaagaagtccctccagcagaaggaaaatggaaatagaagaaaccctgtgtctacacagaggaaagaagggaccagaaatggaaactataagagtaaacatactttatttttcttattattttaatatccaatattttctgattatttaagtctttaaaattaatctactgtttagataaaaattacaatgtaataaggttcataacatacgtaggattaaaatctatgactacactagcataaaggcctgaaggaaaaaaaaagtatattgttgtaaggtttttatatgtgtgtgtgaggtatagtatactatcacttgaaagtagacagtgataagtttaaaatgtttactctaaaccctaagtgaaccgcgaaaataaccataaataattatagctagtaagccaaaaaaggatataaaacacaataataaaaaattcttgagtaatccaaaggaaggcaagaaaaggagagaaaaggaacaaagaacaaatgaaacaaaaacaaaaaaaagcaatatgtatatttaaacccaataatattaataattatattaaatgtaaatggtttaaaaacaccaatgaaaaggaagcaattgctagattgaatttaaaagcaagacctaactgtattctgcctacaagaaacccacatcaactataaaggcgcatacaggttaaaatttacatggaaaaagataaaatatgtgaacactaatcaaaagacaactgcgatagctaatgagtatcaaacagtggatttcagaacagagaatattgctaggaatgaaaaggatcattacatcggaataaaggaatcagtttatcaagaagatgtaacaattctaaatactaagcagaaactgacacaatttcatggggaaatatataaatccacaatgatagagatttcaacacctattcctcaagaacagatggaacaagtagatagaaacttagtaaggatgtaggcaattattataacaaacattttttattacaaaagatgtgaaatatttttggaattgaacaattttatctgagttacattttatttaaatgagacataaataaggccacattgtagagagcaaaatttaagagtgtgaattagtcagctattagtttaggaaattcaaattttagatgattttttctttttaaaacatagcactttctctagaagtcaatttttaaacatcaaatgctttattacaaagttaaaataattatagaaatgattaatttaactgtcactctttacatacttctctggtttatttacattatttggttggggaactttgctgagttacctaaaggagatttcagagaaaatttgttatggaaaaatggaccatattaacttaattcagagtttcctatcccaaagtttgcataaatcaagaaattacttagtcaaaagcttttatggaagcaaagttttaggaaaaatattttaaatattaactttaatggtaatactaagagattttaaatattctaacataattcttacaacttggtgagaataggattattatctcaattttatagttgaggaaactgaaactcgtatgttttaacaacctgtcagaagtcacacaaagcagcagaaaaagttcttctaaatctatgtccacttttttctccactaacttcatgataaaaataacacaaaacaaaaatcacttaaattaacatccagaaataaccgctcatcctttttttgtgattgatgaaatattgccttaatttgataacatgaaatgaatatgtagagggtaaaaggaaggaatgtgtattttgcttagaaactataggtaaatagatatttgcatatttttaatagaaaatatatttgtttaaagtaaaagtgaggacatttgagctaatctaattcacaattctaaaatagcaccatctcactacaataaaatacattcaagtgttagttaaccattgactgaaaaaatgaatgatatttttagactacacaaaaatgtactaaacattttttaagcattcttactcattctcttcctcctttctttctcctctccacatatgcatatatatgctactggcaaaatgaaattataactgctgtttttcatttatcattatgtattggcacctctttctctgctaataattagtttacattataattttttagtgatgttttgaaatctatatttaagggcataatttatttaaccaaatctctatgtggaaagcatttaatagttttcctctattttaaaatatgctatgataattattcttgtacttacatctctgcagactttctaattatctcattagtataaattcctggaagtataattgttggatcaaggggtattaacattataaattttgagacctattgttaaacttccctctaaaagtattgtacttgatttggagtccctctaacagcatataagtgtatttcttttatattcttgtcaacagttgatattatcaatgcatttttgtcaactggttaacagaaaacttcatctccttgcttttgtgtatattgaacataaggatactatcttttcatataccttgttgccatttttaatacattttactcttatgaattggaaacaattggtcacatttctcaaatattttattagttttcttataatcatattgactttacagattaattaggagaaaattacaaatttagaatattgagtcttccctaagaacaagatgaaatcttgtggaaccagaaatttttatttcttcaagtaatcctttatgtccttcagtagagctttattattttctttgtttaacaatgtgacaggaacttaccaaacctcttttctttttgaatagttttctatcttcccctgtagttaattaagcatggccatttaactaagtcctagctagtgaacaccagtttcagtccttgttctaatacccccagcccatggtcatcttatcttaatttctcgatctcccttgtctgcgtggaaaggactgtgaggacctagaggaagatagagctgcaagatggaaagatgacattcaaggctatgcagcaagaaagaacatcagtgtgggactttgtgtgatccaaaaataagcttgtactattttcagacactgaaggttttttttgtttgttgtttgtttgttttattgttgtttgtcatagcaaattctgtttttctaagacagaaatgcaggagttggttctaagagtggtgtgatataaaaatctgaagcaactggtcagtagggctatgagaaaacagatacagaagactgagaagctgaaaaatattgatattctatgaaataaacatttttaaatgtcaactgtgacaattcggaaggcagactcagtgctcactgagactgtggctctagagcaatacttgaaaaggctcagaatgatagtgtatgtttgctactcttggtgctttcagcaagacattacaagaaagaggtgagatcggataagaattggttagttttcaagcacagaaaaatgggaatggagatgtttcagtgatcaaaatccttacaggtttggaaaatccaactgcttctgaactcaaatagcattagtaacaagtaaatgtgcttgagaaagttcttagctacaaaggcccaatgaaacttctcattgggaaaacagactcatccctgcagcctaaagcagattttatatatatggctttcccagctaattttttttcagttagctttagggtaggcacaattacattgacaaagaaagagagaatgagggaggcagagagagagagagagagagagagagagagagagggagagaaaggcaggtgcatgagggcaaggaagcaatgaaacaaaccaatttgagaaggaaatcaatttaggtgtggttattaggacataaaactgcacagaaagaaatagataagtctgcaatattttggggttatcatattgccaaagaaaccatgagttaagactaaaaaagccttcccttaatttcctatacaaacccttggatctttaaacttgcaaagcaagaagcgaactgtgaaaatggtacaactcccaagggcctgcacacccagttctgatggaatacacccaagatcagtggtctgcaacctatttggtgccggggactggtttcatggaagacagtttttgcacagacggccagggggtgaaggggtgcgggggttgggggaggatggcttcaggatgaaaccgttctacctttgatcatcaggcattagttagattctcataagagcatgcaagctagatcccttgcatgtgcagtttacaatgggctgtgcgttcctaagagaatctaatgctaccactgatctaacaggaggcggagctcaggcggtaatgctggcttgcccactgctcacctgctatgcggcccagttcctagcaggccacggaccactagcggtgagcagcccagggattggggacccctaccatgtaggataacaaacaagtaagagactgcttgagggcagggccaggacccgtggaggacagtgcacaaggctgccccctccagagagctgcattaggtcctaagcaaggaatttctcccatcacaacagagtaattgcgcaaggtcttcctggcagggcctgccatatctctagtttttcctttcctaaagggaagtgtttgttgtggttaccttgtcctgttccaccatagtgtgttgacacacagaggggcagataaggtgcccactgaattcctgtgtcaccagagcatatctgaactaatgaagaggattgattacagatggctcagagagagcctcagctttgaggtataaacagtgcctgggtgggattgtgggtcttctgtgaagactgactataatctacatgtaaaaagaggagtaaaatggagatttggttaagagattggtggactctagcagagactaattactcttaacgaaacccgttttctcctattcctgaatacacagctagactacatttcccagcctcccttacagttagatatatctattttattcagttgtagccaatagaacatgtgtggaattaatgtatgctattcgtggtgtggttcataaaagccttatatgggcaaccatctattatctcattcccataagttaacttcatggagagaacgcctaggacctagagaagggtagagccatagtgtagaggaggctggttcccagaatgcccaagtagaaggcagaaaggtctgctttggacttcaatcagaagaaacacaatcttaacgagtttagcctaatgaaagttgactggggcttttgattgtttgaatagcaagtggtttttttttttacagtaatacaatttttattatgttgttaaatctcttcctctcactttttaatgttttgaaggttgttattgtgaattgttcaagaatccaggatgaatagagtcataaattttttcagttgtattggatcacttaggctgaacttagacttcatttacaaaatcaaatgcactgttaatgcaaagtaaatctaatatagcgcacgataaactatatattgatcaaaatttccaaataacattttaaattatacgaaagagtagcagttttgccagtagaaatactgaaatttctgccatgagtaatagtttatactaggaagaaaaataaatatgtgatctgccctcagcttttgcatgatagcagagaagtgattgatattaggttattcatttatgggtagctcctctgtgctttatttctcaccctgtcagactgagaagagctaccaattttattaggactgctgatgtactctgtacttatagttttattacctattggagaagctacaaaatattggcactctttaacaatgagccttttatgcttccttgtgtcagcaagtattttagattaataccctatgtttgattgatggaattgtactgagctcttttttaaggttctaatttctccaaacatgtaaaaaaactagcagggggtctcacatatatgtgtaggcatatatatatacacacacatatacacacatgataactctattatgtatatagttatatatgtatatggtatatatatgtatatggctattgtgtgtgtatatgtgtgtgtgtgtgtttgtgtatatatatatggttattgtgtgtgtgtgtgtgtgtgtgtgtatatatatatatatatatatatatatatatatatatatggttgtcctctctcttttgctaggcagacatatgtctgaagctgatattatatatttgtctattattataaataaccaacataatggtatccatgttattaggtttgcaaaatattttttgaacagaaaacaccaatttagaaggaatacaaacttatattctgaagttcaagtggggagacataagaatgcctgtcctctaatttttttttgaaaaattattaaagctagtccaatgccagtgttggactagtaacctggattttttaaattaatagactttattttttagagcagtttcaggttcacagcaaaattgggcaacaaaaggtacagggagttcccgtgtgctccctgcaccagtgtggtacgtttgttacaactgatgaacctgcactgacacatcattgtccaccatgttcatagtttacattgggtcattcttgaatagtctgagttttgacagataaataacgacattttccaccattacgtatcatacagagttttttgagtgccataaaatacttccgtgaccccctatttatttctccctcctctgaatccccagcaaccactatctttttactgtatccatagttttttcttttccagaatgtcatgcagttggaatcatacagtttgtagcctttgaagatgagcatctttcagctagtcatatgcatttaagatctctccatgtcttttcatggcttgatagctcatttgttttttagtgctgaataatattccattatttggatataccacagtttatttatccattcacccactgaaggacatcttggttccttccaagttttgggaattatgaatgaagatgtaaacatctgtgtgcagattttcatgtggacataagtttttaattcatttgggcaaattccaaggagtgtgattgctggatgatagggaacagtatgtttagttttgtaagaaacttgcaaactgtcttccaaagtgatggcaccatttgtcattcttaccagcagtgtatgagagttcctgttgctccatatcttctccagcatttgtggttgttagtgttctgaattttggctattttaatagatgtgtcatgatacctcattttttaaattggcatttctttatggcatataatgcggagcatctttttgtatgtttacctgccatctttatatctttgggaggtctcttttcaggtcttttgaccatttcaaaataaggttgttcattttcttattttgagtttgaagagttgtttttatattagaataacaggcttttattatgtgtatcatttgtaaatattttcttccagtccgtggcttgtcttctcattctcttgaagaagaaaagcttccctgattggaaattgaactcaggccacagccatgaaaataataaatcctaaccactagaccagggagtgcatgctctagatttttaaaatcttgtaataagaatattaaaggattaattaaagtaaatatttggtcttttattttgttgtaaaactaaagatatgtcaattatctccaagagatctaaaagaatggaaaatatgtttcttccctgttttgatcattgagtgaggaggcaactaactgactcttaaaagcttggaacaattttcagaataattgaaccttggcagagctttgctataatcatttttaataatatttctatcaaacagttgtgagtccctataatgctaggtaacaaagttttgttgaaatatataaatttcttttatttagtttttgtagcataaccatattggtacatcaagtatttgaacatgcttacttttatagggaactaacaactcatcttctaaggcaaaaatcaaagaaggttactataaaaatccacaatcatgttaactttcaaagtcttagtttcactaaggatcattttttctttacagagatgaaaaggagtgcttactatttcaattaactcttggtttcttcatattatatttagctatttgagattaaatagattcatttaggtatcatggattaatttacatatatgactttaattatctttcaatatattatcaggtattgatttagactgttttcataagtcttttggtcttcctcaatagaaactgatttcctgtggatttacatgattgccctctaaataaccagggtgagataactgtgccaaaatgattggctggagagagtataagttcatttagaccacttttaaaaatatcaaagtattgtagtagatctctgttgtactttagcatgatttgaatcatgtcgtccaggtctgcatatctacctgcatatggagtaacacctgatcataaaatcacatttagcactattggtttaccatttccaagtactgattttagaactagatctcaaatagtaggcaatttttgtgttgtatctgtggggagagagagtctgctttcacatgactttctaaaagtagcaaattatatctaaatgatgtttaagtgttttaaaatgtaaacacttagattttaaatctaaaaacacttattggaaaaaaatctttatttcccttgcataatgttggcatgaatgcagcgtggctggattggcagttctgttactgcaggaagtggatttaaaaatgtataatttcaaagccaaataattcaggcaggcatgctcataggatggataggttcagtggatacatttgctctccccgcactcaccccactcaccccaccaaccctgactcctcctttgttttgtgctttgtctttcttttctgtagattgggatccaggttcaaaaatcttagcatagtttacccttctgtagtccaattttaaatactctaatggagtgttctattgttttgtagcaagtcaaatagttttctccatatatatatatatattgcttagccattccatacatagttaattcttttaatcttacctcataaatcaatatttctaggtcattaatcacccgtactgccctttacacatcttactgtatatatcccttttcccaatcccttgtaaacctgattttccctctgcacaaaatttattatataatcctaagtaggctgaagatataaatttctttttggaagaagagtgctttaacattaaaacgtctctaagactggtcttatctagatctgcgttgatcccgctatgtatcaaaggacaacctaaagccggaagataactgaataagtcttttaacttacttgccacttctaaaatattgagttacatttgaccagatagctccaataaagggacaagatttattgcttaggaaacttcaaccctgtattattgtgctttgtttagcagatttttctaaaggagaaacatatgtatttaaagaggtagaattttttattattgtaaatgaacaaaagatatttctagccagttgtgtctcctagaatgtactgtagttaggtagaattaggatgttgctttcaatttatgtatgtgatgcttatagtttcacacaactcaaggtatgtcttaaagtgagtgtgacatatagagagagaagcagcctccctattacatagatacttaacttagattgtatatgtgcttgcaaggattggaagccaagctgaaaatgggggtttttgtgggtatatttgctctcttttccccactctgactcctagtttgtttgtttgttttttttttttttgctttgcgctaactttcctttttctgtagattgggttccaggttcaaaatcttagtgtcacctttgattctcctttccttctctaccccataggtaattttaaaatatgtcagaacaatggcttcttttatctgctattttcttgttatttcaaacaatgtatttatagattgcctgatccttctaaagtgaaaactgcaggagagtaggattcctatttgccttgttcactcctaaatgcctggaacttagaacagcaagtgctcggtaaatatgtgtgtaatgaattaatgaatgtcacttgtcttagtcttccctttccatttgtactagctccacgtgggcgcttttgcttcatatctagattatttaaaatatatagcatcccatcaatttgaatttcaccattcagtacttactgcattctagaaggaggatggggaatgcagaaggtaatgtgtagttttaaacagggcagtcatggaacgctttagaagggacaagttctaatgacacctgggggtcaatcccagcaggacacagaagcaagcgtacatcctctcctgcaggaggctcctgtgtgatgtttcacatgctgacgggtgtgtagatgtggtggtagcagccttccgaagtcccctttatgttatttctattcaatgactaggagcaagaacattagctgtgaatgaggctggagaagaggtgttggaggtttgaggagagaatgaaatatataaaatagccatctgtgtgcatggccaattgaatggagtagagaagtgtggtgaaatcgcttgttctgcaccagctacattgggctgctgaggcctcagcatacggttgacagagagcttgatctaggcagcatctgcaaagcacagcaaactaagggtgggttaagggagttcagggtgagtgcaagggagagattgtaccgactgaccatgactttaaactgggtcaggcaggagggcagaaataggagtaaggggcagggaagagaagggaaataattggattttcaggattttatagcgaaagtttcagggttagggttgcagagggattgagctagaaagataagaaatggtagtcttagagtgggatatatgaagtctggaattttggagtggctgcaattatttgtcagaaacctggctggccaggatgcaggtcaagaccgtgatagaacaggccaaggaactagagaggctgaagcactggtccaactatctacacaggccctgaaatgggatagaacagtctgaaagaggaggcagacacttcgtctctagtcccagtgttataaaatggattttagagagaaaacaaccaacactgctggggagacagcatccttagggaaaagtcaggcttctgttagagcaagaagaggtgaaaaaggcaatctgagacagggaagggtatgcaaaagaggttttcctgatgaccgactgtgagcagcaggggcacagtgcaatggttttagcagttgatgaggtggcagagatgatttcagaaaaggagatgtgtagagccattcaggagccagaatgcaaaatgagaggtgacctagtgtttacactttattgggactaaagggcatggtgagtttggtctggagagtgctgaggtattggttggccatgagtataggaggaacagtaggctggggctcagctggaccttgagtcctgcaatagagggagggcagtccaagggcaggtgattttcctcctggcacgagagctcccttaagacacttttccactggtaaatttgtagtttattcatttcaccaccattttacagtccattttcaaaaaatgctgtgagtattcactcattctacttattcaggattgttgtgttgttgttcttttttgttgtcttttacaaatactgctgccatgaacattctcataaacataagtatagtttcttattgagaaagacaataatcatggataagggattctctagggaacatgcctaggaatgcaatcgcttggccacagaatatgtacatttttattttatttttatttttcagaagtaaagagtaaaaacattgaatgatctcatataacaaagtatctggaggaaacagctccttgatttcttcagggacccatatcttttgcatctttctgctgtagcatccttggaatattgtcttgttgcttcatggttggaacatggtgcccattgttctaggcatcctttcaccatctatctggacaagaagaaggaagaaaggaattgacatgtgcatctgcatttagcaggcatcattagtataaagctgtttgacaaatattaattgaaccatcatttgggtggcaatgtgtcaggctatggaatttaataattagtcaaaaatgtacaatttggactctttagcaaatcttacaggtccaaatacaagacttcttcctagaaatttattttacatgtctgattacgcagagaagggtcattccccaactccagcacactcttaacaattcttgtgttctgactctgaggagggaaaggatcaggaaaaataactaatggatactgggcttaatacctgggtgatgaaagaatctatacaacagactcccatgacacaagtttacctatgtaacaaacctgcacatgtacccttgaacttaaaataaaagttaaatttaaaaagtatgcatttttatatatgcagctttactaggcaatggtaaatggtttccaaagtgtatccatttacactcaaactagcaggaatgagacttcccatccctccatatcctcaccaacacttcacagtaccagaatttttttgtcatctagtaacataaagatgttttattagtgttctatttgcacccctgtgattattaatgaaattgagcatttttaatttgttttattggctattcagttatactcttctgttgttactatatatttcctgcttttctgtggggttgtgtttctttttcttgttgatctgttggagtactaatatgttttgaatactaatttttattgattatgcttgtatatatctatttggagtttatggcttaccttttaattttttaaatggcatctcttgatgagcaatcattgttaatgtggacaaatttatcaatttttatactttatggtgtgtccttttagctatctttcttaagaaatcgttgtctatcccaaaataataaagatttttttctgcatttttgttaattttcatatggtttggcctccaatatttcttttaatcacacagaattgaatttcatatatggtgtgagacagagatacagtttttctttttgcatgaatatgcagttgtcccgcaccatatatcgaaaactaccttccccattcatcagcaatgtcacctttcccatatgatcaagtttatgcaatcactcaagaaatatttattgaacacctgttctgtaccatgtactattaatctaacaaggaacaaaacaaacaatgattcctcatggagcttataattcagctcaggtaggaaggtaataaacaataagcattacagatgcattctatggtacattagaaaggaatgaatactatggaaaaaagagaaagtgaatgaatactatgaatattgtggaaaaaaagatctggataagggggtttggagttcttggtggggagaccgttattttaaatggggtggttgtggtaggtcgcattaagaaagggagaccgagacacttaaaagagatgaggtaatgaaacagacatctggaagaacactccaggcagacacaacacctagagcaagttccctccactgggaatttgcctgatatgttcaagggaagccagtgtggttagtgcagagtaaactgtggtgaaaatagatgaggagatcagagaagaggggtggggggcagagtaggtaaggctgtgctggccgctgtatgactctttttaggacacttattctttcttttttcttttcattgactatatgcgcctgttggaactaattctgttgtaaattgaaagacattgatccaattttattctacctggatggctaaccagatgtcccaacaccagttaatgaatcgtccatgtttccccactgatttgaggtctaactttgtgatttattgaatatgcaaaattatttgaactataactagatccctgctccagtgaccttatgttatacctgtacacactgattttttttttggagatttcctgactaattttttaaaataattcagtgtaaactacagaatcatcttctcaatttctaaaaagaaaaacctagttgtatttttattgcgatagtattatgtttataaattaattttgcaaaattaaccattttgtgatgtgtaatgatgtgcaatccttctatcacaaaatagtgtgttttctaatttttaagtcttgtttatactttaaatcatatttcaaaacttcttcaaatagatcttgtacatttattacatttttcccatgtactttattttttgttactataattgagtctcttatcaatatctcctaattgatcagcacttttgtatatgaaaactatagatttttgcatgttaattttgcatgctagtaccttactaagtttctatgttacttaccaattttcaggtggttttctctgagtaaatgatcatgtaatcttcaaagacttactgttttatctcatcattccccaatgttttaacctcattttttttctcttacctaattgtactggctagtgcctccaataagaatatttttaaaatgttaaatagtacagcaatagaggacatccatatcttcttcttgcctttagtagaagtgtgttgtattttcccgcatggttctgagattggagctttacatttgactttcttggtagatttttctttatttcttcattttcaatctctctgggtcactttgtttttagcacagacgtgtttttctttatgatcaaaactgaaagtttatttagtctttttatatttattaatagctgagatgttggtccaggttctgtgaaattattttgtaatgttttctatttttatctttctctgtgtgctcagttttctttgttcatgtgtatttgaaagagtatgtacactgtttattttgtttttatggttatctttataacggtatatcacctatagcccttattttttatgatagctattaattccctaatatgactaatgaacataattaatatactttctcttcttccctttctacagtaccacctgattttagtcaataatatcatatttcatagtgcttacctttgtctggttaaatatagttccatgctctaaatcctgtcctttgcctcccaatgataatagatgaagcaaaaaaaaaaaggatacctcacatgtttttctcatctctctctcgatttgtgttagttgtgtcatctgcatatgatatgtgttattgacattctgtactatcatcctgaagccaatgctaaatgatgagttgtgtagttatttatgtgaatgcttgacacagtcctttcaaagacattgccccagtcctttcctgagagtctcaagcttgtctccaaagagtttcctcaagagtggttcatagcaacaattatctttgaacttttgaatttcaaaaactatttatctggctgggcacagtggctcacgcctgtaatcccagcactttgggaagccaaggcaggcagatcaactgaggtcaggagttcgagaccagactggccaacatggcgaccccccgtctctactaaaaatacaaaaattaaccaggtgtggcacatgcctgtaatcccagctactggggaggctgaggcaggaggatcacttgaaccctaagaggcagaggttacagtgagccgagatcattccactgcactgggtgacagagcaagactccatctcaaaaaccaaaccaaacaaaaaaaacaacaacaacagaaaaaaacctatttatctgtagattttatacctaaagggcacttttcctggaaatatataccttggcaaaccttttcttatgaatcttgcaggtgcttatctattgtcttctgggatgagacattgaactggaaacacgaagtcaacctgactcttacaagtgacttgatagttttaaataactacacaaaagacttttaaataaatttttgataagttcactaatatatgtcattgggcaatgtttgctttaatttttcctggcccacaggtaataatttcttcagcaataaataagtagctcttgtatttcaaaacatttttataaccacatttaaaaatatttgtttttttctcattgttttgaatttttttgggggggacttcaattatgataaggtagcactcccttgccagactttacgtctctttcacattattcatttttctcatttctgtcctttctctcctctttgtatttttgcaatgctatttttcccttttacttcttccagtttcatttttatatattgagtttcttatttctacttgctttccgaattctggtgccttatgcttcatcttctcctattacatcaccatttcttccctgtcataattcttggtctcctttcatgtaagtgagggattcaccaagttttaaaaattcctggcaagctatttggtcatagtgtttaactctgtatggtatttttcatcaattagtaagttttgctgctcttttaaatattgtttttcttatagtaactttgatattgtgctaggtcccactttaatacttactgctgaattgaattgatttttcctaaatgcttatttaaagtgggcttctgggtctaggcttcttgatccaaccttttccctctctattctgtcggaaagaatgatggttgcaagtgtcatttgtttatgtatttatttgtgtttgtgggtccctcttctgcctctttgatccacaaatggatgtgaagggacttttactgggagccttatttatactcatttttgcaaacaagaaacaaatgttgtccctcatgagttctccctcaccagaaatacatttttttctggtgttttctagaatccctcaatgatctccatcactcaccatatttcctctctctccttcctcccacatagcttgtgccttatgttagctgcttttggtggtcagtttttctcctaattttacagcaagtgaggcttatggttcctttttatttttattcatcttatttcattcatatgatttccaaaataagaagaagaaaggagaaatgttcacactagaaattatattaacttttgagatttagtacttgttaggtaccaaggcactaaaggaggctgtgaagtggggcatttgctcaacacctcctctatttccttttgaaagtgaaagcttcttgtctgtggttactcatatgtcatcgtatatttaaaaatcaaaaatacagtaacatatttcaaaggaaagatgtattaggaaacccctcactgagtcagattgtgtgtgtgtgttgtgtgaattacttatacaagtatatggaatgcctatataaaattttagtatctaacatatttcaaattctgcttaccaattctattcaaatcatgtaatcgtatgcatgcatcaaagtaaataacgctatgcaaaaaagaataacttctgaatgtaaagaaagctattaacaaagcttctggattggtgaattgcgagtgtctggctgttactgggtagataaatggccaagtcagacttgttgatggagagtggtcaggagttcaatctgcatgtggattagttggctttattttggaaacaagctgaccaaacttcagccagctttcacaaatgaagattttggctcagggaaaaaaatgcatatttactaaaaaataataaaatgtaaatgaaaataaaaatactttgcatctgaatagtgaaagatgcattactatctttatttagggcagacaacatgctgtttaggtacatgttcatcttttctccttttatattcttaatatttctttcatggtcgaatagactgtggtggaaactgtggtggaaaaaacctaggttgataggactccaatctagtgtttcttattaaattatcttccagttaagttgtagtaagtgtgctttatgtgtgtgatatatatttcgtacatttcttgctttctttattattggagtttctaaatcataatcagagtatttcatagctctgtaaattgtgttaacttcctaagtattttattttagagggagccagtgcgatgatgggaaagtgggacccttttttttttcttactactataaatatcttttattgtagacagttctaagaattgttttctattaaatagctatagttttttcttctggagaatttcagtttgcatcattagacacaaggattttcaaattttctattaaaatattcatgatatgtaagatgtgaatggtaatagtctcttaatagatacaaaaataacattttttactctaattattcagtaagaaataactcttgcaagacacagaagatatatgtttagatataaactgtttaccacctttcaacattaaaggtattaggagagtagaatatattttacactcttgcccatttatattctcctttcacatttggctcactcattcctttggccttagagttaggtgtgacagtgtattagctaagctgtctcagtcattcaggccttttatcagttctacaagacagatgctaaatagcatagtctaaattgaagtctctgatgactctcggagacaagttgaaggcaagaactgcacttgggcacttaaatatgtggcctttttctatatttaactgcaagaagaaggcagcttttaagtaaactttttagcctttaactgtcaagaatttttttaatcatttgattgttgcatctcattttgttaagaaaggctattaaccttttctttttctcctacaatggagaattttaaagatcactgctgcctattattttaaacaaaaataatttaaaacaaattttgttgtttaaccattgctttcaggacaattgtagactatagagacatttttgaaatgaaatattgcttccaaatgtgccacagtttatctataaattttgaatgacatactcacaatttacttagcaatctttgggacctccttatgtcatacagttattacagaagcatttttaaaatcaagtggacctgaaagaatctggtatctatgaaatggagatagatgttaagtaatagagctgaagaaaatatgctttgaaatgtcgactgggatatgtttccatagcctgtttgaatttcagttcaccaagaggaaaacaaggagttgatgtgttctttgcagttcctcttagctccaaaagtgtgtgaatgctctgataatattgtatgtcctcagtatgtgttgaattaatacattgaagttttccctgccagcccttgttgcctgtagtgccttatttttaaagactccgtaggatgctcactcaacatgttaagttagaaaggtgtagaaggaatcgtagaggtcagccaggaacattttacaggaggctgaggctgcaagggtccaatccccacacctggcagttcctccacgtgcgctgagccgtcttctgaactgcctgcgtcttcgtggacctccttaaatctttctggaaacaaggccgcttacaatgtgtggtcaagctgaaaaaccagctgtagtaccaaactgtgctaaatcttttagctgaaatatttgtcaattttctttttttttgaggcagagtctcgctctgttgcccaggctgggggatatcttgcctcactgcaactccacttcctgagttcaagcaattctcctgcctcagcctcccgagtagctgggattacatgtgtgtaccaccatgcccggctaatttttgtatttttagtagacatggggtttcaccatgttggccaggctggtctcaaactcctgacctcaggtgatccgccccccttggcctcccaaaatgctgggattataggcgtaagccaccatgcctggctaattttctacatattactatcttatactgatagcattgcatctttctcatagcaccgattagaaaaaaaaatgcatcataagttatttgtttttctgtgatcatcaaaaggcaatggtaatttaaatgtaatttattataatatgcacatgttaattttggtttttatttatgttcatcatatttaaactagtctctgcaagtactttagactaatttagattatttcctttaagtctaacagaaaccttagattttcaaccagatttttcatttggacaaatgaatttcaaaacaggaaatatgaattttattgcaagagatttcacctagaaagtgtattgatctcatcaatagtgaatttttggttataagattgtagtaataattaataactacttaaatttataaaatttatagaaaattcagacaaattaattctgatttaactgttaactacaaaagttgtaaatggacaaatacagggaatagcaaacataattttctaataattatttctaattaaaattgtacagaattcaggttcataggaaattataatacgtttttgtctggatccactgaaacctgtaggtactctgtaaaggctaagtaacattttctaatgaaaaggaacaatgccttcagatcgaagaggtttatcttctgagtttgcagaattctatatattttttgtgacatttctcatattcttatttcaagtgcagattgtgggtggtatttttatctcttctcctaataatatatatcttggagctaatgtatttgagttgtatttttccccgctcgtactaaacctagtaacttgtgaaaattaagtagtcaatatatttttaatgaataaatgatataggtaaaagtctaatttagagctattttcttaactctgtttctagtaaataatttagtttatgtgaccatagatccccaaattcatatttatgagctcctaacattgaaaaacttactctgcactttacatgtttctctggccattttatgtaagtgcattggttatacatatagcttgttttctaaaatccactgcggttccataagtggttatataatttatgaattccagtgtaatagtccattaatttacctctcttttcctatttccagttaccattggttttgacctccttcagcaatcacaccttgctaacatctcagatcttgacatcccacagggtagaaaggctcctatagaatacagatccttcttcatatttctcacccattcctcagtgcactacagtctggcttccacctcatcatgtcactactgcttttagattttcagatggatactttcagtcctcctcttaatgatctccctttattattaaaaaacaaaaacaaaaaaaatggtctctctcacttgttgaattttatggtatcatcccttttccattttcttgctactattctgactattctttctattctcctatagaatcctcttgttgttaaatattcaggtactgtcttggggcctcagcctttttctcactatacactctctctttgggaaaagttgcccgtttccatagattgaacctaccacttggtcacagccaaacataaccaacagcttagacctctctaataaggactcttcagatgtccagttgttcagtgaccccccaagttgtttaccccacaggtattgcaagcttaatgtgaagaaggatcaaaccccacttcacagtagggatgtggtttgttaggaaaggtttgtgctgagtcttgaaggtgattaatggttattcaggagaaaaggaaggagaaaagaaaagagtgagggcacgagggagaattacaggctgatggaaaatcatggagaccaaggaggagcaggatatatttgagactgccagcattttggtgtgactaatgcttgaagggcctgtgcaggaacaacctgagagactgacagtcagcttgcaaatgtctttgtgtagtgtgtcaatgggaaatcattgatggattttaagtagatgagagatatgatttaattagtctattagaatattcattgtgcagcacacagaggaatcaactagaaaaagcaaagctggaggcaaaaagagcaaataaagaaaagacagagactttcttacacaaaatttaaaacttttaaatgctaaataaataaaatgggaaacaaagatgataagatattttcagtcaatacaaccagtatttaatatattccagtataaagatctcatacaaattaacattaatgaggaaaagacatgaacacgcattcacaatgcatgcatattgtatttatacaaaatgagaaaatgctcatcctcctttgttaaatgtagtaatctaaattgaacaggaagactcatctattttttaattagaaaataatattatcaagatcataaaatatacaaaaaatttacctcattatctcactttggagactctgtctgaaggaaataatataaaacatcatatgcctggaatatttatacaatgtaattacaataggcaaaaaattgaaataatataaattccaaatataatggcaaatagtaggtggaatattacttagctattaaatacaaaattttgatagaaatggcaacatcgaaacatattaaactaagtttaaaagtacactaaatggaaaggacataaaaatgtaaaaatatggtatctgcagtgctatgtttttgaaaagtttaaagggaaaagcacaaagttattaataggtggtaggattacaagtgatttaataagattttcttgcaagctttctacagtttcttattatttatatgatttaaacaaatagacaatttgtaactttgtagtcttgaaatctaaattccatctctgcctgtagctctcctcatccaatcggtcaggtgccccgaataatcctttagatttttgcttgaatttaataatctaggacagtgactgagggacatgtcctgtagagacaaagagattgggggttaaagtctttttctgactgtgtgctgacatggtgatttccagccggttattttctctcttcaatttccttgtctgtgaaataattttcatacggttttgttgcaaattgataccagtaatgttcataaagcaatgaacacagtatgaggggttttgttcttattcttgatgccaccttaatttaaggcttttgccatcccatgcttggaccactgcattgaaatgcagaccattcaccttgactctatattctcctgacctcaggccattctgttagaccttgactgaaaacccttcgggaagttgatggctcaaatcacttgaagttttccctgccagccattgttgcctatagtgccttatttttaaagactctataggatgcttaccaatatattgaatatttattgaaatacagtcatgtattccttaaatgtggggatccattcatgcgttgttaggcaatttcatcattgcatgaacatcatacagtgtacttacacaaacttagatggtattgcctactacacacctagactatgtgttgtagcctattgctcctgggcttcagacctgtacaagatgttactgtattgaatgctgtaggtaaatgtaagaagatggtaagtacttgtgtatcttaaacatatctaaagatagaaaaggtatggtaaaaatatggtgttataatcttctgggactacaatggtatatgtggtccgttgtttactgaaacattgttctgcaacacatgactatatataaagggcgaccttggagatatcacagattcagtttcagaccactgcaatgaagcaaatatctcagttcagagagtcacgtggtttttttgtttcccagtgcatataaattatatttatactatattatagtctaataaggtacaatagcattatgtctaaaaacaatgagcctaccataattaaaaatactgctaaaatatgctaacaatcatctgagccttcagtgagtcttagtctttttgctggtggagggtcttgctttgaggctgatggctgctgactgatcagtgtggtggttgctgaaagctggtgtggctgtgatgatttcttaaaataagacaacaatgaaatttgctgcattgattgatttttcttttcatgaaagatttctctgtagcatgtgatgctgtttaataccatttgatgcacagtaaaacttctttcaaaattggagtcaatcttctcaaattgtgcccatgctttatcaattaagtttatgtttgctgtcattgtccttttttatcattttgataatgttcaaagtatcttcaccaggagtagattctgcctcaagaaactactttctttgctcatccataagaagcagctcctcattaaagttttttatgaggttgcagcaatttggtcacatcttcacttctaattctagactttttgctatttctgctacatctccagttactccactgcagtcttgaacccttcaaagttattcatgaggattggaatcatccttccttttaatgttgatattttgacctcttcctatgaatcagaaaggttcttaatggcatttagaatggtaaatcctgaatcttttgcagaatatttaaatttacattgcccagatacatcagaggaatcaccatctatggcagctagagccttacaaaaatgtatttctttctttcctttttttttttttagatcgagtttcactcttgttgcccaggctggagtgcaatagcacaatctcagcttactgcaacctctgcctcccgggttcaagcgattctcctgcctcagtctcccaagtatctgggatcacaggcatgcaccaccacgcccagctaattttgtatttttagtagagccagggtttcaccatgttggtcaggctggtcttgaactcctgacctcaggtgatccacccccacctcaggcttccaaagtgctgggattacaggtgtgagccaccacacctggcctaaaatgtatttcttaagtaaaaaaaaaaaaaaagctgaaagtcaaaattaccccttgatgcatgggctgcagaatgggtgttgtgtaagcagggatgaaaacaacattcatctccttgtacatctccatcagagctctagggataccaagagctttgtcaatgaggagaatactttgaaagaaatctttttttctgagcagtagatctcaacagtgggctgaaaatattcaataaaccatgctatatacagatgtgttgtcatccaggctttgttgttccatttacagagtacaggaagcatagattttgcctcattattaagggctctagaactttttaagtgctcagtgaccactggcttcaacttagagtcaccagctgcgttagcccctaacaagagagtcagcctgtcttttgaaacttcaaagccaagcattgaattatcctcagtagctttagcagcccagtgtcctcttccaatagaaggctgtttattctacattaaaaatctgttgtttactgtagccactttcatcatttatcttaggtagatcttctggaaaatttgctgcagcttctccatcagcacttgctgcctcaccttgcactttaatttatggagatggtttctttccatacatctcacaaatcaacctctactagcttcacacttttcttctgaagcttcctcacctctctcagccttcacagaattgaagacagttagggccttcctctggattaggctttggcttgagagaatgttgtggctggtttgatcttctatccagaccactcaaactttttccgtatcagcaataagcctgtttcactttctcattattcatgtgttcactgggatagcactttttatttccttcaagaacttttcctttgcattcacaacttggctaactatttggtacaagaggtcttccagcctgtcctggtgtccaatatgccttcttcactgagcttaattatttctagcttttgattcagaggaagagatgtgtgactcttcccttcattcgaacacttaggagccatgtagagttattaattggactcatttcaatattgttctgtctcgggaaatagggaggcctgaggaagggagagagataggggaatggccaattggtggagcagttagaacacaaacatttatggattaaatttgttgccttatatgagagttgtttgtggtactcccccaaaatcacaatagtaacattgaagattactgatcacaggtcaccataacagatataataatgatgaaaaattgaaatagtaccaggattaccaaaacatgatgcagagacatgaagtgagccgatgctgttggaaaaatggcactgatagtcttacacaatgctaggttgccacagaccttcaatttactaaataaacacaatatctgtgaagcacaataaaccaaagtgcaataaaatgaatgtctctacgtatccgtaacaaataagactcatatcttttctgactatcatgatcataatatattgttaaattcttaaattgttatattgttataacttattataatcattttacttggtattatgagctcatttttgctatcattgagacacctatcttctattacaatacaattttcttattgtaataattttgtaagcattgtcctggtcatttggtgaccttgagtattgtaaaatttctgatgtagtgaagcaattacagttggcaaatgaggcagatactgaattacagaacttctcactcaggagcctacgctgaaggtaaccgatttaccattcctgagactaacagtccagtcctgacagaactcaagtcaacaggtcttgcccacccgtttataacaatggcgttttcatgaatcagaatttcagattgaacctgatgaaaacaagtaatcaatatctttgcatcctattgtttcagtgttctagtgggttggctaaatgggccaattagaataacacaatgcaaatttcctgcttgatataaaagtcttttttaaacagcttcagtttatgctaaataataaaaatagtgaaaaggaaattttcaaactatatgatgaagacttcaagagccttacattccttccttattattattagttttgtgaccatatgatggacactgtgatctaagtcctaaatccattatgccacattccgtaaatgtaggcatataaagtattctgtcatctgtagttatttcaaactgcattcaatatcttggttcccaagtgcattggattttattaaaagcattctgctgtaacatccattcttcccaattggtttacagattgcccctaccattcaggcaaaccctaattgcattttcccacaaatctcgtttgatttatggtctcttgtttgctttatattatttataataaattgaggtaaaattcttaaaacatgaaataaaatttataatattttctcttctacaaatatggaacttacctaaggattttcagagtcgttttgcttgttttaaaagttgtttagacaagctacaaccatctgcatggtttccaataataagttctttattaccatcccagaattaattatatttcgcttgattttttttatgtacagatgtttaggattatatggaataaattatgtatagaatataaaaatggtatgtccttctataaagcttaggtggttacacatgtcatatgtacctggaacagaaaaaaatattatttcagcagtagtgacaaagcatctgcataaaattcagtgccactgatgcaccgagacagctaattgagaacattcttgcttctgttacaagttccggcttttgagatgccaagagttagtttagaatggatctatagcagatcccaaaaagtataaagtgtttaaaaataagtaaatagcagaaatataaagacagaggataccagagacttaagaagagaatttctcactgtcaagtgattacatatcaccatggattattttgtaaagttctcttctaaataaaggctttccatggaagtgcaggcatggaatcatttctgtagggtacatgaaaatttattgaaaggaagaagtataagttatctatatcgatttatgaatagccttctaagctttgttagaaatgtgtctattcagtcaaaagtttgaacattaagaattttgagctgagaatcagaaagattggagtatattcagtataagagacaaaaagaaaagagaaattgattttttgagaagtgcaaagacaaaagggggaaagatggatgatctcaacaaattttagaccaactcagtaagtgggaggcttattatcaacagtaaaaataactatgtgacttctagaaaaactcagaaagggtggttagtggatgattagcaaacaaaatatctaaataatggttgtagttgagtttcttaaatggggctttgggactttcctcttcactagaatagtaaagaggccccaacatctgcagtgccagtggagacctcacgaggagcttgggcttgttccccacttagtgacgaaagagttgtctccttcccattggagttaagtcagaggactgcctagagagtcaggaatttcaccactgcccagggtaatgaggccacactgtttatgatgtcagtgtggacaatgggggagcagtaatgagtcactcctgccccttccagccaggagggcatcagtggaggcctagtgggttctggaatctccatccccacccagtattaataaggcactccctcctctggggtcacccagtattaatgaagcattctctcctctggggtcagcagacgccaagtagagtaatgagacctctaccccaacttggcagtaataaggtagcacccttcccccaacctttgccagagaaatgtcagaataagcaagctaaaacggaagctttaagatctcataatataatgtatcaaacatactggtttcacaagaaaatcagtaatgacaccaagaatcaggaagatctcagagtgaatgtaaaaatataatcaacaggtgccaacaacaagataacagaaatgttagaaatgtctagggaagaattttaaattagttacttccaaaaatgcttttatgaatattatgacacccttgagacaatgaaagagtggaaagtctcagaaaagaaatagacgatataaagatgaaccaaatagaaattgtagaactgaaaatacaactcaaattaaataaaagcatatttgggctcaacagcagaatgcagtaggcagaaggaagaatccacaaacttgaagatagagcagtagaagttacccaatatgaacgacagagaaaacaggctggaaaaagaaaaagtttcagggatctgtggcactgtaacaaaagatctaacattaatgtcattggagtctacaaggaaaggaaaaagaagccaggccaaagaagtactcaaagaaataatgactgaaaactttctaaatttggcaagagacatgaacctacagattcacaaagttgaacaaacttcaaacaggataaaaagcaaagaaatgcatgcaaaggcacatcgtaattaaacttctgaaaattaaagacagagaaaaatcgtggcataactaaaaaaaagtggcaccttataaataagggaaagcaatgtgaatgagagtggatttatcatccaaagccttgaagggtagatggaagtggcacactatttttcaagtgctaaaagatagaaccatgaaccttaaatcctacatccagttaaaatgtagttttggaaatgcagaagaaatcaataaaattggccaacttctagtaagacagacaaaggagaaaccgaagacacaaattaccaaatatcagaaatgaagaatggatatcttgagagaccctccagacatcagaaggataatacagaaaaaacacaagcaattctacacttgtaagtttaactacttaaataaaacgggccaattcctcagaaaatacatgttactgcaagtcatccaataggaagcagattctttgagtagctctataactttaaaggctattacatttgtaatagaaaactccatatcaaaaggtgacagaataaaaatcacagaagcatattgactgacgcagaaaaaaattgaaaaaattgaacatttagttataatgaaaaactatcagaaaaataagaatagagggggaaaggtcatcaacttgttaaagagcatctacaaaaaattttgcaactttattcataatagccaaacccaggaagtaatccatatgacctttaaaggtggatgggtagacaaactgatgtatccatgccatggaataccattcaccattaaacagcaatgaactgttgatataggttgacaaccccttatctgaaatgcttgggattcaaagtgttttggatttttgattttttcagctccaataagcatttcctgtgaacaaccatgtcagcgctcaaaaagtttcagattttggagcttttcagattttgatactcaatctgtacacacaacaacttatatgattctacagagatttatgtggagtgaaaaaggccaattccaaagggttacatgttgtatgattcttgaaataacaaaattatagaaatgaagaggacatagttgttgctaggggacgaaggttaaggggaagaaagagtgtggctgtataagggcaaattgagggaactttgtggtggtagaaatgttcttgtctgtatcaatgtcaataacctattgtgatatagtatcacagtttgtaggatattcccattcgggaaagcaactaaaggctatgtgtgttctctgtgtgttatttcttacaactgcatatggatctatgattatcttaacaaaaagttaaacaagaaaaataaaataaaataaatgaggcttttgctgaccagtaatcagtgttctacaataacaatacacacacacatgcacatacatatttgcactatacactggcactattgcacataatttactataaatatttgttcacacatttatgctcatttaacttggtcaaattttctttctttagattgtattatatcacttttttgagggtgttaaaatggtgccatattggtagatgttaccatctaccttttctaaaaaaaaataactttttggcaacataaaaatttgtcaatcatttatcatttccaaaaaatgtgattcaagatttactcctccatgaatttcagaagtccaggaatcacagttctacagtttccatgatagtaatatagctaaaactgttctttttatgtagcctccagcttaaagagctgaacaaaatagttgttaaatacatgtggttatttgataattgaatgaatttgactgaaaatggtggctattaattctaattccagaacaaattcctaatcttcaataagtaaaaggaaatcttccttcctactggtaatacccaatgctgcctcaattactcatataatcatatactgggagtaatgtgctatgtagtggagtaaattctaaactctaataaatgtgtgttacctcactcttcaactccacttcagcatttaatcattgtaataaggtatttcttaataccacacttaatttcaaatataatccttttatatatgtattagatacaatgtatttttcatatctaatatgtgtattgtatgtttatttattgtatgttatttagatatgttaatatattcattaaaattggagtttttaacaaaaatattacaaattaacatataaaataactaaaaatattaggttatattattttgtctatagttagtattagcaaagtaataatgaatttattaagctaatatataaaatgactagtatttaccttttttcagtaagcagggaaaaataatcgtgtttagactatatgtaaggaacagaatagtacatttattttctaaatagtttacttactactttcaattttgtaatctaatgaattagttccaatgtaaatacagatttaaaagatgtattcattgtaaataactctatagggaatatttcttcttcaatgaaaatttcagttttggagatggaagtttctcatcagttctaatttctcacctattctaatgttactttcttgtgaattcatgttaccaaatgtatgctgtacacacacatagtaggccacctttttctctttctacactaatttattattagttttatatcattttagtagttttattgttaatattcataatgtgagaacatattccactattttccatatatatagaaagattgaaatgttttaaattacttcagtattccataaagtatatcagacccaagattagaatttataagtatttgaaattgtaaaagttttaacattctaagcgtaagacacctctattaaaatgtttttcacaaacataatatcagttttctcttccctctaaagtgatattttaagagacattttctaggaatgctttctaaagtagcttgaaataaagtagacttttaatagtgattataaaataattttctttcccaggtgtttgtattaacagatttctgttgtcccttatttgataatgtgtttttatcttccaacatatttatacaaactgaaatctttaaaaacagaaagttcttttattatgaatttttttagtatgtcttaaaacctgatccctatttttttttttccaattaaggtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtaagtcagggcacagctgtgccggccagctgcacccgctgaagtgacatctcccaatgccaaacacacttggctgcttaagtaaataaactggagtcatttctcagcacatggaagatggtgggaaagctcttagagaaagcccccctgtgtcagccatccaccttgactaacaattaaattatagcctgcaaagaagaaaatgacagagttgctttgccttagagagttgtctgctgcccaattcatctctatttttatgagaacctggcagcccggcctgtttcaggcagtccatcaaatgatggaactggtggctggatacggagagcaacagccatttatctcccccagatttcaccttcctgcaggacacttccaaatggaagctttaattacctaaatggataggtcaagattgtctgctccctggaaatgcagagtagaatacaaaagcaggccgatcccaatcctggctctcctctccgtccccgcctgtgtcagcaagcgcgatggctgtcacacgtgccctgttagaggctgacctccaccgccaaagccattacagcacggacatttttctgacaaaaggttaattggcttcaaaataaatgtattgcctaatgactccattctaatgtggttgtgttcctttgtaaaaggctcactgatgttatttgtaaaaacttgccaatctcttaaccggagaaggcttttacatttaatctgagaaaaataaatgctggtctctaaccagcttctgctatttaattattgttgttatcaaagactttgcttttggtgatatttatcaactaaaagggcttctctgcctacagacagcaaagcagttgtgcacacttatgagtatcacatcaggttaaggacaagaaaaggttttggccaactattagttaaattaagcaattgacacatttaactgggaagtccagcagtcgtgaccaaaagcaaatcaggaattgtttttaattagtaacaaataaatttatgttaaaaataaaagtacaaatcagagaaatcaaagtaaatagcttaaaaaggtgcattaaaattaaatttttccttcctgtatagacacattgaaaggattattgcattatatctagtatgtcttttgaaatattttcatattgttatcaaacatttctaattcttgagcagtcatccaatatcagttattgaacttagaattattccaacttatattacaagaggaacttggtagtatccttattaggaaaccttactataaaattttgggggggtgggaaagaggtgagtaacattattatctcctttataatagtgtctgttagaatgtgaacttgttatgtgaaaatgtacgtatgatgagaaaaaatttatagcgtgtataactaactttcatactttagtcttaatataagcatatatttccaaagttttgtttggatttttggattcatatatttgattggttgcatggattttgtgtttgcctgtctatgtactggctcatagatatgtactggctccaagataatacaatggagtttcttcaaaacctgattcctgttgagtaaaataatatgtcataattctttataaaaagggagtggcttttggtgttttaggtaattataacctacacataaattgtattaatgaaaataaattatatagatttactatgattcaaataattttatgagcaacctttagaagtgtagagactagaaaaaatcattttgaaaataaattattaataaaaatatgagatgaatcattttctttatctttgataatccaacagtcagcagggatataaaatgcttttcttttttatggatatattaattctcttaagctactattgattatagtactgattcagcaagctaaaaagtaataaaaagaagaaacaatttctttgctgtcactggtagtataatagcataaatttaggaaaacatcttattccggaagctgtggacttcttttagacagtagctactacattttaattgcattactgtaacactgaagataagacattaagattattttttattttatttatttattttttgagacggagtctcgctctgtcccccaggctagagcgcagtgacacgatcttggctcactgcaacctccgcctcctgggttcacgccattctcctgcctcagcctcccgagtagctgggactacaggctcccgccaccacgcccggctaattttttgtatttttagtagagacggggtttcactgtgttagccaggatggtctcgatctcctgacctcgtgatccgcctgtctcagcttcccaaagtgctgggattacaggcgtgagccaccgcgcccagccaagacattaagattgttaaacataggcttgggaaccatctgtccatagtttcatatttatttcgtggcacatttgatgaaaggacaatctggtgctaagtaggaggagggacttgttttaggatgccattcttaaggaagaactcttgagtgttgaaggaagcagggcgatccgtcccccacaaaaaactaaaagcaagaggccaagaccctgcactcttctcttgtgtgtgggcagagcaccggtttctggtcatgcaaacctctggtctcaatgtcatagctcatccctcactgaggactgctgaggagcagtgcttccctccgaggataccggccctctctcaactctcctcagacaccctagagactccaagtggacttgtgagcacctgaaatgatgcacataactaagtgagaagcaggtctgttgcttttatcagtgtttccagagcctgtggctccgaaggacttaggatgcactggctgtaaaccccggcacaggctgccccagcctctcacggtcattccagtctgtgaatgtgctggtctggggatccctccccaggtcctcagactcctcttctatttgttctggattagctgacctgatcttcaccaggttaggaaccattgtgtgttcttgaaataacaaaggcactctatggtaacatcagaaagtagaagcaagagttagagacagacagatgtctttgcatgcttaggtttctcagcccacgccctgctctcagtaccagtttcatgcacatggaagtggtcattagttccagatgccaaaacaacgtggcaggctgcgtgtcatcgtctctgcagcttcgtctctttcttgtggcatctctgaagattgcagcagtgtctgatccaacagtctgcagtggtggaaatgttctacatctgcaccgtctaatatggtacaattggccatatgtggtgattaagcacttgaaatgtgcctacggagactgaggaactcaatttttaattttatttaattttaattaattttaatttaaatagccacgtggttaccatattagaccatgcagctacagattaagataatggcagtcaaaaataaatgcctgaatctgctacccagatagatagaaggctatcactgtgttagaatttttattattaaagtgaaaaaacgggactcatctgtggattttttgtcatggttttctatgcatatcataaatttattagtaaatgtgagaaacgttttgcaaaatgtttgtagtgaaaatttctatatacttatcaatggcaagttcatgagctatgaaagttgaataaatctcatctcgaatatgaaatctaccggcaagcccaggaatagctttttttttaatttttaaatatgcattttctaaatatcactaaagaattcttgattatcaatggttgtagttataaaaaagcataaggaatacttaaacaaaaaaaatgttaatctgtttcttttgctacattttccttgacccctctaacatttgggaaatacgactgttgattcttttgctgtcttcaatatccacattattggcaacaagtgagaaaagagctaagctgtctggataagttacaaagcagataatcagatgaacgatggaattttaaaaattgtgtttgagttttctcatcttaaattgccatcctttaattttctgtccttctgtaatataaatcgcacacttctaatgatggtgatcggggtggggacggggctctttgtaaaggttttccatatgggcacctggggagggaagaaatgctatatgaattggtaaaatacatggcccattgtctctacctctgctgtgtaaataaagagcgaagagaagcatacaagtggttttgaaacggtctcttcaatagagacctcgagagaaagagatgaagataaatacctgaggcactgttaatttttagaaataactatatcatattataaaccattcatttattttgaagatggaaacagctacacctacataaaggtgtctctaaaatctttcactttctaggcattttgatgtagtagatattgatacaggtcatctttctccatgataacgtgctacgtgacagaatatgacatgcactaagacggtcttgttttccactaaatttctaataaccaggcgtaagaatgtcccaggtatcagagatatttgaataggacgtagataaacctgtaatcctctaggaaaatcaggatagaataccacccttttatgcatgcaacaaaatcacaaacctctcaaatttgaaagggagaaactcaaaatggacttgtattttgtccaaaatccttccccactgcccgcacagcacccgatcaacccacacccggcaatgtcatgatggtccttgtccagagtagcagacatgccagaggcctttctgcgttcttgttttttcttctttgacacgtaaatgatattccatagccacctatattgaaatgaataaaaccagaactgatacatatgagcaggtatatgtgagaatggacttaggtggcctctactcactgccaaaaatgtatcttcctcactgccctattagagaatatgaaatctcaccatggaggcaaatttccccttaggttaatatagtaattttacctgttgattaaaatttagatctccagactttgttttgtattaaaaaatgacttattaatcaggtaactatacacatttaatactttttataaataaatgttgacatacatatgtcatttatatatttataccccacattatttcaaaacggatttaaattgtcttacaaaaaaactataaagtcagcaaaaataagagatgagagaaatgaaaaccatagggacccaaaatggatccagtaacaatgttagtaaaaacaggcatatcctgaaatcctataaggcgagatctttgtctgtatttctggtttattcactcactttcctggtacctagaacagtactgtcacagggcaggtgcccagggatatttgttgaatgcaagtaaagcatacaggagctgattgtttttaagttttatttctcttgcttcgtaggcctcactttccttatctgtaagtgacaacaatataccaggtgatttctatggcccttttaaattatgagcattcaaataagttttgtttcataattattaaaataattgtattttgatatgttggtggaatacttcaaagaacaaatattgagtacaaatttgccacagagatcaattcttctggtagcaaaatggaaatattagcagcagcacatttaatttgaatccatagcactttaggttccagaatgatatgcaacggtcttgagggggttgaacttttaccaggaggatgctctttaggttatacacgaatgctttccaatgactactcatcccttaaagtttgctttcaaaatgacaaattcgcttccctttctaaaggactgaaaatatatgttgcacttgaacacccaagtaaaggaaatgctgtgaataaattaattagatgcataaatcagcctttataatttccactgatggtgtctcagacaacacctttaattatgtgttgactgacaattccattcagtatttcttctctggcattttctcctttttttctagttctttttatttctcagcagcattggtattcaggaactataaaaatctctgtcaatgtgactgttttcattgacataactgataatttcctagtaggaaaaacagttattgcatataattattataaaaatatgcacacattttcttacaattaaaatcagcccaactgaggatagctcattatctgtaaatattactgcattttaaagtaaatcacactgtgatgtgatactcgatccatttgctatcagaatattcacaagattccgtaattttgagttataatttagtcccttggtaccttcaatttcttaatgtttcaatttcttaaggattttaaaaaaataatgctatatctgttgcccctaaggtaaaactgatattgacttttgaaatcttgtaggcaaatttatttgagctgaataatttgtttcacatcaaggagaatgaatgttctcttggaattgtcctgggtttctatttcttttgataactgccaaagcttgagtttggataataggacttagtagaatttgcaaggcaaattttacaagagaagtgacaatttacctgatttttgtacaagagatctgccacgttcccacaattatttcctttgtgattaattaatagacagagcttattccagaagttttgaaaaaaaaaatcctctggcaatgagtgtactattcttaatgccattcttttatttgatgtaaattgttacatcttaaaagtgtatagcatgaaaatacagccatgtattagaaataacttttatttaaattggttagatgacctctgaaaaccagatgaaagattttctgctgaatgggctggtgctccctgctgcctatataatttatgtgagaaattagtgcaaatggttcacttttatgtagcagagctgcttgtagcaagcctgcagaaacaattttcccccaagcctccatctgttcttcaaactagggcatacgccatctcatcgagcttgaaagtcaactgatttataactcctggaaagtgtatagattgaaaagaaaggtcgactgctgctctgtgacagtgatttgtttggcattggctaaagacaattcacattaccagggacccaagggaaacaagaaatgttgtaagtttcagatctcagtagactgacaactagaagaaaaacaaatcactcctgctttttaagtcagacgaccaccagggttgaaaagtaggtcttggtagtgttaagggtgccaaagctaagctgccacccatattgtcacttagcacctcatgaagaaatgtgtcactgcccaccctctcagtggtaaatgttgacgttgtagaagtatcaatactctaatttttaaacacaaaatatgtgtcactgcttgtcagaatgttctgtttggagacacaaattggtctttgatgaattttctgtatctacccaaggataatctccagttgtattccaattagtaatttaatgaacagttcgctcctgtcttatcactcgtcacacgtctcttctctttactgaagcactattgagatcaaaagtcctttgacagatgacaaatggaatcagattggcagtatgcttgtaaacaacaacaagaaaatcattctttgtttgatgttttcctttgagtagtcaaagtatcatcctcccagataacaacttttagtctattgaagtttttgttgtcttttttctacatgtatgtatgttttttattttgtcgaaactgtgtttcacatgataatttttaaggaactcaaaggaacattcatggtcctaattaagacaggagattgatagtggacatactgccacaggaattctaatagttttttccagtttaatgacaacgaaaaagacaatcatcttttaatgtgcaggtttaagttttcagcggtcattactaagacctttggaaaggagatacccaaacatgtttctatgcaaagctccatgttagcagggatgcacatacatggcttttcctgtagtaattctcatggtatggtgcccaaccacgtaagcaggcttgcctttgtgagcatgtcattaccatgtttttgaagagcagagtaactactattttcacaaagttcattatgtatgaagcacatttcttgctattgggaaaagtatagaaatggacagagttgacagaatcattttaaagccaacctctgcccctactctaagagactgtctttacaacaaatactcctacagaatttccaagattgggttctaatctgagtaaaagaaaacccatcaacctttgtagccataaattctcaaattttgagttcttatttagattgatctctctctgttcattcatagttttaagcacttaaaaaaaacaggtatatggtttgaatatttctgaattcttgaatatcttgaaaatataaaatttcaactttcatgtacataaaacacaatttaattgaaattagcattcttaaattacaattgcttcccttcatatctctttagaagataacatctttgtattctattaatgacatatgttatgttaggtatattataacacatgtattataacatgtattataacatatatgtatatgtataacatataacatatgttattatgttatgtatatccaattccattgatctcattttctgtagaaattccctttattttctgcctgcacatttgttattatactgatttgccgttgcatgttacattttcctttttctgtatcttcacagataattttgtggtatgtggagagatactgtgtcagagatttgtgtcaagatgctatgtatatatgctgaaaaattaagactagcctgattttattcctttaatgtcaatgtattgtttgtttgtttgttttgtttaacagccttggtaaatgcactatttttgtgtaattaaaaattgcttccatgtatttttcttttccttttgtgtattcttccattagtacagtaagcttattgtctacttacttgaaactttctcaactgaggaaagttttcttttgtaatattacttattgttactctgtcccaattttctgttttctttcttagaacaaatattacatgtagattatacatttatattctgttctattatttctatcattatctccctcaatatttttatctctttatccttgttttaacttctggcagagctttcttttctcttctttttttttttttgagacagagtcttgctctgttgcccaggctggagtgcagtggtgcaatctcggctcactgcaagctccacctcctgggttcaagcgattctcctgcctcagcctcccgagtagctgggactacaggcgcccgccaccacacccggctaattttttctatttttttagtagagatgggatttcaccgtgttagccaagatggtctcgatctcctgacctcgtgatccgcctgcctaggcctcccaaagtgctgggattacaggcctgaaccaccgcgcctggccagagctttcttatgttttctatttttgttggtatggatctatccattactgccaccagttcaaattttagctgtgcttaggtaaactgccctgcacctggccaatacccagtgtctagcatgagcatgtttcacctggtcttattctgttggcctaaaaggggactttgtaacttctgacactgagatagctggagtacacaaacacctataatccctaaaaggcacaggtacccagctctgtctttgcctgcctttacctatagcattttgcttgtgggacacactgctttctaggacagaatgcaatgtggtaccagaaatctctgtccctacagagatttgttgttgtttcttgagttgactgtgaatggatgtaggaagggtgaatggaagtggatagtgctttgtcttgaaaggcaactacttcaaggtagcaggctggtggcctagtccctcccgcccccaccatcacccttttattctagaccttatgtttctgaccgggccaggaagggggatcagaaagtgtgggagagatgaaaaagctgactacctacctttggattggtgcctctggttgcaaaacataagttgactatgaattgtggttttccaatccaattccattgatctcattttctgtagaaattccttttattttctgcctgcacatttgttattatacagatttgccgttgcattttcctctttttctgtatcttcatagataattttgtggtatgttgggagatactgtgtcagagattcgtgtcaagatgctatttaaaaacactgagtccaattcatttttgtgcattaatggactatattcctttgcagagaagtaatgtgatctcattaacaggctacagtgacttgtctattcataaaggaattgagtacttataatgggaaagacatggtgctgagctctgtaacctgcataatatgagttctggtcttaagaagcttattgactagaatagatcactattcaaggaagaaaccgaaagtcctttcaaagagtatatatcaagtcttaagacagattgcttccgcttgcatagatcataattcttaatcctttatgcagtatgtgttaaacatttgctgcttcagtgatctggttcaaataatttctgtagacaaacttttcaaattgagagtctctataaaacttttgccagttcataaatggttatctatttcagggagtgcagcttgctgacacttttgtttttcttgtatttcagtttttttaattgccatattaagaaataataaattttacctttaaaatgacctttaggtagtcaatccacatacctatgtatctacatattgtggcaatcccaagtatcaataagatattactgacttcagtgttctactctgtactttgaaataaacactttgaaaaaaattatgtttttacctatttgtgaattttaaaggtttatcgtgcttgggattcagtctgatttaagtctgaagacttctggagtcatgattaaatacgagctgggctttctcattccagctttcacatctctgcatctccgttctcttattttctatctttttaaatcaccgtgtttcattcactttttaattcactgtgtgttgtaggtgatttcctcaactctgtcttccaacttaataatttactagtttaatctactgtataatttgttgaaattttttcaaatttactttcagtgaatatcaattctggaatttatatttgtttcttaaaaagatctgcctactcttatatttttctcactttatggtttctcttactatctttattagattgtatttttaagtcactcatttgaggttctttttcacactcatctattatcttgagctcctggggtgtgacttggaatctgccttctgtgggaggccctcgcggcctgggttgtgaaggcacccgtgtgctgtgctttcaggttcgtctctgcaggacacacattctgaacctcttttgatgtgaatcagccttcacgtttcctcactgggctcctgctcactgctctagatttgagtttccctttcatttctggggacttagtatttgcctatcttacttttgagaatggctatgcatttatttattttattttattttattttatttttcttcccgtatttatagttttggccatattgaccagaggtctattaattctgtaaaattgttttctcaattaactgaatatcttcgcttacatgcagattaaagtaccatcttgagatgtaatctttcctcaatgtcagaccaattctaatacttcctcaagtacaaaaaaaatcaatagaataaaatatgttttgtatttcccatggaagtccctttatgtaagcaagttacctttatgtaagctaatgtgtattgcatgattgtgtatgtgtgtgtgtaatcaaacacacataaattaaaactctgttgaacatagcaaaacttgggtttggaaaaatcacaaggaaaagacataaaaattttgtgccaacccacaactctcatttttgtatgtatatagtacgtgcatgtgtatgtgtgtatttacatgtatatgcaaatatgtgtagacattttgttcctatttcagtactggagtaaagatttttcttttttcttttttcttttttttttttttgagatggagtttcactcttgttgcccaggctggagtgcaatggtgcaatctcggctcatcgcaacctctatcacctgggttcaagctattctcctgcctcagcctcccaagtagctggaattacaggcatgcgccaccacacccagctaattttgtatttttagtagagacggggtttctccacgttggtcaggctggtctcgaactcctgacctcaggtgatctgcctgcctcagcctcccaaagtgctgggattagcgacgtgagccaccgcacccagccaagattttaattgtcatactgtaaaattaaggtgggtggggttatcctaaggagacctttatcttctcaatattcatatctattactatgaatctcttgagaagcattaacccttccaatggaaaacatctttcaaatgctttccatttgcagtaagttgcataacattttactaaacatcattcaatactttttaaaaatcaacaaattatagcattggattggaggtaatttagtgtttagaaatcatcttcatagaaataatcactgtagacttgttattaatttttatttttgaagagttgcttgggtaatgattaagtaatttatatatgcacaaaaagacttcatttacataaatttttatttatatattttaaatgcattatgagaagtgctagtgtattagattggtaatattaaaaccacaagtcaaaaaatacaaaagttaagatttttataattctatttgggaatctctagctttttctgttggtgtgggctataatttcaacactgcattattctaacttattacatttaataaactaacaattgggactagcttcaaatctcaagcagcaatttagtagatggttcatttcatgagaaagaaatatggactatggtgactatgactgtactattgcagaaatggaagaaagtgaaagtaaaatgtattggttagttgcaatattaccagtaatattttgtctggccaataatattagaatgtagatcaatttgcacaaataatgagctccacgaccaaatgaataatcctctatggaatatactagtattgcagaaaacctttttggtaagaaattttgcatgctattactgtaaagcatcattatttggcttcttaaataatcactttgttcttctcatcacttgatgtcttgtactttatacatcagacatctctgtgcatgtagattaccaaccatgctgcctccctttttgtctctgaacctgtaccatgctggcctctcttgaatgcctccattgcctccatatccacctcctctgctcagcctctaactgctcatctgcttgcacctggctcagctcttacagtctcctaaaagtctttcctgactttcccaggccagattgagtacccttcttggggaaaccagcatatgctattactggtctcatcactgagtaagatagtgatctgttttcacatctcccctcaagatgggggactgcagaagaactggagcagggttatttaactttgacctgccttagcccctgatacaacatgagtaaatattttaaggctgatgtttcaaatgattcattaaaatacatttttatacttttcatatatttttgtttgttgaatacagtagcaatttgaattttcatctacttgcaaaccaagaatgagggtggttatctgtgacttttaaattttctttacaggtcccatagatcttttggtagctctatttatttttgttttcttatagaatgtagtttgcagtacttttaaaacctgtatagtatcagctcactgaatattgctgattgctgaagaaaagtgtttgttcatttaaaccccagtgatctgatcatatttaaattgcattcttatctatgtgttgtctttaaatatgtgctgtccaattggtgctcatgtaacttgtaagaagcatcattcatttgctaggcattacctgagtacttactgggtgtcagaccctgctctgctctggaaatacagcagtgaatgaagcagcgaaattctcagggctcatggagcttccactacagtaggaaaactgaaacaaccaaacaaataaatatagagactgataaatggtaatagtatgaagcaaaataaagcagggtgaaagagagagttgtgagaggatatagcacccttttgtggggtggtcagaggaaattttccaaataaggtgacattaatgtgtaggctatttggtaatattgtctaaattatttttaaaaataagagtcctaacttaataatttgccctgtttaaaatgcagtgatatcaaaaagaataaagtgttaaagagaatgcaatgaaaataatctagtaaattgtgcaatttcaggacctagtactaaaaatcagtgtaagagttataacccgacactaatgaattaacaaattatattttaattaaatttttattccactaaaaccctaattgaggaatcatgaatgactgtgttttgtacatttcaacataaatattttgtgagtttatgcaaatatatatttcctttgtgaaaagtacttttcacatttcaaaaataagaaaaacctaaatagccaagcaaatccattttttgtgtcccctttctctcttcttttgaaagtaaaatcgttactagtgagcagatttagaaaaacaaacaggaaatgatgagacacatgtgagcagataaagtgtcatatctagattgtctttagagagggcacacgaaagcaagccccaaatgcaggcaaggcctggcctgcagggaagacacattcagatggagtcacagctcatgaacttttttgggatacaaatatataaaagtttctgctatggcagttgtataacaggatgtatctgagaaattaatggaattaaatgaaaagagatgaaactgagtattaaagacgtgcactattcatttgtttgttctgagcattctttcatccatcacacatttcagaaggttgcaatttattaagtgcagtgaaaatcactggtgatataggcctttgtgcagtgtatacaattagtcataagtacagtcatgagctgcataatgtggttttggtgaacgatgaactgcatattcgatggtgggaccgtaagattataacagatctgaaaaattcatattacctagcaatgacatagccattggaacgttcagcaacatatgttgccttttctcttcagagataaggatgttctttttctccgggtataggaagggcacccctcacatatgagggtcttatgaccggctttaggaaaacaaggtgggagaatgtgtgagagaacttcctgcttcttccatttttaaagatgtggcatatttggggatcgctgtcctgaccctgtcatcactcaatccctactttggactttagattatcttgcaatgccttctcattattatttattcaaatgggaccctaacacaaaaccaatgtggtatagaaagttaacagcaagaagggctagtgtctctgaggctgcagtaaacaggaggaagggcgtggtccactctcagaatgctgtcatggttcagagctgagggatttaatattgtttgggtatttttttctcttctctcaccctcttgccccattcctcactttatagcaacaccgatgtatttaccaacctcaagtgtactaacttgagcagtttggggaatcggggattaagatcttgtgcttcttggggccctggggacaatggttgaactgtgtcaggcagccagactggaatcaggtggagtcactggcaggttagaagcccttaattttgtcatgcctctcacttcctgtgaccctgacctgcccctacccactcacccacatggctccagccatactggcttccttgattttccaagaaaacaaaactcccaggtctcccgctggccttcatcaggaatgagtttctccaactcttggccaacttcccctcttcagggctgtgctccgatatatcaaacagccatccttggcacccattctcatccccctctccccagggacacagtgatgtttctccagagctcaataccatgcctgtcccaggcaaaacactgggataagaaagacattttgtctgtggctctcgctaccatccagtaatagctccaaatgattttagacagcaaggattaaaggatggtgatctagttgaaagtgtgcaggcatggtggggggtagacgtcttacattaaaacgatgtttacttatcaagcatttagttatttgggcggctttggtggagggctcagttgaaggagacgaagttggggagagaggactgagacatcctgagacatcccttctagctgctgctggaaccttcttacttttcttactttcaacaaacacgttctcagctctcctttatttagtcatgaatttactcatttattcaagaaacatgcgttgagcatctttgttactgccattagttccaataatatcttctatttctaatctgcttcattttgtcctattctgcctgctattaaaacccacctcttctgtgagaatcccatagattattgttattcttctaacataccgttcattctttaaacccagaagagtgcaactttcatgatggtatttggagcacggaggcaggcaggtagggtttagagggtaagagggagacaagcagagctgaagggttttgaaactgccttcaaagccaacgcatacaccaccacttattcattctaagataggtctttgtgattaaaatttagtgatgttcaatttatatttattgcttttcattgttttattaaatatttcattcgacaagtacttattgagcatttatgataagccagacattgattagatgctgtacatacagcatctaaattcttgccctggtagtgcttgagatcttgaataaggtgaaatcataagaatgccatattatttcttggcattagtgaaacttgatacatttattttgtttctttgattaaacttccttttgtaagttccaggatacatggcaggatgtgcagatttgttacataggtaaatgtgtgccatggtggtttgcggcacctatcaacccagcacctaggaattcagcccagcaagcattagttatttatcctgatgctctccctccccatgcacctccaccccacaagaggccccagtgtgtgttgtttccctccctgtgtccacgtgttctcattgttcagctccaacttgtaagtgagaatatacggtgtttaggttttctgttcctgagttagttttccaaggttaatggcttccagctccatccatgttcctgcaaaggacgtaatcttgctcctttttatggctgcatagtattccttggtatatatgtaccacattttctttatcaagtttatcattgatgggcatttgggttgattccatgtctttgctatcatgaatagcactgaagtgaatgtacacatgcatgtatctttataatagaatgatttatattcctttgtgtatatacccaggaatgggattgctgggtcaaatgtatgtctggctctaggtctttgaggaatcaccacactgtcttccacaatggttgaactaaattacattcccataaacagtgtaaaagcgttcctatttctccatagcctctccagaatctattgcttcttgacttttcaatactcgtcattctgacttgtgtgagatgatatctcattgtggttttgatttgcatttctctaatgatcgtgatgatgatgatgttgagcttttttcatgtttcttggccacataaatgtcttcttttgagaaatgtctgttcatgtcttttgcccacttcttaatggggttgtttgtttttttaagaaaagacattttttaatcaattatttttcatgaaatctaaatatgccttatcagtgctccaatctgtgtgggctggttgtttctaaattttatttttaataattgagtgatattaaataaaattcttgctatatttggtttaaaatggttttgatgtttagcttttgttagtggcatttacaaattctaaacaacttgtaccacatctattatattctttagcttctgctgggatttgctgtgtaaaagagagtgggaacaatgtagctcacattattctgataattaacatctgtgaaggacaagcttctgcataaatttttcccataatgggaggaagtgaatagaaacagaatgagcattgtgagctatggttttaatatttaaaatatttttctcttaggaactgaacctctagcttctgcacataaaagcagtctttttttttttttcatttttttgcccaaataaagatgattccaaataaactattatattttgtttgatgtcttcctttctactcaacaaaaccaatgatttgcaatttgaataacttttcaagcaatttctctttgttttttaaaaatcttttttatataatttatgaaatgaagatttaatcaacatttgaaaggagtgatgccatctcgatatttttacttaaatttcttttactagacctttcacagtggattcaggcataagtgcagggttttaaactttttcccctatcaactaataatgaggtgagttatgaaaaataataatttgtcataatttccaaaagaaattattacagccttcctattactagtgtcaaaagatgaattaactttcttttgttacctaaccatagccatgttgctaacttgatctcagctctcttggaaaaatgagaatacttccatatttaggcaatattccttctagctgttaagatgacttcagtttaatttggttgtctttcttctagtaactgcctcattcagagaagatattaccaacactttttgtcacttttgattcccctctggagctcttttattccccttgccttgataacttgtttgtgcagacttttctggaattggagcattgtttgtatcttttaaaaaacaatatgctaattattttgaaaaaacaatatgttgtttcttgactttttagtaattgccattctgactggcatgagatggtatttcattgtggttttcatttgcatttctgtaatcatcagtgatgttgaaccttttttcatatgtttgttggctgcataagtgtcttcttttgagaattgtttgttcatgtcttttgcccactttttaatgggactgcaattaaaaaaatatgtacttaaaaaaaccaatatgttaattaatttgaatttttaggacttttttcagtataacagttttacttttactgatgatatttttataagtattgatgcaatcttatttcttttctttcctaaaattgtggtaaaggcccatgatgtaaagtttaacatcataaccatttgtaactgtacagttcaagttgtggtaagtggtaagtgcattaacgttgtgcaaccaattttccaaacgttttttcatcttgcaagactgaaactctatgcccattaaacagctcctcactccctgctccccacatcccctgctaaccaccgctttactttctgtctctctgaaatggacataatgaatttcataagagatttttcatgtacgttaggtgcacagtgaagtgtatttgtttttgtatagattattggcaatatggcctccaaatgttaaaaaagagaagaaagttaagtcagttatgttttctacttggaatgtttagcagccacagagagttaagtaagaaaactgtacctgtactaaaaaattatcacaacatatgaaatacatataatttaattagacattaaaatatcagggtaaaaaggtgtttttaaaccctgtctaaaacattatatacattgtataacattgcatacattgtataatgaatgcatacataaaaggttataaaacctttaaaaatgatataagttgttttaggccagttgaattagctacatgccatttcccaaatatgctgtttaatatcccttaaaccaatgggcacatgtacgtgtgtatttttgtattcaattcacttttacctgcaaagaccctgattctgacatccttattaaaacttggaattgtttgatttttttaaaagatttgataattgcaaagggtatctagttatgcctcaagatcactggcctctctctatagcattttgccaaaaatactccttaaagcaactgtcctgtatctgaatgtagattctattatatttccatccaagcatttttgctaatatcatttgtatgttactttgatgtaatgaaacccagaaggtgcaatttcatgttaaagagcataatcagggcttatcatgtcctaatgccaaaccaaaatttggttctaatgtaaaacttgataataaaatttgaaaccaaaggggttttcctgatttacgtaaactattaaatcccctttattttggcatattaagttaaaataaactataagagtaacttaaacgaatatgcttacttacatttttattattctacttggcctcattgagccctgtttcaaggacttaactcaatgctcatttggttactctttttcattttcccatttccttccattgtttgaagcttggaataaattatacaagctaaactatattattttttcattatcttagtctttcttttctgatgatgaatatgctttagaaatggcttcttcagtaaaacattgtttcatcagtcattgctatctgatttaatatgcaaagtatacatgaagtattacaaaggagaatctttacattaaattttattctgtttgccatttgtcatcctttgagaattatttataaagcaaattccatttctaaaaagaagatataatatgatctggtccttctccctactctttttattgctatttgtaattaatagtgagggaagcactgtcttgagtcattggaacatgctaggaaatcattctgtgatgcacaccttcaagtataagaagataaatcacaaacagtaaattggatatcatgttaaaatatctgcaaacaattttttagccataaatgcattttataaatatgtatttaattatacatcttaaaatataggtttgatcatgcatctcgacaatgaaaaaccgaagggtttgtgaaattctatcctaagcagagaaaatctgtggttttttttgttgtgtggtgttatatattacacaagtagcatgtgctttttaattacctgccgtcatctatatgaacttgttgaggaaatgaaaattagcttaggtcttacaatctaccattggacacatttcaacaaaaagtaataactcactccaacttttcaactcttttaaggtcttctgttacaaattgtaatgaaaagaatcatacgatttgtgtgaaattcataagtaaaattgttctttccagtaggaaaaaagtggttaaaaataccctacttttttcttcctctcttttcctttgttttggtcagttttccgtcccacatcctgttctgtcttcttttgctttattgttattaaatactttcctgtcctaaatcttgaattctgacatatttttgcatggctttaaggttatatttgactttaacatgatttttatatattttttacttatttttggtaatacttcatacattcattgtgcagcattttgaatgggaaaaagagataatcactttttctcttctttattccttcgaattttcattatttccctcaatttataaatctttataacttaggctttctcccctttctttttcgcaattgggttatgttttcacatcctgggtctagcttggtacaggggtagtcagagggctgtgacttcagggaagcagaagcctcctcctcttcgcattctcctcaatatccataactgttgcttggcgcgttggcccagaggggtgaggtaggaacacctatctgaacacttccctttctttcctcttctgccttccatgatcgctcaagctgagggattcagctttcaggtttccaccacttttacatcataccgtcctttctgctactcaaaagtaccaaagagtggaggtggagggaagagccctatgtcatttagaaagaagttccattatcttttgcttctctctgcttcatttccctcgatttgattattttttataccttcaatcttgctcttttagtcacatcccttcttgttttttgtatttttcatttgatttaaaagagtgttttcttagcatattcttacaacttgtgctgtaaaattttattcaaagattatcatgaatattaggaagaaaaccagataaattctaaaccatttttctgtcttcaagtataaaactaatattcagatattagtttggggatttttcacaatgttacaaagctagtgagtagccctaatggagctagaacctaggtctgctatatccagtcctttctttctattatagcactaaaactcttgcagctgaatgttagagaagactcatatgcttctttacagaaaatttaagtatttttttttaacaatggttgacctgattcagagatggaaatgtaaataattggatgtaataagtagggaataatgtgggataagattaagtggaaaggcggaagctggattgtgaggggccctgaatgacaatctgaggtagcgcattgtcctgcgtagatagtgggggagatgataaagaaggaaattagtgttattaaagtctatgtttcaggcactaactattgtgaatcaagtattttattaaagaacaccgagtatatatgtaacacgcggtgctgataaagagtatttgggttgtcaccagcatgcatgttgaattggactctagcagctgtttcaacagtccacacattaaatgataaggagttggagtggaaagatggtggaagaggagatagaattggcaaataatagaatactagtgatcaagaggagggagacataaagggtgaattcacaatgttagcagcagaggatgagatgcaagtaatctatttcttttaagcaagagcaaaataaaaatctcataatttttagttggatttgacagaataatcctcacaacttatctggaaaaattaacaagcaaggaaatcaaatgacattttccaataagttaataaaaggtagacttatctcaattaagtttcaacaaattttagaaaggaaatagaactgagacaaccttaaattatctctgaaggagtacatacacaccgaccagtcatacacctcagcacatgttttaaaaactagaggggcctcacacaacagcaaggaaaggtaaacagtcatcaaaggcatctggaaacaggattaatgacttggaaggaaacaagaaattgttagcattcctgttgccatatatttaaataaattataggtgattttgaaaataaatacaaagaatcaaggtagagaaaataaagagcatttccttattgaaatgatacatcatatttattttagaaaaattagataatatagaaaaatgtaggcaaggaggaaaaaaagtttctaccagaaggaaccagtgttaatgttttggcagattttcttccatattattctttcctatcttagttgacttattattacatatcattttatattcaacgtaagtattttttcaggtataggagtttatgccaactgccgtagaaaataatcctctgaatctccgtggcttgacatagtaaggccatctgtcactcatctgtcagtccagtgggtcatggacaggcctctgctccaggcagtcactcagggacctaagttactttgattcttttcctgaatcctctcctgtatccttttcccatacatgtgggaggagaacatgtaggctaatcattatgagggacgtttatggtcccagactagaggttccattcttcactttcatctactttttgttgatcggaaatcagccaatcacatagccatgaataacttcaaagaaggctgggaaatacagtccagctgtgtacctcaaaggaaaagggaaatggtctgaacagtgagtctttcccacactagttattagaacccccttattaacatcatttttttttattattatactttaagttttagggtacatgtgcacattgtgcaggttagttacatatgtatacatatgccatgctggtgtgctgcacccactaactggtcatctagcattacgtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatgatttgcaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgcgatggctgggtcaaatggtatttctagttctagatccctgaggaatcgccacactgacttccacaatggttgaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcttgttcactctgatggtagtttcttttgctgtgcagaagctcttgagttgaattagatcccatttgtcaattttgtcttttgttgccattgcttttggtgttttagacatgaagtccttgcccatgcctatgtcctgaatggtattgcctaggttttcttctagggtttttatggtttgaggtctagcatttaagtctttaatccatcttgaattgatttttgtataaggtataaggaagggatccagtttcagctttctacatatggctagccagctttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcatgatattgattcttcctacctatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctagcctcataaaatgagttagggaggattccctctttttctgttgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattatctagtttatttgcatagaggtgtttgtagtattctctgatggtagtttgtatttctgtgggatcggtggtgatatcccctttatcatattttattgcatctattagatttttctctctttttttctttattagtcttgctagcagtctatcaattttgttgaacctttcaaaaaaccagctcctggattcattaattttttgaaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtatctttgttctcgttggtttcaaagaacatctttatttctgccttcatttcgttatgtatccagtagtcattcaggagcaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttagaataggtgtggtgtggtgctgaaaaaaatgtatattctgttgatttggggtggagagttctgtagatgtctattaggtccgcttggtgcagagctgagttcaattcctgggtatccttgttgactttctatctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcagcccctgcctttttttgttttccatttgcttggtagatcttcctccatccttttattttgagcctgtgtgtgtctctggacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagtgcttccttcaggagctcttttagggcagtcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttggctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttctagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgcgttttagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaaccagcgagactccgtgggcgtaggaccctccgagccaggtgcgggatataatctcatggtgcgccgttttttaagccggtccgaaaagcgcaatattcgggtgggagtgaccccattttccaggtgagtccgtcacccctctctgactccgaaggggaactccctgaccccttgcgcttcccaagtgaggcaatgcctcgccctgcttcggctcgcgcatggtgcgcgcacccactgacctgtgcccactttctggcactccctagtgagatgaacccggtacctccgatggaaatgcagaaatcacccgtcttctgcgtcgctcacgctgggagctgtagaccggagctgttcctattgcgccatcttggctcctcccttaacatcatttttgaggctacataacattcagtgacctgggtgaatcttcaattacataagcattcccttttgttgaatgtaatatttttataagctgtcaccattacaaattagtggttttcatttcttattgatcacaatccttcattgtctgctgttaaacatcttaaaatggttatttcttatattttctccagtattatagttatttatataacatgaaggctagttctgtaccagttactccatcatggctagaagcagaagtccactatgcttttattattattttttagggtactgttttacctcatccttgtgtaagtagttttgtttattaatccaatgtgagtctgcctagtattagagagtcataaagctgatgtgctttttgtcaaataatctcgtatcttaggttctagaggaaatgatgtaaataaaggtaaactatgtgaaaagtttcatttttataatgaaatgtcgaaagcagcccaaatagccacaataggtaatagttaattaaataataataaattcacttgatgagatataattttgcagactagcaatgcagtaaaaatacttcagacaaaatactaggttaaaaaacaaacaaacaaaaccccactgaccccattgtatatgcaacggtacgttccaaaattaaacctaaataaaacatactcacatgtccaaaccgtgagcaagaatcccccaggcttgcaaaattcattgcagtgtggcaacaagtatcatcaatttttttttcttttttttttttggtgggaaggattttcataccttttggtaaagtttgttgtatatataattaaaactcgtgtttactggacagataaaatatttgctaaaaaatttcaagtatacacagttttagacatttcttgtatatattggtcattagaacctcctgtgatcaatgtccatttagctaaactttgacttttcttcattgtctcaagaaaatgttgcttgctgtcacctttaatatttctaacaccacatcactgcagacgtcatgccagttctcctgctcagaagcttaggactttagcctatatgatctgcttagcttcattaaaagtattttcttgaatcacatgtttacagtttcatagaaatgttttaatttacctccagctgttaaaattaattgccagtttgcatcattcaatctctgaattttcatttgtatgttatcatacactacctaatgttttgtatcctgtgttttactaaatatcaccttatgatcatttcccagcatcattagagagttgctgtgtttaacattagtgttctcagggtagcaaatgccaagacaagattaaacatgcaggaaaagtaggagggtaaggcggagaggaggaagggagccagtgacagggtgggggagccggcagacctaggtgcgggtctgaccccagcgaaggggagggaaggaaggaagctggacggaaacactgtggcctgcactgcgtctctaaggggagctgggcagggctgtcaggggcccttagagccacagtggcctgtcagaggatcctgcatctccaggagggggcctgctttcctagccctgccagactcagtcaccgctgggagcagccccagggagcacaacttcacaggaacacggtagattttacagtgcagagcttggtccagggtcagttacattccctgcagtcagagatacgggaagtgcattctcatagcccccacactttgtaaaaatctttagtgcacctatgcacctaccattctatcttaaagctataccatattacaagtaattcttctgagtaagccagaaactcagaatcttccttgacaacattctgtctctcttacctccatagccaaaccatcaccaggccaaatgaatttggtctctcccatctctcttagctctgacactttatattcatctttagtaggagactctaataatcacccatccccacatcgtatcctgcctttttagatcacccgtgccaccctccagtggctgttttatcatattgccagagtaatttaggacagaaggcaccaccatatttatccctacccctttcatccacttttggctttttgtagccttttgggtggtgtgaaataatcttggcaattcctgtagtgcttcagttcacattatgctccccactgttgtctgtgctccgcacactgtccactgtgctccccacactgtgatgctccccatgctgaccgctgctctccacactgaccactgtgctccccacactgtccactgtgctccccacattgctgtgctccccacactgactgccgtgctcctcatgctgactgccatgctccccacactgcccactgtgctccccacactgtgatgccccccacactgccgtgctcctcacgctgactgccgtgctcctcatgctgactgccatgctccccacactgcccactgtgctccccacactgtccactgtgctccccacactgtgatgctccccacactgactccagagcttcacacactgaccaccttacgggtccacactagccagctatatcctcccacttcagccatactttcaacacacttccttcttcctagactggtccttcacaccctcttcatcaaagtcatttacacacagctttaaggccacagcttgagagaactttattcaaggatccttccttgacactctgttgaagtcatattccttgcatgtgacctcttgcaggcccacatttctcatcttttagtgtttattgtaacttcagtttccccttttttgggatttttatgttactatagtttgtaatactcgatactttgctatgaggacagtgccttctgtttatttttgctcagcaataacatctagtatgtgtgtattgttgaatggataaggggcctcagtataaaggtgtaagctgagatacaggtatgggaacagttacagttggaggtatacgaatggacgtggtccccaaggtaaaaagggcaggaaggaagcatcacccgaggtgaacacatgtgtcctgcattcacttagggaagatagagcatgtttgaaggcacaaaggggccaacagcagcatgcattgcaagattcacagtagttctgaataacctgaacaaggagctactaggggcagggctcaggaggaggatagaagtggaaagaaacctgaccatcaagtattttatatacatgttgagtgatctggactttatatcaaaggctagtgagaagccctgaaaggttttaaggaggaagaggcctgagcagatttgcctttcagaaagatcattccatcaggaatagggaagagaaattggagggggcagaccagagccaagaagcccccaagttgctccttagtgaccccggcaggagtgaggacagcgggagctacagtgtcgggaaagggaagctctagagggtgcagcggcagagttatcaccgagctggaggctgcggcccaggagaggacagaacgcaggaggcacagctccaagggatggagcccaagaggggcctctggatttggcaagcattcaaatctcaactttctctgtgagcaacagacaaacttcaccttcttcaaaatagcaccagcaaggaaacacaatgacttctttaccttttaccgaaatgtgtccttcagctttaggagcagcagtcaggaaaggaaaagagaacatctatctgactagctggccaggaaaacacagcctctgatcagtgcaccatggtgggcacagacaatagactcatgttcaaaatatcacacgaggtcttgcacactccttctagatgaacagatgaaatcggatccagaaatctactatgggcttagaataagcactttgccctgtgacaagatatcaagtaaagctttatcaaactacatagaattctttccagttttgaaattaaggtagctacctttattctttcaaagacttccttaagcccatttttatgaagaagagggaacttttgaaacaccttatttccattctttgtgattttacttaggattcatggatggtagttctgttgccttagtataatttaaggcttatttcatgtgaaatcaattggataataatcacttactgagtgatctgaatatacactatatgccaggcactggcctagatgacagaaatgcagatacttcatacaaaattgtctttgccttctgaatttcagtgatttggggaaaagaatgcacatgtgaggtctgtgtatataaaatacacaatcagagcagatctagaaatccaagtgctatggaaacacaaaggagagagcaactttaggggaaagcgagagatttgcaacagagatgttgaaaactgaattgatgccaaatggtaactaaaggtttaccagagaaacacaagagaagggctgggggcagaggaagcagggtttcaggcaagagaaacagtgtttaccgtaacacgaaaagaccaaagaagttgacattattggggaacaagtgagcaatttagtacattggcgtgcaaaaagagtgaagggatggttaaaaagaaaaaaggaccctttaagacagtcgttaagctttaattaatcacacacatgtaaaggagtggggaatatcacacaagcagacaagtccgtgtgcaataagacgagcacggagacaggggagagagaaaagaacaggaaaggtgaaagcatcttgagcttctgcagctatagtcagctccctgtttgctccactgatgtgaagaatgcatgccccattcccagtgcctgctgctgagaaagtcacgtgcagtgcagtgagcaggctgaccaattgccaaacagtgcaccccccaggggaatgctgcagagccctaaatgataaccagctgatatgggtgatctgctcaggctttttgtgcttgtctgagattggaggacttataacagaatagttcctgtctgtatccattttgaggcttactcttcttgaattgctgtatttactttttatatctttctaaaagtacagagattattgaaaactacaatttagtatttgcaattattaaaatcatagtggcaaattagactataacttgtaagttttcgatttttgaaatatctaaatattaagatagatttaaaatatctcaaagagaaaaggcatgctgtttgccatttgacagtaaatagtcgctaatcaatattctcacattttaatgctcagcagattctgacaacttgactagtaatgagttaatatattgttttttataacttcattaataagaagtttgtagggtagcatatttctatctcaactatccccaaaatgctgtttctaaggtcatgctcagttctaagaatccataaatgtgcatgtgaatagaatcacaaagcagcagcatgaaaacttatatttaggggaaatgtttgctgattccaactttcaatgagttttatttgggaattttacagataatatctttaatcaagtgcatggtctatgatctgtcaatctcatgtgtgtaagtaaaatcaaagttcatcagatctgtattaaacaacttatttgtgttcataaaatatgtgtagctttatagtgagtcttgttggctttctaatgtgatagagtaggcatgcatagattaaaactatgatatagtgaaatatataattggtcttcagcccatttcctggcatagggctcctaaaatccttagaatctccaaaatgatatccttttttatgcaaataaatcaacagatggcagaggtagcttcagaaaggagctggtcactagaaagaccaaagcatgactagagtgttggaactttcagccctacccctgaacccagggaggggagaggggctgagggttaagttgatggccaatgcacaatggtttaatcaatcatgactatgtaatgaagccttcataaacccacaaaaggacagggctcagggagctcggaatagctcagcatgtgtaggttcctggagggtggatcacctggagagggcggggaagctccacaccctttcccccatatcttgccctatccatctcttcatctgtattttgtgtaatatccttgataataaaccagtaaacttaagtgtttcccttagtgctgtgagctactctagcaaattaaccaaactaaagagggagttgaggaaactccagcttgaagctggttggtcagaaattctggaggccgagacttgcaaatggtgtctgggggagggaggagacagtcttgcgggcctgagcccccagcccaagggatcggatgccatctccaggtgaacagtgtcaggactgaatcctaggacacccagctggcatttactacagaattgattgttgcctattggtggggaaatcccccacacatttggccacagcattttctgtgttgactgcggcggcagtggggtgagagcggaggaaaatgctttgatttttccctaacaaggaccaatctgatagatccccacctgccactgaacctcctggtgagcacgtgtccagctgcggctggtagattgtgattcacagggaggtccacttaataaatgcccagctctctctcctgtcctctcctgtctccttgcctcccttctgcaccctggccacagcttccccagctcggctcctgctgtctcttcacccacactatgatctccttcattcccacacacgttctcttctctagaggactgaccttcaaaataactcattcacatttatcccaaaagaattctgaaaaatggtagtctcttagagatctttattctggcatctaaaatgcatgtttatcatagttgcaagcaatgtaatttctagtgaaatacaaatattgacatttaaaaataaaattatttttttcactctgttaattgtatccagccagttcttagtaccattagggatctgattctcaccatcagtcattttaaaaatacatgaatttgcttttctttaattgccagatttttatgttgttcttttatcccccttgaaactgtattttcatttcactctcctctcagaatgttttcctaatgtaactttttattctgaaaattattattgattattatatgatatgtaaattaatttaaacattaaaaaatttcccataaccatgtgtccaagaatttaaatatatttaaaatgtgtatttatacatagacaccactttgaaatggtgtccatctacctatcttatgtaagagagtgaaaagtatagaaggaaaaagaaagaaaagagaaaagaaaagaaaggaagggagaaaggaagggaggaaggaaggaagggaaaagagaaaagaaaagggagggagggagggagggaggaaggaaggaaggaaggaaggaaggaaggaaagatggaaagctccatcctggataaattttgtcattagaagtattactaatgcataactttcagaacacctgttgttaaccagcaggcttgtccacaagtaaatctgaaccatgatgactctagaacccagggcttgatccttctccgtctcagaggggctacaattcaatccagtttttttgtgatcagcttcccccagaactggtgattgcctccatctgactagagtagggtggggtttaagtattcctatgcgtccagggtcctcaattctgggcatctttctcagacaactcccagaaggaactggcaccagcactactgacccccgggggccagggtgctgccagcagcagaacccccagcgcaggctgagaggctaagacgcgcttctgtgggatggggagcctccttctcctgcgggactgtggaatttgtcctgaaccctggcaggtagagaccacaaagggacctaccttgcatgaaaaacatagatgtattacaaattgtgataggtgatttttaagcataaaagtaacattttgtatgaaattcatctcttgatagtccaggcttttgttttcaattggtccatacatgtggctgaatactaatttattgttagataaaatgaggcccagcattaatttcgagcctatgttttattttatagaaggaagcacaagaaagccctgttataataaagcagatgtgaatgaaaggaattttaacaatgtgactcaattctttgaacttatcctgagaattatatgccaacaatcacatagcaattcattaatcaataattctttttagtgatctcatcactgataaactgtcgggtctgccttcaattttcttgaaagccaaaaactagaaactgcctgacttacaacaggatttgctgcccagccgtcaaagccattccccttctcaacaccgtcaccaacatgatttcaaacggagcctgtggcctggtgacctggggccttgcagccagagacagtgaactgtcaggtttgggatggatgagagatttccttcttttgtaaagcggcagaactattgtgaaaggggagtagagaaaagagaacaccaggggctttcctgagcagatcatcactttcagaaaagagtacactgaacgtttaaaatctggaaattgaactccttaaaattatttgcatttgggtgctccttggaaagcctttgtatgccaaagctttgtgtacccagtataaaaatctctgctccagaatggcttgatctccttggagatcaggcagaaaattctgtcttttgcttttctttgcaatacctggttgaaccactgacttaccgtacgttttaactttcctgatatcctaccattatgtgttactatcagcctcgaatcatcctttcttattattttattcacagaactgtggtgttctcagtccttgtagccaatcttcttgtttttatcacagccttaataagacagaaagaaatatgcatacaaagctatactaccagataacacaggaacagaaaaccaaataccacatgttctcccttataagtgggagctaaatgataagaacttatgatcacaaaggcggaaacaacacacactgaacttagcatctgggggatgtaacagtatgtacaacaaacgcccatgatgcgtgtttgtctatgtaacaaaccttcacatgtacccctaaacctaaaataaacattttttaaaaagctatactaccagatatgaaaccttgggcaaagtacttaacctctttctaagtcttggtttccttgtttgtatctatgtatctacctcatagggttgtcatttattataaagatgaaataagaccatatattcttgaacttagaatattgttgggtccatgctaggtataaatattaactattattattaatatcattagtatcattatacatttaaaatctctaacatattctatggtcaacagttgaaggaaatatattactaatctatgtccataaattttacttcccacatattttgacttaaactatagtttttattttgtatttgccttatatatttagttctcattaacctgctagttctgggagaaggagaccattttctttctgttttttttttttttaattgaatgattttgttttattcatctttattttcttgactatatatagtatcctgcgcatagtaagcattcagtaatgtttgtggaattaaattttgtcaaagcacacattttttatttgtgaaagtccatgagtagctaatgatctattaaactgggaacagaaacttctacctgcatagttccacaaaagaaaaccatctgtgtgtttgtttaaccagtagaattgaaagatgttttgactttgctccaggaattagagttccatgtgacctccagataatgctgtctgacacataatcaggcctcatagagaaggaattaaaaagcaagcattacagatcctacattattattattattttttggtttgagactgactttatttctctccaaaaagaaattaaagcaaatatttgtgtatgcagttttaaaacctatatttgttttgatagatggtgtaactgacattcattggtatgtacgcatgagagtatgactaaaaaggcctctgtacggctagttataaacctttcagtttagtctgtggctgtaccagctaggcctactatgaattgtgtttgattctgacttcacctaaatgagcctgatgacacgtgtgaaaagccccacttcgctggttttagcacagctgtcccttcagcagaccgtgacttgccattgaatttcacatgggtagtccctttggaggtgcacagagtccgaaaagcgtttcttccgcccttcctcttatcaccgtatccttgcgctcttcctagagcagccgctgcagcagcatcgcttctacgctgtgccctgcgagcgcgcctggcttggtcgctgctgaagtggctgaatcttaggagcagaggactccccacgcagtctcatgtgaaccatgattccttcgttcactcccagccctgctgttaactagctgtgtgatcttgagcaagctgttgctgccttctcagactcggcgtaagctggagataatgcccagcgctgacacctggtagagctgttgtaaggattaggtggaggagtgcctgtaaaacacttagcaccctatctggcacacaaaaagaacacagtacatgatgatcgtgttataattgtgatttatgacactgatgaaattagtaggaaaagtggtctctgtcagcccttcaggacttcagtttagactaattcctaatcttatagacactcttcttttttgcgtatcagagatgtaagtattgtaaatgtgtcttaaattatatcttattatctgatgaaggaattattatagccatctgtcttaaactgttattctaagaaaaaaaaatggagaaagaagaaatacagagtgagggacttaaaaatattgaaatggctttcaaaataaaataatcccaaaatatggtacgagacaacagagagatcagagaagcaaatagccaggaagaagctctcctgtcaatttgaatgtaacttatgacaagggacatgggaatagatacccccaatcgtcccagcggtgtgtgttcccaccccagcttcccagcgccccaactccctgcttctgggacgtttagtcatgttttctccactggagatgcctccatagggcgtagcagttcctggagcacagtggacactgggtgggagacaggtgatttaactggccttccttgggcaccagtgaacagatgttgttgctagtcagttatggccccttctcacggagtccgggttcaggttctgcccctcatttctcagacagcgtcccaggccacctccacccatgccggactttatgccttccttgaccgggagggccacttatccttgttcaggtccaaagctgcgagttttggttttgttgttgttgttgttattgttgtgtttagagacttggtctggctctgtcacccaggctggagtgcagtggtgtgattacagctcaatgcggcctcgaacttctaggatcaaaagagatcctcccacctcagcctcccgagtagctgggactacagtagtgtgccaccatgcctggtaattttttaaattttttgtagagatagggtctcactcttttgtccagtctggtcttgaactcctggcctcaagctatcttcccacttcggcctcccaaagtgctgggattataggcatgagccaccgcacctggcctaaaactgcattgtgcatatagccgtggaagtgctgaattgtattgttatcgggtactttaatagtgatacattcaaccggctgtgtggccttgggagagtcatttcaacatgatgaaggtccaagcccaggagatgatcagagaatcatcccgagtctcctgcagccctggagcatcttctggtagcaaataatctaaacaggtatcttaataggtgagcggcacgtctcgaagaaaaaaatctctccacacaaatggtaaaggtcttgaaggagcaccagatctgtagcgtgtgcagcaccacacttttcatatatgatgtgattagtgtaaataagtagttgattttgcttcataagtcaaatgatgattcttttacaaatagccgtttgaataattctttacacctgctacttagccatagttttgctggaaggattgagttttcttctgaagacacagcactactctgaagcttatttccccctgaattttgtttttcccatttttggctgagaaggcatctggagtgactccagcgggtttacctaggttttccctgaagaggtttaggtgattagacaataacagaaggaaaagtagagttgccagtaggtggctcactatgaatgtgcttgggacgggatcagacatgtcacccctcctccacttagcctttgttttcaatccctgctgctttgagcctttttctataatgtctgagtcatttgcagcggggtgggtaaagaggggagaaagaagaaagcaagcaagcaacagcctttgagctccggaatagcaaaggcccccatcttgctccgagagttcacagagtatagcccagtccgagttctcttttccacgcacacttgcttgttcttttgttccttgtgtccttggcaaagactgaaagaactaagcctggaatacttgggccctcccgtgtcacttaagaaataataagccattgtcctcattaagccacccttgttttagcaaatagaatccagataccggagagggaacattttgaagggaggcagaattagagtagagatgctttacaaaattccctagagaaactgctttgtttctcctattttattgctccttactgagaagattcatattcaaatgggttggggttgtgaatagcggcttgcacattctcatgcacccaggaaggctatgattatggctaattacaatgaagaatgaagctctaacaagagtgttccatcagattgtcattcatgcatgaagtaacttaggctggccaatggaggtgtgattttggtaattacaaacaatgtggctatttgaaaaatgcttagtaaatctgttcaagacaaaataaggtctaattaatcactttagctctgaattctccagatgatccatttgctctgtttttttttttttaatttaaggtctctttaataaactagatctaagatataaaatatgttctcgttgcccacacttaaatgcaactgtgttacctgtttcaaaggcttcttaattctgccaatcatgttgcaacctgcttttaatgcaacttgacagaaggcttttaaaaataaatgtgtgtatattcttgttgttacctgacaagaaaatggtttatgaaaagttactgtaaaacattaactattaatttagaagccatattggtatcatcattgtgctgacatatattaactcttgaatattcggtgaatgttgtgtttagcacttaagtaatgtctaactatatgtattagtttgttttcacactgctataaagaactacctgagactgcataatttctaaacaaaagagttttaatttactcacagttccacatggcgggggaggcctcaggaaacttaacaatcacggtggaaggcaaaggggaagcaaggcatatcttacatggcagcaggagagagatagagaaggcggaagtgccacacttttaaaccatcagatctcatgagaactcactcgctattatgagaacagcatgggggagctgcccccatgatccagtcatctcccaccaagtccctcctttgacccatgggtataacaattcaagatgagatttgggtggggacacagagccaaaccaatcactatattataggggagaaaaagtaatatattttccttacctatcacaaggttcgtggctgagaaccttagagcaaaggacagagtaacaagagaaaaacatcacatttatttaatagaggttatgtgacatgggagccttcagaaatggagacccaaagaaacagagatgtgtgtacttttatggacaggcatgcagaagtaagactggaggatgaaatggcatgctccaatcggtacaaactgggggcaactcagggagacctgattgcccagtttcttctccgtgttcctgagtgacattccttccctcctggtatagggcagtactcctgtcacatgaggtcttcagggaagaagtgaggccgcaggtcaaagagtggccttccctgcggtcatggcctgtttcagggaagaaggggtggagggaattctagtttccatgcctacttcaggagacagaggacaggaaaagtcacagagaccctcctgcttctgcggcgttttccattttcttgagcttaaaacagtacacaaaggtgctatattttggagtatcatgttctgaaccccaaaaatattctaccttaaataattggaggcctccatgaaggcacaatgatgacataggaacttatgcctctctatcattttttttttcagtagatgattgaagcgaagctgttttatgcttgtctcttttcccgtttgccatttttgtacctttgttctctcacctaaaaatagactaataaatggccagagttgttgcaagaaatgtacaatgataaaaacatctaattattggttttaaatgcatcaatcttcaatttcttttaaatgtctactagaatgaaatctgcccaactatctgaggagctttgttatttttaacttatttggtttctatacatgaacccaaaggaactaccttttcctaattgaattagcagggctagaaattcaactcagcacacgtttaactgaggagtatcagggttcagaacacgctaccccaaaatgtgacacctcggaggtcactctctcaccttctccctccctcctttccttcatcttcctttctcccctgaggaggttcatagaaaccaaaatttctctttgccaaagcaaaccataaaacctagaaaggccactttctgaccttctcctttctcccctgaagaccctcaagtgataggtgtcttgccctgaacagaaaggccaagaagaagctaaacaaataagccttgcagagtcccctcagtttagtacattaggtcgtaccccctttttgtccagtcacatttctatacaactgtacatttttcctggaacctatgcaaaaaaattacatagtttttcctgggtctttgggtcttaatttcagaaggcaccttcctgtgtcacagaaaacttttgttacataaatttttttatgcttttctcttgttaatccgccttctgttatagtagtctccgccatgactcttgtagctggtgaggaaaaggtattattttttctcccctacaagagtaatggattttacaactttgactgttatactttctaaaaaatgggtttagcagggaggtgggggtgggggagagagaaggaagacacaaaaaaagactagtttttatacagatattttcttattttaactaatttatatcatctataaagggaagcaaatattaacgttattagtttcctcaagaggataactaaagaaaacattcttgtaacaggggaagaagtaattccatacctattgtatctatagagctgtgcatttcatgtctctaaaatggagtaatttaaagttaaaaggcctcttctagtagttttcaccaaatgaattttatatatactgaagacagataaaataaaaatggtacagaaaaacgggagttttagagtcttgtttcaattctttagaaagtaagttgtctagcagaacatgccaacttggttgcctaagagcaatgtaaacttgagtcccactcgccatgttgaattattcttgtttctatttagcaagtggtctggagtctttgatctgcaatgtgtgtagttaaaatcattgtggctattattttatctgcccaaaatacagattttctaggatttgacagtataaagcatttgctttaataagttgagatttaatatttaatggtttctctcaaattcctgattggtcaatgtattgttgccaatttgtaaatttttatcaaaggtacaaatttgaaatgttttgctgtatatcatggaagagaagccatgattatgttccctaagcaagttacggaggcttagagtggataattattctctccttgtcctggtactgcctttgaagaatttccatgttgagggtaagagaagatggtttaaaaacctgatgaatttaggtagttgcttgagagaatgagtaaagtccattttttccctgattaaaattaagtctgttagttgcttttttgctcaccaaacacatcaatacagatgcagataaggtgaggcctcttcctgtaaatcagctgtcaaggcctatcggggagaaaaacaatggacaaggaggcaaactgcttctcatgaaggctgtgcgcttcttgtttgcaagaagaatatttatgggcttcacagctggcagcaaagaacatttaaatatataacttcatacacatgcaaagcattttgtagattaaatcagctcgaagtgtagaacctgagagggttaatagaatttcttggtaaccatttaataaaattaatgtgctattagtctgatgtcttaattcaattggctgatatatattcccagttttcactcataggtgagccttagaaaaagttagtaaagattgttttaagattgccaattttctaagaatgggaatacaataaaatgtaggtaatcaaaatattgaatctttgatctaggatctgttaggatagcaataataggtgcatatataatgtcttgtatattcctcaaatttttattatttcctttaacttccaaaattaagaaactgccagaaaagtatggcaggtgttcttagctacctatcaaagcgaaagcaactgagaccctgagtgaagtcgtcaacacaaggagcaccacagagggaacgtggaagctctaagcaaaacccacctccctctgcctcaccacccacctctcattatacacatctatttccatcgcatcgtggagatgcagaggtgctggcagaaagtcttgggtacttaactgttggataaatcttttactgaatctcttaaagttatgctcactataattgttggtgaaatcactttagatctctgttgtaaagctctctaaatttcctcttccattggtgttcatagtttatgacctgtcccactgagatgctactaagggagtctgcacagagtgggatttctgtatctgctacggtctgggtatttctgtatccactagggtctgggtatttctgtgtctgctaaggtctcagcatttttgtatccactaaggtcttggcatttctgtgtcagctgagatctttggttttaggcgacagaactcctctctgtctggcttgaccacacgttggtcagaaagaggctgtactgtgctccctctaggacagtccacgggaactcagaggactgaggaggtgactcaaaagtttggaaggtgtttcaagatttagaaggcaggattcaggtagccccagagagtcttgggaatgaattccaattcccccttgtaccacctttcacgagactccggattataggggcgaaggagaaagacgggcaaagcttctgtcatgtcattacactgggaagtgagagggaagtgctggctgaacctcttgggaccccctgtatactctgtggtgggggagaggggaagcgtctttgtttaccccctcaatactttatacagcagaagaaaggagatgcctgaaaaggcaacggggatgcatttaggaagaagcaattgatgctaggcacacaagaaatgctgcaacatctaagttgtacctgaagcagaatttcaatttaatgtgccatgtcaaggtggccacagagccatctttataaactgggagtatccacatattccagactcagagagcaaagatccaggactagtacagaaagtcactccgtataactggaaaagcttgcttgtctgctttcagatacgtttctcaaccctcatccataacacgatgctgtaaaccctagagtaagacagagataaagcatgtgctgggatgaagagagccactttggggaagtgccaccacatcccaggctgcaaggcatctctctctgctgcttgtgcagactggctggggtgagctttggagctggtctcatctcgaaggcaggcgctgctgaggcctctgtgcccttttgcctgggttagatttggcttcaaaattaatttgaaatcatttaatcttgctactctcagcaggtcagtgattaacaggaaattcagtgcccatgttggtcctgtttatgagcccaagtctatgtcataagtaaaaacaggcttaaacacatcaggaaactactcagtatagagtggaaaaagcctgggctgggcttccactcaagggccctgcacacactgcatccacaggccctgagggcagcccctgggcttcagccgtctgcgtgcactcttgtctagtaccgtgcctgatgtgggctatgtgctctactggtatttgttgagcacatcatcaagttactacgtgaataaacatcacttatctgggtcttggtttcccccatttgtaaaaccagagagttgggctaggaaacttttgagtccctccagcgcagtgattgatgtataacataatcagcaatgttgaactttgaagagaatacaagccttatgttgtcactgatatatttcagaacaccttgttactatttgtaaggatgtttgagaacatgtgggcaaatgcatctattttttcttccctaaaaggtaaacttgtctcctttacaaccaaacaaaagaggatggcactgcatagcagaggctaagctacaggctgggtaccactgagcagtggagtaacccaagtttaaacttgaaaccacatttgtgcaataagcaaaagcttcacatttatagaacatcgatgctgcggcacagcaggctactttcatatgtgttatttcattaaatccttaaaacttcaatgtcgtatgtatgtattatttaataaataaggaaccacagactcagagagtttacttaatttgcctaaggtcacagaggtaataaatggataaaaccaagatttgaatataggtctgaataaattattcatgctctcatacctacctatttaatgttatggagttgtctacctttctgcttcatttttctttatatttttactctacatgatccttattttgaggccttccattgcttgttctccttctcttgattcctgcattatttcctttccaacatgtgctttgatgcatctgttttctctatggagccaaggaattttccatcctctcagttttatgggaagatacagaaattctctactcattgagtcccaatgacaatctaattatttctaaatctcaccgtccaataattatctttttaagctcttcctctccctctgaattgtgtggtgtgttccctgttgacatttgattaaggctttgcccatgctgcttgaataaaaatatttatatttcaaaatttctgactgccaattatccatattttgatgcttaatgtccataatatcacaatttgacatgaaagatattcttaaaaatcattttattatagccacagagtagagttggaaaaataactctaggataaacaaatacatacttattcattccatacctgcttgatgacctactatgtgccaggccttattctaggtgctcacacatagcacctagaattctgttgatcctgggagtttaacgataggcaaatagaagtacaatgagacagatgacagatgttctttcttcctgcctgtctacctacttgtccatccatcaatcttcatgagaaaatggactcaagattttgaaaacctcaaaatgcttccttttgttctagcccttgctttcacgtttaaatgaactctcagtgttgtatatatattttagaaagtttaattttcactaaaataaactttcagtctctacaagtgttgacatttaactccaagaatactttagttggttggaaaatcatttctggtaaagacttcattgtagagaggagacttctccacctctgattactcctacaccttgactgagtactgactacatgtactagacgtttgttgtgagcaagtttcatatactattttattgtgttcccactactgacctataaagtatgtgctattatattttgtttcatttcctgtccaaagaatatttttttaaccaaagaatccagtagaaatgcctttagacttacatagtgattgttaggagaatgatctatagctgttcggagtttgcagaacctcgagtgaatctttcaccaattactaaatgttaaccgaacatttgtgaacatgtgtaatatactccctctaggacgggataaaacctcaagaaacctaggaaaatggccaaattcttgctctggactgcggctctcaatgataattggcatatactggttatttaagacctcacagctgctctggtctgaatgctatttgagatataaaattgtgggctatgtatgcaatctgccttggctcccataaaattaagaagtttaattattaatgtatatgagtatgttgagaaaatgatatagttccactgactatgatagtcttgctgtattacctgctgttttaggatatagggatacagcatcttaatataattgacagtaagccttctcattgtaaattaatctgagtgcttcacattgaaacatgattcttttttaatgtatatattaagtttcgactacatggatgccttttaaactttctaaagaagattttaaaaagcttagactgtagctattcagatttataattccactcaactctgctatatgatcctgaaaatgtttaagtacattacatataacttaaattatttaaaagtttattttacacttcttgaagactaagaactccttgaatttatttcacaaaaggcttatcttctccagaataaatttaacttgcctcatgtaattagcattcagaaaggctcgaattaactggaacatagctaaatagaacctttaatttactagattttttttttctttttgctctacttttagagcttgaaatcattggaaaacaaacaaaatagcaaagatttgttttaaaaatcagcctccaaggttagtgctagggtcagtaaatagctagccaagttttcatattacaaacctatatagttatgatttatttaaaatgatgaaccagagatacccatgttttctaatgcatgaaagaaatattacagaaatattaaatatgttatttgctggggtgaaaaaataagctaatagatgttgagaatattttcagcaatgaaagattgaagcagaattgatttcctagttatcactctgaaaaccaagaaattaaatgaacccaaactcatttttaccagagcattctaattaatcaaatggattaacaaatgcatgagtgagggatgaaaaatacttgtgggagaaaaacagaggtgatacttttggtgagagaaattgctcatgtaaaataattttaaaggaagttacacatttattgaatgcagcatatagagtcctgtgcttccggtctttaccaactaatctcccctaggccctaccgtcacccatcccttttccagaaatcttctaaaaacatctccttcttctccaattactctttattataatatttatgattaaagtctggcaacatttatgtgccaggtactatccttactgacatagaaaccctatgagccatagagctcgctcttttgctataacttcttagagttttctgcacttcagatttcgccacttcagatatttcattattccatgtttatttcaagagaggtttaccaaatacacagaagaaaaaaaaaaatctctaaactagaatgctgatttccaattcccctgtttcaactagttactgactttcctacttccaaaacagtttgagggaacttaaaagacacagttacaataaaagcctaaacagaaaagaaagcaggatggagaaagagaattctatcagagtaatcatgctaagaaaagcaaagtgcacccaaccgaaccaaaagataccagagatactcatgacaggaaacttgacaagctccactgtgcatgtttgattaaaggaagtaaatcagtgcatcaggaaagccaaacattttctcttgactaaacttcaagaggtgtttcctctgtggttctttgtctcagagtttgtccatgataggcatggagaaatatttgttgcatggtaaataataaatataagtgatacttagctgataaccagggtccacagcgggaaagactgggcaataggtctccactccttgtcctgcttccactgtgaagttacctttgccagcggctcagtaccaaatgctcaattgcccctgagaagtgtcacctgaatgctccccagtcttctagcccactgaccttggcacccaattaaaacagcttgatccctcctctcacatactatcagaagcctcaggaccctaccttgtgttttgttattttgggttttgttttattctatttttgtttttattccaaactcttgctgtgggaccttcttggatatctctccatccctgttgccatttctccctccacatctctggtaacagatgtgagacttcttggacatcactgtgggaaacacagtggccttcatcccctgcaccctggcttcctgaagggctgtgctggcttctcctccagggtccctaccttgaagccgcttcaggttcctctgtattatgcagagcaaggggactctcctctctccgctcccagactattcaaaaggcccgccatctttgccttattaaaatgtgcattgagatattttccaaacgaaaagaactatccgcaagaaaaatgtatttctcctccagcaactggcccgaactgaaatgagattttaaaatattttctccctgtgacacagacacaccttgatgaaccaggtggctaccctctagggtcctgggaacatctcccagtcagaacaggcccggttttctccagcaagagaagatggttctctaaggagccctcgtcctagaaggcagcgtcgtagagggaaagaaccaggcctggagccaggccgacgttggtttaattcttttctctataacccattactttgctgctggctcttggacgattctcagaacttttcagagcctcacttttctcatcaataaaagggagagaagaaagcttagctttgtattgcaggcgccatttacccttcagggtgacttctcttatgacttttcttattccagacccttttgcattttaagctggatctctcactgaataaggagagggttgcttcaaaggattttcagacacctttgaacaggcagcagagatgcctttgcacatggccttggtgactaggataggatacacggtgttcctagatccagcctggaactagaggcgataggccgccctgaaaggccaatgggctttcaaggtggacagccgtggttttaaatcctggccttttccccgctattactagagcgaccatcagacttttttgacctcagttttgtctctttaaaatggaacaagaattatctaacagacagaattacatcttttagattgtcgtgaggaaagcgcttcccatagtgctgggtagactgggagcgctgggagctgtggcaggccagccgccgcagcacagtggtgagatgcgcggtccacagtcgttcccccttgggagttgttctcccctgaggaacagaggatagggactctgtctgagtgcctggagaggaccccttgctctggcattgagtttcttccagccccgccccatgcaggtgagatccctactcacagcctagggcgcacccgagccgccagagcacagcctcctttccggctcatcacctgcttcctgcgggaggagaatacgcaactccttcgccatgcacatgcgcacagggtctgccgcgggatgccctgtctttcctgtagatggggaattgtttgggattgttacacaatcacaaaccaacactgaatcctactgaaaaaggacacaggctctttgaactctgcactagaacctaaaaccaaattccttttagacctgttctaggaggactacgttaacctgatagctgctgacacagggcagcatgcctaaagctcctaagttagactggtaggtaccgttaattattcctcgttacatcacgcaggtacacagagggacgatgacatgtgcatcctctgctcagaattgcttctgtgctgctggtgacgatggcttcatgggtctttacagaatgtagaggaagagaacagcaaagatttgctggggtttgccactgaatagcagcaaaggcaaatcccaaataacagtggatgtatttcattatcagtaaaatgaaggggctgggctagggcggctccaagatccctctggctcagaacgttccttgatactttgattccatctatgtaacatagcctgaaagtcttagcatgttttctgagattatcccagtagaataccttgtctgcaaaaggctgaaatttattatttgggaataataaatcagaacaaaaaaagatgtagagtccacggtatattattagttttgagtgtactaatccttattttatgagatttaatttttgaaatgtttacctttccattcagactattgtcaggaaaaaaagcgtgatttttgtgttcagggaagaggtaggcaagggactaatgaatatgtgctttgcccttgctctgataaatgctgtagttataaaaagtcgtggcaggttatgggggcccttttgtttaccatgataaaattaataccttacaagttttcaaaggagtttgtaagacgttacagatttatttttaatataatttcagagttggaaagctagacagttggaagtagtgcttggaaagcctgattcttgataaattcattatcaataataccatgtgcagaataaaattacaatttcagcaaagaatattcttccataacattttattattactgtgaaactaattaaacattgtaatctgcaagtaattaaaaatttacctgaaaatatactatgagccctgttgacagtacatggagcattttgtgcgattatttaatgtctgctattttttcttggttgctctattaggaaattgtagtctatatggttttataaaaaggaggcaaattatagactaatggagctagaagactcattaaaagatgatctgcccctgggagattgggtgtcctctttgaaaggcttctgagatggaatggagacattcctgggagcccctcctgggtttggtaccgtggaaatccaggtgactgtcactctattcactattatgtgtccctgcgttccttaagcacattttcacagatgtatttttcacatgcagggaatgcatacaaagcaactagcacactgcttaatgattaccaagcgttcaatgaagagaatcattctactagtattattctttgtgcatggattattacaatactctaacttttttaacttttcactcagagggatattccaatgagactttttattataactcctcattcacttaccagtgtgatttcttgctaccacacgtacatttcttcttttttaaaattcttatttccataggtttttggggaacaggtggtgtttggctacatgagtaaggtctttagtggtgatttgtgagattttggtgcacccatcacccaagcagtacacactgaacccagttcgtagtctgttattcctgacccccttcccatgctttcctcctgagtccccaaagtccactgtggcattcttatgcctttgcgtcctcatagcttagctcccacttatgaatgagaacatatacatttcttctaaatgtgctctggtttatccatatattattggaaataaagccaccacaactgatatcttactttatgagtgtttcttatggggtagaaatttctgatataataaaggccaaagttgtaacatatttattacctttacttcagccagactcacaaaaatagctgcgttgatagctctctcctgatctctaatctcttccttcctccctccttctcttgtttcttttctttcatgcattgaaaattgactggggcaccattttcaatgctggaatatgactgtgaacaaaagtaaaggcctgtggtatcatagaatgttaagttttgggagtgggaaatgacaattagttatttaatcaaggaaaggcataattccaaaaaatgtcaattgctatgagaaaattaaaacgaggtgatgtgggggtggtaacatactctagatgggttagtcagaaaaggctttgtaaacattgtaactgtgctccttttaggaatttcttaatatttatcaataaaagtatgcaatcatacttttgtattttatttttattaagtttgataaataggtgatgtttatataaggcacatatattttatgaagttatagtttgaatgtgattaccattttaaatagcaaagatctgttagttctggtacaaggtatttccccaaggtcttacagaaatgtaaagggttgatactattctgagtgcatataaaacttttaaaactgaagaacattgtttagcactatacaaactatagcaataatttaagatctgccatagtggccttcttctgtgcctcagagaacttggaaatcatcagtagcttatgctaacataaaaatacattaaccatgagttacacattctcatatatatgttttcaaataccagcaatcatttcattaaaaataaaacaagcacttccacttatcttaaagactacttctcggctgggcgcggtggctcacgcctgtaatcccagcactttgggaggccgaggcgggcggatcacgaggtcaggaaatcgagaccatcctggctaacatggtgaaaccctgtctctactaaaaatacaaaaaattagctgggcgtggtagcaggcgcctgtagtcccagctactcgggaggctgaggcaggagaatggcgtgaacctgggaggcggagcttgcagtgagctgagatgtgccactgcactccagcctgggtgacagagccagactccgtctcaaaaaaaaacaaaaacaaaaacaaaacaaaacaaaaaaaaacaaaagactactttctcaatagaatattttaaattcttccaaacactgtaagatatgttttaagattaactaccattttttagctgaattaattttgattctaacaataactacaaaatgtgacattatgttttccatcttatagataaggaggctcaagaacagagagggaagttcagagcttgccaaaaccacagtcatgagagattttaaggaggtggactcatagccagggcttctaactccagatgccctaagttctctatgagagctcagtgctcagtgtcattggaagacagtagacagcggtattgttaggttgactaaaatctggaggaaattggtcacttgataaatgtaattttaaaatatcttcattctgtaaatagattaatacttctaaataaatcttatctctagcagttgagtattagaatgctgtattataaacttacgccaacaaaaattaatgatgttgaattgagaaacaagaaagaagatatttaaatgtatcattaccccacttacttttgtctataagaaattgctcatttccagatttttctttcctactcaagccagccttttggctttctaaaaaataaatacataattagaaaattagaaattagaaacttccctaaaaattgtaataaaacttgtacagattatagaaaacgttcacaggaaagaagagggagggagggaggtaatttctataattggattatttttgtaaaaccttttcaagaaaaattgcaggtccagacacccacattgtcctagcaactaccttggttcccaccatcccaccgctgctcaaggcacccccacctttattctgaactgagtgatttccaagcacagtttgcataaagagacatgaatagagtttcagggaatgagcgctcataggtagtgcaatactttattatctcttataattatactgattttagcttcaaggcctgactgatatcactaggtatcagaatctcaattttattagtacattaaaaaaattactcagttaagaagtaaaagttacaaaaaccagtttaatgtgtaatacagccatttacagtgcacatgtaagcctaacccagatgccagagatgaacgcttagcttgggctttctgcctaatatgtttttccctggaactacaggtattatttatacgtatgagatgtggttatcaagaaataaataagaatactaaattccaagagtagtttggtttttctgtttgtgtgtgtgtgtgtgtgtgtttaggtaactggggtacgtttctggcttgccacatcttcctcagtacctacaatagtgccctgtccatcatagattcctaataaaatacagattgactcattaatggtaggtcacatgtcattattttctcaattttagtggtaggagttatttctttctaaacctttactttcatttactcaacacatatgtgtctgtcttagcactgaatctattgctgtaggtcagcaagacattttaaaattgttcttgaaagaatgctatgaaattatgtaatctggtcaaagtaggaaagcataaaattggcaaaatgtccaaagcaaagcccatactgtaaaaatcatgtcctgatgtcactggaagttgttttgggcatgaaaccagcaatgaagcaaaccaggatgaccctcttagagcccaactagatcctaaatgtcattaaagtcactaaagcactttaccactaaatgtggtaaagattcctttggaaactagctagcttgaaaaaccaattcggcaccaaaactttcagtgactcacatcttatcatcaggccagcttaaaattaatttgatatgctaccctgacactaggcatgaaaagaaaataagattagccagtacatttttgcctaccattcagcaacaaatggaagagccaaataactgcgcattcactcttagattccttgtaactcaagttatcttcttttcaataaacgaaaccaagctacaaacagattttattgcttacaagtgagcagcgcttctgattgtgcacttccatgtcagacctcacattaacaatagtgattatttcagaaatgtgcataaactcaatattggaatgaattgttttacaattgttttgtattccaaaccagacagatcaggcaaaaacatgagggagttaaaaaaaaaaaaatatatatatatatatgtatatatatgctcagatgaaggctagggtatcaaatagttgagtttttttgtaactttacttcctcccctccaaattctgagatggcttaaagaacttttattaataagacaaactattttaatctttcccttcaaactttagctgccgatttgcctaccagtttgtgacttggaatgtccttattttttttatatcatttagggttttgggctagggcttaggtgcctggatccacactcatccatcttccttcttagagtgatagccaggggtctgttcacaggagggcaagaaaccagtggcaaacagaatgccagccaattcaccagactgggaaatgcctagtcagcttcaaagccagatctcctgggaggtcgcagatggaagcacgtgacctgcaccacaaggctgtttgcctctttccctcaaatctctgcctgatggacaccccccaatgtggcgattagattttatcacatcagtgtggggggaggccagtcagaatcatccacaagtaccagggcacagagagaggaaatgaggcatggctcctacatgcatagacacacatgcattcacacacttacatatacattcacacactcgcacacacttattcccacatcacacacaaagtcacattcatacgactcgcacacattcacactcacattcacatcattcacacagattctcacactcacacacccattaacacacttacataaacattcacacagttacacattcatatacacacacacatacactcacacagtcacatgcctccggtcacacacatttacacacattcatacgcccacatacattcatacacatgtatgtattcacacatatgtatattcacacatgctttcacactcacacatgcattcacaccctcacacattcattcatgtgctcacacacatttgcacactcacacatacatagtcatgcacattcacacgcagacattcacacacagatgcacacacagacattcatacacattcacacacacatccacgcacattcacacacacacatgcacacacagacatgcacagacattcacacacagacatgcacacacagtcatccacacacattcacacacacacatgcacacacagacatgcacagacattcacacacagacatgcacacacagtcatgcacacacattcacacacattcatacacagacattcacacacagaaattcacacacagacattcccacacagtcatgcacacacattcacacacaggcattcatacacagacattcacacacacatgcttccttcacctgcaccatctgtgtagtatggtgtttagacatcctccatcttttctcgttaaacattttaaaaactcttagccaaaagtggctgaaagaaatatcatctttattattctgtaagtttttgtttcacataggttgtacattaaccacttgtccttttcctctaagtaacatacagtctatgtccaaggctggttttcccccaaaaattctgctgcaataattgtgtccttgacttggggtcacattacaacattaaatgcatggagttatcaacctggcattccactaatgctccaagttttatgtttaaatagtcttcattagttgtatttccagggaggtcttcttcctccagtatgatcttctaaatgcttactgaccattcagtcttggaaataatttttctttctatttccctggagcttgaactcatgtgtctatctccagttgttctacatcatgcttgtctgaagtgaacagagatgagaaggaaaatgtttatacatttccttccctagatagagccgaagattacaaaaggcctcccagctctgttccttcaccaccccctcctccatgctaaaaccatgcatgcttcccgggtatcactgttctcatgtgggtgcagccatctggagggtagcgtttcaatattcatggtcaccatcatagggggttcctctccaaagaaagcaatgacaagtggaacctcattgtaggtggatttgagggagactttacactactgtgaagctttcttctgacaaggaggaggtcaagagtgggaagggaggccaaggccacaagattccactggaaaccatcactctcttcctgctgtcctctaataatacaggagagaatatggcatcagcaactgccagcaggatccctgggagatcttttctctctttattgtttacatgatatcactttaatattcaggaggctttgatttgcatttctctaattaccagtgatgatgagcttttcttcatgtttgatggccgcataaatgccttcttttgagaagtgtctgttcatatcttttgcccactttttgttggggttgtttgtttcttcttgtaaatttgtttaagtaccttgtagattctggatattagtcctttgtcagatggatagattgcaaaaattttctcccattctgtaggttgcctgttcactctgatgatagtttcttttgctgtgcagaagctctttagtttaattaaatcccatttgtcaactttggcttttgttgccattgcttttggtgttttagtcatgaagtctttgcccacacctttgtcctgaatggtattgcctaggttttcctctagggattttatggttttaagtcttacatttaagtctttaatccatcttgagttaatttttgtataaggtgtaaggaaggggtccacgccagttagaataaagtcaggaaacaacagaggctggagaggatgtggagaaataggaacacttttacactgttggtgggagtgtaaattagttcaactgtggtgaaagacagtgtggcgattcctcaaggatctagaaccagaaataccatttgacccagcaatcccattactggatatatacacaagaattataaatcattctactataaagacacatgcacacgtaagtttattgcagcactatttacaatagcaaagacttggaaccaacccaactgcccatcagcgatagactagataaagaaaatgtggcacatatacactgtggaatactatgcagccataaaaaagaatgagttcatgtcctttgcagggacatggatgaagccagaaaccatcattctcagcaaactaacacaggaacagaaaaccaagcaccacatgttctcactcagaagtgggagttgaacaatgagaacaaatggatacagggagaagaacatcacacaccagggcctgttgggaggttgggggctaggggagggatagcattgggagaaatacctaatgtagatgatgggttgatgggtgcagcaaaccaccatgacacatgtatacctatgtaacaaacctgcacgttctgcacatgtatcccagaacttaaaatataataataaaaaaaagaaaaaaaaaaggaaaatattttccaaaataaaaaaatgtttaagaagaggaaaaaaaattcaggaggcttcagtcagatgtggacttactgggaccaaatatataagacatgttttatatctgatagaaatgttttagggaagacatagtgcaacgttccttggttcagaaatggcatccctcttcttgtcctgcccagaagagtcaatatgcctataacatatcagaagggattttgctttccattaaaaaagtagattcatggtctttccctttatagaattatagttaccaatgaacaagttcctatccccaaactattagatagcaacggtcaccatggtaactaagttgagtgctatgaattatttcttacaacattatttttggagctttacctaaggttatagatagtttcacttaactgggtaaatactaaatttagaatatacctgtgaattataaatagtatgagcaaaaagcataataatattagtagattaaaattctgagacttttttatattaggggaattggaataataactttaaatgtttgtaagatgcaagtgtaagtgtgagatgcaagtgtaaagtgtaagatgcaatatcacaattcacatttttacaacataattaaaaattgacattatgacacagaaatgagatattaaattataacaacagtttttaaaagtcatgtatgtgaataagaaaattattttaaacttaatttttaatgtttcttcactaagtaaaaaaacacaccaatgtagctgtcttgataatgaattcttttttgaataaagtaataatgagaaacattttaacaaataaaatctattttacttttttagagtgtttgatgctgttacaaatattgaatagactgaatctttttctcatctgtgcctgcctatctctgtgtataatgagattgttacttggattcaaagagtgacatcagcaagatggccaactagagccacctgatgctcattcccccaacaaaaggagaccaaaacaacagatggttacccatgttatacattaagcttttaaaaaatagtactagggaaatttgagattgttctaggcctttgagtttggaaatagagctgacacataagggacaaatttaaaaatcctctgatttccccaatatgttgtttctagcggtagtttaccgtgatttgtagtatgttaagatgaatgtatatgcataagccccatgttattctaaatctgaatggagtgaataactatggtgacaagtttaaagatgtcttgcttttcttagtttatcttctagaaatattattgctattatagaatggctctttgtatgtaataatacaatttcagtactacttaaatttttattcactaaatattaccttttctgtaatatgtattgtaattgcatacaaaggaggaatctcatggtgtttcaatacagtctaaatgccttccttgcctttaaaaagcttctcagtttatatgatggtcctcaaaaattaaccccccatgtaattctctatcaaatcacaagaacaatatcaagcttcatgtaaaatatattataaaatccatactttattgccaattgtgcacgaagagacatagcccactttaaccttcattaacagtctatagttctctgttctatagaaatcgtcctttaatgaagggaaaaaatagcacaaaaggtaacacagtaaaactatccatgtaactccccttcttgctcaagaaattcagttttaaaagttaattatctattgggcaaaaagtaacattgccaccatgtgatttttggcccagttggcctggtattcatgactctgtctagacacccagactcttatgtttaggaatcattgaggggggcaggggacagttggtgctaaaactgatctattctgttcatctacactgatatagatgtaccatatacagatttttaaatcaatccaatgtaggacataagaagttaatctagcaaaggttttactcagtggttagggtaaataggaggcttcattcattaattcattccttcaacaagtatttattgaacacctgctgtgggccaggccccgagctggccgtgcagataggacagtgagtaagacagagagcaggtttcagtcttccaggagatgaggctgactgtgggtgcccaagcagccttccagggctgtccagtgaattcaagagggcagggaacgtgagggagttactccttcttcaaggagaagtagctggtatatctataaggatttcctgatatatctacaaaacacctctctcaaaaagcatctgtgagaatgtgtgaggggatatattttttaggtacttagcagagcacctggcatgtggtaagtaccgggcagtctccttttacttctgtgtcgaggtcaaaccacaccttggaaccagagagaggctgagcacaggggagaaaacagacatgtaaatgggggtcctccaacacccccttctgtggaaatgaatttcagccagcaggcctgtactggaaagaggaaaggtctgatcttctgccctttagttgcagctcggtttgttgtccctgtataaaatgtagcaacggtaagaaatgtcggatttcaatacagtatggcaaacatttatttaacatctgtcacataaaagactgttgcttacttgggaatttgtggatgatgttgccaggcccctcactggaatctacatgagagaatgatcacttacgtggcattggtttttgatagattcacttaggacctttgttagatgtattgcaactctagcatgtatttctgcttattatagaaagagcaaaggaacaacaacaacaaaacagggcctatcacaaaatatactgcagaagaatgagttccttgtagtgttttgaatatctgaggtagatggtggcatgcagtcaaggttctgtgtatttgtgaacaaaaatagaaaaatataacgcttcatatctttcaggcaacactaagttatatatagtaagatcagccatgactattaaacaagaatgctttagaaaagataaaatgaaaatttatattccttttagaataaaacatatcttaaatttctataaactgttgtgcctcatacgtattacaaaaataagcagtaaaaaataaattgcacctacctgaaatcatcttccgagataccctaaaactacacatcgctttcatctgactgtggctgcacgtgggcaaggctacattgcacaccagccagatccaccttgtgtagcaaagcatgcgccaggggtgcatcgttcagggcgtggcagctgcactgcattagatgtgctggatgtgtgcacagagccacgctctgtctgtacatttacatctacagaaagacacagatcgtcacgatcttctgtagatgtgcatgtcattgtcctggtcttggtagttgctaacagtgatgctggcaatggtatcagggaataaaactggactgaatgagcctgtgtatggaccacaggctcagccagcctcagtgcatatacttcattctttggattttgcctattggaagtgtttataaactttaaacgacctggcagttttggctgagagccttactccaggggctgcctgatggttgtcttcaaaatgagcaaactttcaatgatgactgctccttaatgaacctgttttcctttggggctgtaaatgaggcctagctttcatgtctaagtcctacatgcacccacgcaaaaggtagatgtttatttttttaaaactgtattaatgtccccaatccggtgggaaatttaaattagaagggcagagagatgagtgtcaatgctccagcaactacatgtgaataaggtattaaagtgtgtttccaatcatcatgttcaagagatttgcaaagaggtgcacttgtggatgttcacatggctgaagaaacacagggagcactcttcaccaaactggagacccgggggcactctccaccaagaccagagacccaggggtgctctccaccaagaccagagacctgggggaattcttcaccaagaccagagacccagggacactctccaacaataccagagactgggggtgggggggtgcactctccaccaagaccagagacagtggggtgctctccacaaagaacagagatccgggaggctctccccaccaaggttagagaccctggggtgctttccaccaagaccagagactggggcagggtgcgctctccaccaagaccagagaccagggggcgctctccaccaagaacagagatctgaggcctctctccaccaagatcggagaccacagggtcctctccaccaagaccagagatgggtgggggggggcactcttccactaaggacagagaccctggggcactctccaccaagaacagagaccaaggggtgatctctaccaagaccagagacccgggggcgctctccaccaagaccagagactcggggtgggggggcgcactctccaccaagaacagagaccaaggggtgatctctaccaagaccagagacccgggggcgctctccaccaagaccagagactgggggtgggggggcgcactctccaccaagaccagagacagtggggtgctttccaccaagaatacagatccagggggctctctccaccaaggttggagaccctggggtgctctccaccaagaccagagacccgggggccctctccaccatgaccagagacccggaggcactgtccaccaataccagagacctggggcaccgtccaccaagatcagtgacccaagggtgctctccaccaagaacagagacccaggggctctctctaccaagactatagatggatggagtcagtggcaagtctgtggtaaattcttggatgtaagaattacaaaatgccttggacatgtgggaaaattataagaggaagagtgtgtagacctcaggggctctttacatttgtcaccttgagtgaacaaagctcacctcctgggtatggaccctgaggagtaggcaagctgggttctgatgagactcgactctgaacatcacacctggagaaaaccattctctgcatccagggccttgtccaggtcatttctatgcatcccccaactccatcccaccaacatgtctttggatttcaaactaacccgactgtccaggaagccttttctgaccttcgtgaattatttccattgtgctcactcgcgtcttccccactttagcaggcttaccctgaagtgttatttcccaaaccttcagaaaccctgactagatcattttgaagatggggcattagcatttgtgtgaatgcttagcaaacaatggaaaccctcagccaggcttgagctgtgctctctgcgctctgaccctcactggcaggggcacctcgagttccactccctgttgcatcatcagccttggagcagtgtctgacaatatgtattcagttattatttactaaatgaaactaatttttaaatgattaaaaatcagaattaaagtctatgtttcattctgtcactaccaggtttttttttttagctgactaccaatttgttagatttttttaaaaatgtgatttcacataattataaaggcatatttactgatgttacgtaaactgtctggcacatgaaatatccaggaaagagttttcctttcagctctcatgacacagcttgttggggcccgctgcctatttagctggcctctaattaatttattagatttttaaagtgtgatttcacataattacaaagacatatttgctgatgacgtaccaaatatctggtacattacaaatgtccaataaatgtaagttcccctttcattcctctcatggcatggatcattcagtctgcttatttacatagtgttcacaatgttaacaagtttagacagtggttttatatttattaccctctttttaatcacatctttaattttatcggtttttaaaatattttccagtctcagggcaagtccagtacatatgatttatattcagcaggagcaaacatcaagtggttcagaaggcatcaaacgatttttcaaaaactgtgtgtgtgtgtgtgtgtgtgtgtgtgtgtatgtatgtatatatctgcatacacacatacagttgactcttgaacaatgcaggggttaggggcacacagtcagaaatccacattccacatagaacttttgagtcccccaaaatttaactactaataccctactgttgcctgaaagtttcaccaataacataggcaggtgattgacacatagactgctctctacatatatgcattcataacatatttaacttttgttttgtttcgttattttgagacagggtctcactctgtcacccaagctggagtgtaatgtgcaatcgtagcttaccgaagccttgacctcctgggctcaagcgatcctcccacctcaacctcccgcctaagtcccccaagtagctgagactacgggcctgccaccacacctggctaatttttgtagagatggtgtttcaccacgttgcccagactgtccttgaaatcctgggctcaagtgatctgcctgccttggcctcccaaagtgctgggatgacaggagtgagccattgcaccctgcactttttgttatttttttccccaatatttctaggctagaaggttcatctataagttttttcaaactgtaacaaatcaccaagaaattttccagtatgtttattgaaaaaaatccttgtataagtggaccagggcagttcaaatttgtgttgttcaagggtccactgtctgcataaaaatacatatatacatgcacacaagtgtaaatgatagatatagacagtaaattacaaagcaaattgggtaaaatgttaacagtaggtaaatctgggtaaagggtgaatgggatatggatattatctcaactatttttgtaaatatgaaattatttcctaacaaatttttttaaaaaaattaagcaacttatgactacttcatgaattttagttacaagcagtatgtggagtaaatgctttgtactaaatttgaacacaatggtgtttatggtgaacctgaaatataaaataacagtgttaacatgtcaccgtctcttctgtggagtgatacatgtatgcctgtgtatggtggttggcatttatgtgtattttcccagctccccaatgataaacctaaaaacctctaaacctaaaagtctcagcgctaaaaatccagcaaggtcaaacaaagatttcaggggcccaagctcatctattagcataatatgaacccagcccgtgtaacgtactgaaattgtgccatgccacttacacttaaacagacagaagttctctgctctgggtctctcaatatacattttttcagcaccctgcttcactttagaggtgaagttgtgggctcaatgttacccacatcacttgcccattaaaaaagccaccatcgtcataataccataattttctgcatgaaattttggtctccttacccttgtagaggttcctctatgtacaagtttgcacaaaacactgcagggattataaaccatgaagaaaacatggtttcctttcaatgctctgcagagtttggccttttgagtaacctttttttttttttctgggagctttctttctcttttttttttaattattttttgagatggagtcttgctctgttgcccaggctggagtgcagtggcacgaccttagctcactgcaaactctgccacctgggttcaagcgattctcctgcctcagcctcccaagtagctgggattataggagcgtgccacaacacctggatagtttttgtattttttggtagagataaggttttaccatgttggccatgttgatctcgaactcctgacctcaagccatctgccttcctcggcctcccaaagtgctgggattacaggtgtgagccaccgtgcctggcctaaataaggtgtctttgaacagaaacatgtataaaactgaattatgtattgatcgttgatgaaaatgtgatcagaggtttttgggaaccaaccctgtatttccttgaggagcagtattggctaattcagtgttcctggtgactttaccacaaataatgagagttgacttgcatgtgtgtgtgtgtgcgtgcacacgtgcatgtgtgtgtgtgtgtgtgtatatatataaaataattattactgtttgctgaatcatttgagagcaacttgcagacattatgatccttcatccctgtcttagagtgcatttcctaaaaccaaggacattcttttacataaagttactttatcaaattctgaaaatttaatattgttacaatattgttatttggtggtcattctaaattcaaatttttccaatttttcattagttgtaagttctttctgatgcagaatctagtccagatcacacattacatttatttgcctcctgagtagctgggattatcatgcccaactaatttttgtatttttagtaaagatggggtttcgccattttgtgcaggctgatcttgaactcctgacctcatgatctacccgccttggcctcccaaaatgctgtgattacaggcatgagccattgcccccgggcttgcaagctcttttttaacttctcttcctggacaagtctctgttgtggctctccttcagtgtctctggccagtcattctcagactgggaaagccaggtccttctcctccttggccttctcatcatccatctccttcctcctgggccactcttctgtcctcatttattccgggtttttccttttcaaaaacctgtttcattcttatgtatcctgtggacttgatgaaatcttacatgacttcatacaatcacatggcacgcgtctcctggaaagttcagagatctgtctgttcattaaccccctccagtgggactctcattgatgtggcagcagcaacatgaggaatagaatcagaaaacatttcctgtagccatttggctcattggagtgaaggaattttttttacagttttcaagttatgctgttttctaaagttttgaccatttatttttatgtcacagagatgaaattgattttgaggtcttatttttgttacacaaatctagaggagagtgtgtcagtatctcttctaagtattagacacattcatttgctttttcctggaggaaaacatgcaggaacaagaacccaaaattctagatatcattaattttttaaatttaaataatttctaagagaaaagagacgttatccatacaataattatgcaactccagttattattattattagtattatttttgagacagagtctcaccctgttgcccaggctggagtacagtggtgtgatctcagctcactgcaacctctgcctctcaggttcaagcgattctcctgcctcagcctcccgagtagctgggattacaggcacatgctaccacacctggctaattttttgtatattcagtagagacggggtttcaccatgtctgtcttgaccatgaggcctcaccaccatgtgctcaccatcataaggccaggctggtcttgaactccctacctcaggtgatctgtccaccttggcctcccaaagtgctgcaattataggtgtgagccactgcgcatggcccccagttatgtttgaatggttgctttccatcttgtgggtgtgttctttagcaatgaccaggctgaagcaagttcctcccagatagttccatctttgcaaattaagagaaagacagctagtgtggataatggaagggtgacttccaatgtattctctggaattttagtgaaaaaattaatagtgggtacagctctgcacagatgggctcccttggttcatgtgaccacagatgttttggtatcgtattgcatgtgatttctgtagctgttaaggtattcccatagtaatacttatgtggacacgttcttgtaaaacttcccaccaaaattcagagtgaaaaaactaacatatcagggtgaaattatctcaggatgcaatatgaagtcttaagaagtataactattcatttcttgtctaaattgaacttgaatcttgagataatcccagaaagttttgacctcgccctgcctccgtccttaaatacattcccttgagttaggttgagccatcagactggtttgcagagtgcccagtcccaaaggctgggcaagagaccggtctttggtcttcatgactcagcatccagtctctgagggtgggtgaggctcagtcctcagtcttggtgactgtctttgtctgcttgtgctgctataacaaaatactgggtaatttataaacaatgaacatttatttctcccggttctgggggtggtaagtccaagatcaagttcccagcaggttcagtgtgtggtgagggctactctccgcttccaaagatggtgccttgttgcagcagcctcaggaggagatgaacgtcgtgtcctcatatgctggtgagcatgggctgcggggtctcgtcctcatctggggtgtccgtactggtgagggtgggctggggtggtctcatcctcatctagggggtttctgtagcagtgagggtgggctgcggggtgtcatcctcatctgtgggatgtccgtgctggccatcaccgagttgagcacttcccatcctggagtcttggccacaaccctcacatacagacaaaagtcgatttgggtccagcggctctttcagcacgtggtgccaacctaagacatgaggcctcctgctggagctccaggaaactctagtctctgccctcctcttgcatccgtaggatcgctgggctgctgctggggcttggcaatcctcagagaccttggacttgtctgcttggagataaggcacagtcatttcatctccaactgctgccaagccctgctggctggcaggacatttggactctctctccctgggttttcccaggacagaggttacagatccttcagctcttaggctgatgtcacttccactccttgatctcagcttacaggaaaggtggagagaaaaggcgatcagagcagagtccctttctgaagacacacttggtcctcccctgcctgggtctgcaggggtcagaagcatttccatagcagtcattttcatacaggccctggctcccattaggcaaccttcctctttggaaaacccaatagccaggaatttaaaaggcaggactcttttctcttaattttctcctgaaaaacccttccctgaggcaaccagacccagctgctgcccaaataggaaggaaggtcagaattgacaggaattcacaaggaaagagagcataggtttatatttcagggtatcagtcatgcggccatgggatcagatttggaactctgtgattaagctaatttctggcattaggctcaatccctctgtgacagagaagtgtaaaattgtcaaaaaatgagcattattttagcaacacaatcctgacactatgagagggagaaaactgggttggatcaagtattcatcttacccagtaagccattataactcaggcttttgatgcatattttgggctgttattcatcaaggtggtcaaagtcatgaagaactgtatgttattctataatatactttctatattaagtctgttcagatgataccacattttctacatcactgatccattaaaaaaaaatctttctttgaatgcctcttgccactaatcaggctatgatattcagtttttgagataggttaacaaattgaaaacccagctttaaatgttatggtagtttaaaaatagaagtgttttacttcaaactattctgagttgctgcttagagcaataaaaatgtactttatagcttgttaacctagatctcagggatatccgttctacaataatggaagtagatttgtttactgtctaaatcagccttgtcagaacaatgctctccagtgactttttaaagtcagagtaaaccaatacattctgtcttctgtgattatacagcatggcatggtgttctcttgtatacttgtgttttgaatatgagtaacagtctttagctgactttagcattttggagaaatctgtatatgtggcttctacttatataagcatctaccaaatatattaactgagttttatagtccggttattttccatttcagttacttccaagactcttcgatatgcacttacatacttcatactcattaaatgaagatattggaagctaccttattttgaggtacagcataaagcaccagcagagcttagttactacacattttagcacaatctcctgtaagttactgcatgctgcaaaagagctgaatgagtcaacagacattgtaatggtgatgtgtaactcataacctgaaataaactatgtcaaatcgattagaaaggtctgagcacatctggaaaattggcaggtaatttagaaagaaatgactagttattaagaactcaggccagttaaactgggagattaaaatgtattacattgagagactattgccatcaattgccatttgttattgaacataaaatgcagcctagttttgagactcaagtgatgaacccttcccatgggttctttctacctttctactggtcctcaaaaacaagttaaagcaaaaaagatttaagtgataaaatgtgtttatgcctcttggatgtatacttttttttaatctaaggaagaaaccttatgatatgatatgatgaaaccatcctctctggattctaatcctaagtaaatactgaccagctgcattaagaaattttctgtttttttctccagatcttcaaatgctccattaaaaaaagaaagtttgttctagtgttttcccatcagcatttacctactcttatgtaccttcaccacaatcaaaactgttttccagcccaaacttggcctccaggccctcactgctctagagccagcccctcctaatggtttcgctcacactcagcgccttagcttcccctcctcagggtcacttagagaaggaaatacttctgcctctttgtaccacctcctgccagaaaggagaccccgcactgtacctgattctttgggtcataggaacagcatgtgccccacgtgggcattctcctcagtctttatatcacataccctgtgaatcagcatgctggggtaggaccccagggtggaaactgttgaaagccgtccagcaggcaatgaggtatgctctaccctggaggcctggtaaccttcacgacccccttgagcttcaagtctctgtggctgatggttttaatgataggagcccagaaagggaggcagcttccacccagctgcacccctcgaggtcttgtgctccctgaccgggccatcagctacatccttttgcaaagcagccatcagcttatgatggggtcttgctaagctgagtgcctgctccaggaaagccttgtgatgctcatacgtggtccgatacttgtatttggggtgagccagcttaggtttaacgactaaaggacaggaagagcccggcaagccttgcttgtgaaatggacacggtatatccaggaacacacccagtctgaccccagcagcactgcactttacatggaaagttagcagctatccattattcatttcaactgcaatgctattgcagtcaggcagtgcagagagacagcagttttcccttatccaagtgatcttgagaaggggaagttgaggcactaagtagaaggaaaacccttagggaaggttggctctaaagagcaggaaatttatccctccctcatgcacctgaagcaagctggtgctcagtgggacccacaattcatagaagttccctaaatgcctgggcctggttcagtgatgatttggctgagctgagacctgggagtgctctctggcttgctgcagccattccatctcagctccaatgagacagggccaaagatggacctgattctccacccagtgggcagaactcaaggccattctcagctataactgctacttcccttggtaatccctgttacattcttcccaactcttaggctgttgccaatggcctagctatttggtttgccacctgaaaaaaccagacaagcagataaaaggcacctctttggggggctgtagaccatggaaacaaatcatgcatggaaccatgtgggtcactcaggtacaagcccacagtgtggacctgtttcgatgagaccaactggaatgagctgctgatccagatggcactggccacataaccaccaggctgcctgagtttaccttcatactgggcattgcagcacatcccccatcacaacatgagcacaaaggaaacccagtttctgacacagagctgccactcactgcatgcaggtgttttatagtccggttatcttctgtttcagttggtgtctcaggaggccacacttccctgggcaaggccccccctgctcctggaagactgactacgttggacccctgacctccactcagggctgacactgttccaggctatgttgttactgtcccagtctggtcagccaacttcagccacaccaccagtccgcttggttcttactttctgtttgcagtctgacaatggaacaccttttgtcaaggaaaccactcaggagtggacagatgaccttccatgccattgccatccacaggcaccaggcattgttgagcactggatcagtctcttcaaaaactgactcaaagacatctgactttggtctcctcctggtcacacgcttgactaagacacgttgttcactgaatgtagctgttccagaaagggaccatcttctcttggctgcttcttgagtaatgaccagaatgaaggggcaaggaatcatctagatctattttgaaaatttgataacctttcctgatcattcctggacatgaggcttctctctttaccctaacaactcccccaggcccacgtggttagtgcacccccgtgagcccagcgcgttctagtctaattctgatgcgaccacctggatgctcatgccgcattgccatggactgagataggtgggacagggaccactggctgagagctccgccccctgacccccctacagtggttcacacaggccaaaatggtggccgtgacaggcctctgtagactttattaaaatcctctgtgcctcttgcacctgactgtccagatggaaagtcgggagtgagcaggggcatggggagcaaagtaaagctccagccactgacatagggcacactaattttattccagtggagggagaagaaccacctcagcctcaggagcctcggcccacaccccagagaaccacctcagcctcaggagcctcggcccacaccccagagaagaaccacctcagcctcaagagcctcggcccacaccccggagaagaaccacctcagcctcaggagcctcggcccacatcccggagaaccacgtcagcctcaggagcctcggcccacacccctctacctccactaagaggtaagcggggtgagggctatgaatgacctttttcctttactgtcatccctggtgtctgtcttccttgtgaaggaaaataacttggtgccgctcacccaaactattacaagcaccttaactgactgctggctctcacatcgtcaccaggcagctctgaacacagctggactgccattgcccttaacttaccgagaaatttttggaaacagcaggggagggcctcggctcgactggcagtgtggacagacagggcagggtaaatggatggctctcaaacagtctctccaaagccgagaaggacttcacccagttgctcaaactgaactggaaacggtgcgttttaccagcagatcaggaggctacattgtagtgattgtcaaagtgcacttctcagttcacactggtcccaacagtcaaggaagcccaacttgggggtgccagcaattgtaacccacactctgttttcagaggcaccacgcgtgccccagatctacactccttgtatgggagggagtcaggtactaagttgcttttcttccccaaaacgtgctttcctttccccttacaccttatggattctcttgagaatggaagtcgacaccatcgatagaccgtgcagcactccgacggctatgcagatcgaaaacagagccgccgtgcttaccctcaccctgtgggcagtcagatatgatgggaatcacccagttagaaagatggcatggaatctgtccctgacttcaaatgaagtaatcaatggtattgccctggaaggcaagcaagtcagcctccactcaccagcgagagttgtcagggatggtagcattgccccagactcactcttagtggcacaatcaatcacgaactcagtcattcataccttgggacgtaaagaaatgacagtgaatggcagtaacaaaggcacaccacagcaagggacccaagctcggcgcaccattgtcctttttcattctggttttgctgagctgctgttgcttggccttgcacaaatgctgactgggagtagtctgagacctggagtgggacacacgtccttcccatgactaaaactgctgatgaatatgataatatttctacactagcctccctcaagcccagaaccatgatctggaacagcatttgcatggagcaccaaattacaggccttaatccaacaagtatttcttgattatacgacttgattccaggttagacagatggaaaaatgctgataaatataaaacatgtcttgctctctaaaaaattatagtttggttgcaaaagtaagaccaagttgactaagatataatggtcttttgtatcattatgtgatcatttgatcattgtatcattatttgatcaccaaattatatggggccaaaaataacacaaaattgggaaagagattgtaatcactgagggatgaaaaaaggcagtcaggttttgaaaaagagctctatttgggtgcacgccgagcctgcctgactgtctacaaatgaaaatcaggccaatgcctgtggcctgcaaggcttctcgatattctaaggtgacatggattgcatgttattatgcaatttttaaaaaaatggtagagcctctggatgaacgtgttataattaggtttccttttgttgatttggaactctttctgttcattgctgtgtgaaacacgcttgtggaaggaattatgccagctttgcatagtgtgcatttttagagagaacattttcattgaaacagaatcagaaatgtaacaacgagttgggtagaaatttgtcatgattcttgttggcatatattattgttgctaaaggcatttattaaacttaatgaaagtgttcattaagaacactgaagattataatgctgacaaaaacaccaaaaaaagtcattctactacattgaagattaaaaataaataagctaccccatcaaaccaaataaactataacttttaggtaattataaaatacaacttcacctgcctgggcaacatggtgagatccccgtctctacccccccgcccccaaaaaaaaatttagccatgtgtggtggcatgcgactgtgatctcagctactctggaggctgagaagggaagatggcttgagcccaggaggtcagggctgcagtgagcagtgttcgtgccaccgcactccagtctgggtgacagagtgagaccctctctctcaaaaaaaaaaaaaaaaaaaatacaacttcaaatgaatgaatactatatttcaggtgataattcctaataataaaagcaaaatattacaactacccagcataactgtctatctgtgatctttcacccaaagctcatggcctttgtaccattctgtgaatttcaaggttatcaaaatatagggaatgttaactaatggtctaacatttcttaatctttactttgtatcaaatggggctattacttaaattctttgtatgttttaacggtttcttatgaaagcataccttcttcacccagcccgatcttgacagtaatgcctaacactaaacaagtcagtgttgagttgtttgtttaatctctccaaatatgttggtttaagacctgtacaatttgaaaataaaacctgcaatactttttacatatgaatagcaatttacttatgtctgaaaccttagcaataactgcacagagagcatccaacagtcttaattggagttatctgattattactcacaggataccacaagctctaagaacatttactttacactgctggtgttctggtcacctcctcggtgaattcactgctccctttgcccaagtcgaacagtttctattatttgtaactttttctttgtagtgtttactgtgaagatagctgaatgtttcagccaggcttttttcttcttttacagaataatattgttcatgatcaacacagattctacagagtgtattaaaaaaatagtcatcaaaagcttgattgctcccagcagccttagatcaggcctgtgtagagaaggattgaccatgaagccgaaaggatcactgattgccaccacaccttcctcagccctgagaggggcctaggcagggtggtcacatggccatgtgttcttgtaaaattcacaaacgtgagatcgtttggccacagtcctttgttactgctgcctctttctaccctgacttcactccagcacattctcctgctgtttagaggaattggagtggggcttggcagcttcgggatctagctgggggaacattgatttggaaagacattgagtatgagtttagaatgacacattttgtggttcacgcttactgcggactgtgctgacttaccaggagttattatgtgaaggtccagggataatttctccgtaagaacgcatcccacggtgctggcagcagacccacgagggtggtagaggagaaacaagattggaaatgtctggagtcacaggcaaatccgtggtaaaatcttggatgtgtaagaattataaaatgtataggctacctgggaaaactatgataggaaggttgtgttctcatcaataatgcagggtatattataaacgtatccatgtgttcatttattttttcatgtgaattatatgaaacatgtatcagaattttttcctttgtatgacacaatctgtagcaatttagtaagcaagcggtctgtgtgtgaaggtgaatgtcttatgccttttaatatattggaacaggtcttagtatatttgattattttgtttcaaagccatctggcaggtccaaacagcacatgtgtcattccaaaaccaataatttattatgagaaggaaatacattttaaatagaagtaatgaataggctctcaggttattagacaacttaattaatgaagagaagtggtgcatacgaacccattgggaaaatacttgaatttcttgcttccttgacaaaagttctgacatcaatgaatataatctgatctaatctgccaatgagcccctacaacaaggaactaacgataaacttgttaatgagtgtcagcaattcaaagagagtttaagattagttcctgggcaacaaaacttgaaaaacctagtattcttattgcttgcatgtgagagaaatttggaattccccaaaaaatgtgcatgatataaccaacaacaagtcatgaagctgaaagtaactttttcaaacttcagtactaaaagagaaatttagatcaactatgctgctggaaagactggattatctttctgcttttttctttataaaatgatagtcatagtttcgtattcttttttcaaagagcacccccaattgtgcaagcctcaagcctgaggaatttgcactcatcaagtacctgtgcctgatgcgttctttccagaactgaagtctcattgataggtgaggtaatgcgatcccagctggtatagagatttattcctccagggagtagacagtgaatttatccagaaatgaatgtgtatacgtaagaaaagctgttcataccaagatttacacacctatgttccattaaatgcaaaggatgtggtttcatttgataatcgcttctggttgccatcttggtaacgttacactgaggtgctggagaggtctgtagccatttagggtcttaccttcaactattctgtgtatctgttatcagggaatttcttcatttcacgctgagcaccagtgctgtattagtgagtggggtgtatagtttgttggcatgcacggacttctggtcctataagcttcaggctgcagaaagggtttagccctggaccattctgggatgcgtcgtcaaggctggtgcttctgcgggaggcagggcactcagggctttcatgctgcaatgggggagtcccatggaagccagaacgaggtggtcaccctgatgtgaaggaatctgcagaggcaggaagagccctgaagctagctccacgttcccctgtccatgtctacattcacagacactttcccaactctccaggagaagcagtgcagaacgttctggaaagagagtgaagttttgccctcctaagactaggtttctgatgaaagtaggaccactgaactgtaggcagctacaggatagggcctgtctgttcttcaccagtgtagcctcagccgcgagcacagtgtggagctgctcacagataatgaagacagatggtgctaagcggaatctcctctctgctgagtgggttgctgtagtggaagaagcactgaagagtcccaagcgtaggttgaactccttgagtatgtcctgagagactggggcagcctgagtctctgcgcgcaccagcctttacactgaagtgagattctatgtaagaatataccttgtctaccggaatgcaccacaggactggatattgttatggtaaaatattttagtaaaggaaaaataatgcctaaatacatatagcctttcagaaattttcacacaatggaagtgctgtggtgattatgaacacaggctctggagcgatattccctgagttcaatcctggatctatctgttatcagctgtgtgaccttgggcaagttgcttaatctctctgtgtctattttttcatctgcaagtgaggataatcatagaacctacctcacagggatattgtaagaattaaatgagttcacacaaatacaggacttaaagagtgtctgtcacttaggaagcacacaataaatattagctattatcgttatggtcttcgttttactttattgatgcctaaagtaattttgaactaaaaattgtgattaaaattttgttttgtttcagagatttggaattactgtctaaatccaccaaatcttgataaaatattacagggaaaatagaagtttgggtaatgtccctatttcattatttagtatctagacacattatttaactgatgtctaatatgaacacttataaaccaaagaaagtgagtttaaatttcaccaggtgttaaatataaatacctgtttaattccgagggtggttatatcctaggacaaagagctatcaaggttatattgtagtacaccaactctgggagatgagggcttgagtaagtctctagatacttctttttgtgtgctgaggggttttgcaattctttggctgtcacagccctgtgtaaatttttgaaaattaatgacaatttgctggtagtggccaggtggtgtgccaggggagaaagaggaggttagagggagatgcagtacactctcaccaggcagtgtgaagacaggagagctggcatagatgaggcttggtaacaaccagaaaccacggggggaaagcagcctcccaggaatgagtcagggcccagaggacgtctcacctttctaggatctgtgtggctaccgcttcggcaccacctaggagctgtcaaaattgcaagatctccaagcccgtgccggaccttctgagtgagtttgtgttttattcacccccactgaggactgtgtgcaggtaggcattcgggaagcaccgggcaggaagctgtccttccatcctctcttcacctctgccctggctcctgccgtcctctctgtaaggaaggtcttcctcccagccagggtgaggctgagagctttagagccctaaacactgagaagacaatatgcagatgaaatgtaatgagggcctgagctacaggagtcacttggcatggcaagaaatcactggatacgagtaatattaagatattcacattgtgaaaccttgttgccccggggaggataagaaaaagcagcttacgtttattgaggtatttactttcattagccccatcttacaggagaggaaactgaagctggaaatgaaataacctgttccaggtctgagcgcaaggaagagggaaggccaggactcctggctttgggtctgcacccgtcaccgtcaccgctgtgcatgcagaggatgaggggaaggtcagggagctgcagggagcaaaagggtctggctgtggggaagggcgggggagagagagccagttccttatggtcagaccggaacatcgtaatgctccctcgagaactgatgctctggtatcagagcatggtcaggccggaacatcgtaatgcaccctcgagaactgatgcgctggtatccagggaggatcggtaaaggaaccaacacgcacatatgcactcacaatgctcacggatgtcacgcagcaggacctggcagggctggcctctgcttacagaggccgacgttccctcgccctgagacatcaattttactccatctcttcttgcctcaaactttccatatccgtccccattctaccctcacttcttcaacctgtgattcctaggtgattcctacaaggagacgtgatagcgtgcaagactcaactcccgtcttcaatgaacttacgtttcaatgagaatgtatgggtctatggatacttcagatagtctcatgtgaacaatcttaccacctgcaggaagagcatttggaaccatggcccattctttcttcaaacttcttttggcttccacggcatctctttctctgcatttcctctttcctcactccttggctggtgtgagggcccccgagctgccactctaagctcatctcttgccgtctttcttattcctcaggctccaaacacaccggcttccccgccatcccccaagcgtgccaagcgctctgctgcctccgggacttgctgtttgcttttctttctgccccagcgcctttcctgtggctggctccttctcagccatcggatttggctcaaatgttgcatctcctgagagcctgtttttaaacccttgattttcctcagttctattaccttgtttattttattcaaaagacttatcatgagctgaaagtatctttttgtttgctcatactctatctccctgactagaattcttcaactacgcatcccgtctatcttatttgcttcagcatctctcatgattagaacatagccttggtgagtattatagtctcattaatttttaatcaaatgaatgaatatataatatacagatacataatacaaacaatttaacctggcacataaaagaccaggagagataagacatccattttctggtatttagaggactgtcataaagaagagggatttaccctgggctacatcggctctaggagatggaaccgactaagagtgggagccgaagcaggtatatattggtgcaatttaaggaagaacttcctaccaggtagagtgttcaaagatgtaatagcctttttgggaaggtgatgagcctcttactacagtttttcccaaatagacaggtagcttctgggaagagatgatgtaaaggagattcatagctgcttgtaataagtggcttttaaggtttctttcaatcctgattgtctcttagaagttgggtgcagtgactttctctaaggcatgtactgttccaggatgatacatagataaaggtgaggttactaggaaaatggactcgattgtttagctgtatcctaatacttgttttcaaagagtaagctaaacacttacagtttttaaatttaaaaatgagatagagatcaacaacctcaaaaacaacgtattcaaatcctgtggcaccgcctttgctcagggagtctttaaagtgcttattctagaatttcctggagagtcatgtaacaggaagttgtgcaaatttgttaaacactttatttgttagatttcagtttaaaaaacttctgctttaaatccattcctagcgggtaaagatgtacctccactaatttgaaagaacaagttaaaagctctgaaaataattataaaagagtgcaccaaaaaaatatttgccacaatggcaggatcgctaaggtaattacagttccttccaaggtcattacttggtgacaaatgcctattggatatattggctgtgttgggcatagtaaagaacaatgcccaggcgtattgcctgatgggaatgtggcctgtgtgtgtccatgcgtacatgcagattacaataccaaatctcttcttcttaatcgttttttgtttgttttgacaagaagattcttactctatggtttcacacgttgcatgctaaatatttcagcctttgcaaatgtgataagtatgggttctgacattttgaagatcttttcagaatattttagaaatgtattatgtttattctacatatgcatgatcagtgttttacatgtgattatagctttgcatttacaaagaaaataactgttaagtaggaagcaatccatttggatgctctaaagagtaatttgagtggcttgtaaaccttttactgttttgtcttaaatatatggctgatgatatacctttaagtagccttaaaatactatagtttactttctatgaatgactgcagaaatttcaagcatacacacagtgcataacattctacattatatttttacttttaagaaacaaaatgtttttcctgtctagttctaatttatcactttgtagttatgcccagtgaactgataggccattatcccatcttattaaaacactcagggcttgctatcccgacaatatatcaaaagaaaagcaaaacaagaagatgtatacagaatacttaagtcaattttatcttcagagtgcggttttcaggtagagacgttgtaattgttaacaataaaggtaaaatgtagtctggttttgcttgagttttcagatcaattttttagacaaaaatcatcctatagtttagtatttggccaaattattttcttctgaatctcccaaaaaggaaataaagtattcctcttatcaatttgaccccataacaaatgctgccctttgggctttttttcttcaattccaaaagcattttaacaaccataatccaagacaagaagataatatatttatcatctgatcatttttacaacttctgtttttctgctataataatataccttactgttaatccttcccagctgttggagtaaagcacttagattgaactatgtctgggttttaaagatccaaagctggaatgttttattgttgctaccttttaattaaaggaaaactaaaggttagctaggtcctgataaaattggaatcagattaaggtgaatttttctcccatactacagtttgttgtcaggttttaggtagtaatactagaatcagacccacccccgaccatctgactgtgcaggtgagaactgtcactttgtcttcaagaagcttcaggaaaggaggatgggagatatttgggaatatatttttctctaggggaaaaataataatatgttaataatttaaatacccaagtttttaatattggggaatgtattagtctgttttcacgctgctgatatatacatacccaagactgggtaatttataaagaaaaagaggtttaatggactcacagttccatgtggctggggaggcctcacaatcatggcagaaggtgaaagacacatcttacatggcggcaggcaagagagaatgagaaccaagtgaaaggggtttccccttataaaaccatcagatctcatgagactgattcactaccacaagaacagtatgggggaaactgcccccatgagtcagttatctcccactgggtccctccctcaacatgtggaaattatgggagcaattgaagatgagattcgggtggagacacagccaaaccgtatcagggaatatatacttatgactgtctcttacttttttgtctgcctacttctcttaatttgggaaactgcccccaaatacccctttatgtgatcgtgaggggtttgtcaaccaaagactacattcaccctgcctcagggtgggcccctgtatcagttgggacattccagagaaacagaaccaataggttaacacataatagggagatttatcttagggaattgacttgtgtgattgcaggggctggcgagtctgaaatccacagggcaggccagcagcctggaaataagtgttgatgctgcactcttgagtccgaaatccgcagggcagactgataggcaggaaactcaggcaagggttctatgttacagccttgaagctagattccttcctcctccttcagaacctcagcttttcctctgaaggttttcacccagccagatgaggctatatagggagggtaatttcctttacataaagtcaactgattttaagtgttaatgacatctacagaataccttcacagaaacatctacatgaatgacgcaacagctgggcaacatggcgcagccacagcaacaaataaaagtaaccattgcagccagtgagtcccacagggcccttctgtgaaactcacacagactcaggaaaaccactgggcattttctctcaagtcggggaacagcccctgctggttgaagggcctgctagagaatgcagctgacctgggagcacgtggagtgagggagcgagggaggccatcctggtggcagtgtccgattcctggatacagccgtgctgccgcccaactcaaccctggaattccctctcttgcttgagcaactaagactcttgatgaatgaagaagacttttagaaacctattaatacttaaggttaggatgcagcttacatgttaaatgacgttcagaaatccattcagtcattttttcaccagtgttttagtgcctgcattttacctttatggaaatgttaggcattgagattaaagtagtgagcaagagaaacccagtgcctgacctgtttagtggaataagcaacattgaatgataaatgacaaggaaaaaagcttacaaaagagtaaggagatgatatggcatgagaataatgcaggagtggccgactatctttgggtgaagattaggcttctttgaggaaatgcatttgtgatgcaacccccgaaggtgaggatgagttagctgggaggggaagagtgatctagtccaagggaagtatgggaatgaaagagcaaggactatacatggagttgaaagggcacaatgcctgggacagagacagagatgagaagagagacagggggaattcatgaattgggcatcaggaaaagcctcctggtcccctgtaagccttgcctacattggagcaacaaggtggtggtggcctcgttgcctgacgcaggaggactggagaaggaaatgtctgcaagaggtaagatagtcattcagttgaggatgcattaggcttgggaggagatgtttaagaagcaccatgagcatttagggctcaggagagctgcctgtactatcacctgtcatctgtgtgaatggagtgggaagggaactgaagatggaaaggatgctttctgaaggtaataataattatgagacagtgctttagcttattgccagtaaaataagcttaccaattttaaaagggagaaaccgtttctgtttgctgaccagactggcagcatttacagtcactaagtgggagctggaaagaatcccgcagctcgtctaattccaccctttaatttcaaaaataaagagattgaagccgagagagacagtcaggaggaccaaaacccaaaccttctgacgtctgctactttgctgtttctactacagttttgtggaaagggagagagggagacagggaaaaagaacactttaatgtaataaacatttccatcttttcactttccctttaattttatttatatagccatgcacctaatttagcttccaattaatgttgagctgtggtggattggtgggagctgcccgaagcactctatctgaagccactttggttttcagtgtttagtatgagtaaggcatgtatctaatgtccaaaccagtccaatggagagtgaaatggtggttattcctcatgcagagacagcaggcatgaaccagaactgtccccagcaaactagaacccgtggtctccctaaccacgaggactataggaagaaaatgcagcatgggagccattttgcaattcctggtttatatggttttcctatcgaagttagaatttgttaagattttgatacagaaaaaaagggggggaaagctgaggaaaaattgattccaactgcggcaaggttttcaaattttttactattgtcttcttcatggagatgtattaattattcatcttgaattttaataatgattttttgtgtgtgttccaaaaaaaggaattaaaataattactttgtataagtctaccttgatccaaaataagtatttcaaaataggaaacatgtaaatgtcaatttaatgcaaagctctttctcctttaagtcaatcctcttcctctgaaataaaatcttctgtaaaggtaatagtatttgtctctccttgtgatgagcatttttagagttttagaaatttctttgacactggaaggaaattttcttttcttggtaaaaactaaataatcagtagagaatagtgcttccaaaacaattttaaatgccagaccgtatttcaaacaaccgtctaatttgagttaagtacatttgggaaatatagttatcaccaatgttgacagaaaacttaatattggtgatcacgacaggcatagatcaagcactgatgaatatgcctttgatggagttttctcacgatcttcttcatgtgcaggtgatgacagctctttcttccgtggtgtttacctgtacatcaatactacaggcatctcaaaagacgttacaagtattgaagatctttatgcctctgcctgtgggatttctttagggaactgacatattgctaaagaatagactcaacatccattactagctttcattcaaatctctgtacctcacagaaaatttcactgaaaacaatgatcgtataccttgtatatcagagagatgttcatgttatgggaaatgtggaataagttctggaatatagtgcatatgaaaaccagtgagttttaggaaaatatttaaatgtggagaaatgcaaattatactcaaatgtgggcttcatcagtgtgaggagctaaggttgctagggtattgaaagttaatactctatgaaatgcatcttaagcagaagccttaaattaaaaatctacacaaatcaaactaagtgtcattattgaaaagcattttgttcatataccatgagttctttatatgaatgatttgcatgtatcagatcttttttttattccagacattttgtcctggaaaatatgaacttgtttatggaaattttgccctttaaatgttgcagctttaaaatacggctgctccctgttctatagtttaaaaatggcttagattcagtagtttatttgtaaatattatcaatacatgcctattttatgtatttagtaggtggatatctgaactcattcataaggaaaaattgaaattaaacaatttttctttcaattgggcatttctaatattttttacatgatctgaaaattaattcctaggatcatttgaaaagacttctgggtaaggggaagggaagagagtagaaaaatgcttcctacacatttagccattagattttagtcctcagcaggcaggtttttctggtgtgacttcatcaagcataacttaatagagaaaaggatgatttcatttattttaatctacaacctcaaataacataaagacctatgaagtatgcgtgactctttcttaagactcttaagaaagattcacacataaaaagagctacattattttatatatattatttcttaaaaaatgcgtttacacttgaaatagactcataaatactatggaagctataaaacatattttgaaagcaagtcctaaagtcttcagggtacgtctgtcctcatagcaaactagtgatttgagagttccctctatctttcagaatttatgtagctgaatcttaaggaccagacttatgacacttatgacactgccatcttcaaggtatttgccatataatttcagtgactgaaatctcatatgccttgaaaacctaagagctgtgatattgcaacaaaaggacaaccaagtgacatttcctgcaaattttgagagttatacatacgcctctcaaataaattgaaactgcaatttgggtatgtaaccaccagatgtcactgtcttgtgatttttaagtcataggcatatattaatacttacataaagtcatataccaattttacacttttcctattgaataaattataactctttatacagaaacaataaaaagactacattaatgtttggttttgaaactcaaacttcagccaagttgtcttaattcacatacatacctgctaagtagtggatatctctcatttcaaaagcatgcatttctgcaaaactggattatcataatcgtgtttaggactctttaggttgcatcttaaagaagcccaacctagcctaagcacaaaacaggaaatccattggcacacatacagaagcccagtggtgtactgccttcaggcatggcctattccagaggctataatccattttatcacaatgcatcactcagtaggctctccaccaaatagcacatgatatggccctgcagctgaagacccacattctacaacctcagtagagacaggccattccgagacattccatgtctctgctcttttcaggttctgtaaccacagtagagataggccattttccccaatagctggcagaaatgagctgaaataagttttgattagccagtcttgggtttcataaaccttcaggatccagtcattatggacaggggcatggcatacttggattagccagaatcaggggcccactgcttggctgtggcagtggctaggccatcagcctgacttaacaatatgggatggatctccacaggaagcatggcaccattagtacagcacagggagatggaagctgggtgggcatatcaaattattggactgtcattccatgtctctgctcttctcaggagcaagcagtcatgtccatggctgccagagtgacccctctagaacaaaatctcgaaatgctactcttctctcaagagggcaagatgcagtacaaactgtgtagtatacacgactcctcttgacctaacttcttccttttcctgctttagtctcatctcccatcactgctgaatccaaccacatgaactctttgcaattctaacaaatgatcatactctttcaggtactactttccacttcacaagccttactctttctcataacaaaggcttttcccaagttatttccgtctggaagtccttccataccgttgtctttatgcatcatttaaaaatcatccttggccaggcgcgggggctcatgcctgtaatcccagcactttgggaggccgacgtgggcgaatcaagaggtcaggagatcgagaccatcctggctaacacggtgaaacctcatctctactaaaaatacaaaaaattagccaggcgtggtggagggcacctgtagtcccagctacttgggaggctgaggcaggagaatggcgtgaacccaggaggcggagcttgcagtgagccaagatcgcgccactgcactccagcctgggtgacagagcgagactccatctcaaaaaaaaaaaaaaaaaaaaaatcatccttaagcatttctttcttgaaatttccttgtccccacttcctaccccttcccagacagatttagatatgtattttctacatgtccacagtatctggcacacgagtatcattagcatttgtcacactgcattataatatttgatggtggggttattggccattaaacagaacttcttaagagtaagggccatgaattatctgaattatcctccatgaattatcccccaatacctggtacagtgattggcacatgatggggattgaatgaatggttgatgaatgaaggaaggaatgcatgaacaaattagtagatttgaatcggttttacactagaataatttcctctttgctctctgcaaacacgtatatgaagaagcacttgagtgtcagtatgtatagtgttaaaatcagtgtaagctttagagctagaatgcctgggctcagattcttgcgtcttcacttaccagttgtgtaactgtgggcaaagcacctaaccttctgtgcctctgttttctcatatgtaaaaagatagtggtaatagtttccactttgctaagtgtttacttctttaatcttcaccaactctgtcataaacataattattcttatttcttaggtaagtgaactgagactcagaatgcttaaataacttcctcaaggtcacacgggttctaaaatggggagctactattctaattaaagattatctgatgctaaagccctcacagtttcagctgcactgagatttcacaattggttcttactggctggaagaaggatacagggaaatattttccttcccttagctaatttttgtcctaatgattactttctgtataagattgtaacatgaaccatgtagctttgagatattgctataattgtgctcactactgctaagctgtattgtttataccttcagatagttgaacatagatagttgagaaataaatgccaacattttcatttgaattgaaaaaaaaccacaaaaaccattatattaaacctttctatttgtgtagatattagcaattttccccaaaacaaaacaagatacattcaaattgtaaatagctcaaaatggcagaagtttattcaggatgaatttgttcaggatgtagttaaatggattctcttctccattcttgtgtgtcagattacctaaatagaggcagtggggtctccaaaactctaagagggcaacatggaagcagtagcagttcattgcccataattttctctgcagattagttcagagagcccacttagaaaggaggaaaaatgaatcaaaccaaaagttaaagcaactttctcaccttccggctctccacagatgctgctggctacagtgattctgaggattatatataactcatttaccatcccaaagtcatgaaagtagactttgtattaaaggacaattgaacaaactctggtatactaagaagcattaggagaatattagacaattgttgagtaggatatttgatatatgttctaagtcatgatgcgcatctgcatcgatatcaatttgttttcattaacttagacaattaaaatcaagaactaagttattttaagcaaacagcttcattttacattcatttatttctgctttgcatgaagcacagctgcattataatgtgatcaagcacaataaattgtgctctgttgtttatagatggaagattgtaccactcaggtacatgtacaattttaccacaagtgttttgaaagtacaagtgtgtgagattttcttctcttctgaaaataattcttactcagactttagaaactatggattttctacctcctattaccaaaaataaatgcaatgttctgggccaatggcctgaagttacttaactgaagttatttaattggtagtatcttttccaatgtttttgaaaaatatattgagtgaaatagctactgcatttaggatacttacagaatatagatatggatatatagatagatatgcagtgaacaactttgtaggtctcccctggggcacatgcatgacaattctctaggtttataaccagaagtagagggtctgtgttatagtaaatgcccatctttagatttacttgttactggcaaattgctctctacccaaattcaggataattcattcaaagagggtttatttacaaagattttcaaaggtgtagggagagggtaaaccaagtgataatgctgtgacctagggctagtggcagctgagctttggacactgctaggcccaaaaggatgataggagggaaagattccttaactctgaaagtcctgtagaaaaagttgccttcagaagagaagtaacctataattgagaaaacctggcagagagggagcctgggaaacaaattcctctttccagtctctcctctctacttccgctcttctgccaaagtccctcactggccaaacaaaatggtggccagaagacactggggtccattggtgttgaccatacaggttactttctcatagcagagagcacagaggatctggaaaggaaaactgagtatgtccagccacaaggtcaatccaagttgttagaagtatattttgtctgttgctaatgcctgctatagagtagtactccctagtatatttccatcatttaaaaaaatctatcctgtttccttgtgatcaacttccaggttgcctccaattcccttctgccactaatagtgctgtaaggcactttttttgtatatgctctcttatgaacttgaagtcttcttaggggtctaaatccagtagcagaatcaactggtcttcgggtgcatgtgtatgcttaacttgaatgagggtcctctaccctcccagaagcagtgcacaagtattgcggtatcaccacatccttgccagcatgtagcagctttgtaacttctgccactgtagtaagtgtaagtgaagtttcctgtatacactatgatacattcatgtaaatgttaaacacataagtcacatattatattctttttttttttttttttgagatggagtcttactctatcacccaggctggagtgcagtggcgcaatctcagctcagtgcaacctctgacttcctggttcaagcaattctcctgcctcagcctcccaagtagctgggattacaggcacgtgccaccacattcatctaatttttgtctttttagtagagatggggtttcacaatgttggccgggatgctcttgatctcctgacctcatgatctgcctgcctcggcttcccaaagtgctgggattacaggcatgagccactgcacccggcccacacattatattcttataaatacatgtgtagtaaaatccaaaacaaacaaacaaaaaaaaaaaaaacaaaattggattggaaagctaccattggggataagctcaaaggatatttcgacttcatataaaattttatgtatataaaatgtttaaagaagtatggcaaaatatcaacatttatgcctattgttccaatgtaagcctttaggcttatttgtgtgttcacattatgatttttacaacttcactgaagtataaatgaaatacggtaaatcacactaattcaaggtgtacaatctgctaaatgttggcctctgtatacacccatgaaccatctcaggaagcacgataatcaacatcccatggtcccaagcctttcctctgtccccaggtaaccactgacctagctttctacatagaggtaatcatacaacatgtactgtgtttgtgggggacgtatgtggctgctgttactaagcgtatgcctttgatgttcattcttgttgcctgtatcaatagttcattcttttttattgctgagtagtgttttattgtatagaaatagcatgatttctctattcacttgtcagtaggcatttgagctgtttccagtttcagggatcttaaacataaagctactaaaagcattcatgtacaattttttgttgggacacatgttttcatttctcttggggaaatacttaggagtataacggctgagttgcgtggaaagtgctatttatttacctttctaagacattgtcaagtaaatttccaagcctgttatatcactttatatttccactagcagcgtttgagagtctcagtttctctacatcctcaccaaccacttggtatagtcaatccttttaatttcagccagtctaatggatacacagtgactgagcatgtccttgatgactaacaatattgagcatattttgtgtactttttaatgtgcttctatatcttctttttatgtactttttagtgtgcttatatatcttcttttgtgaagtgtctgctcaaatattttgtccatttttattaggttaattgttttattgttaagttgtaagcattctttatatattttataaacatgctttgtctatgtgtttcaaataatttttctcagtcagtggttagcttttccattttcttaaggctctgcaaaagagaaaatgtatttaattttgatgaaatccagcttatcatttttttcttttatggttttacttttggtatgctaatctaataaatgtttgcctcctccaagatctcctatgctttgtttgtcacaggttttatattttagggtttacatctagtcctatgatcaatttttagttagtttgtgtatgtgttatgaggtataaattgtctatttttttccatacagatataagttgattcagtatcatttgttagaaagattattctttccccatcaattgctttgataatttgtcaaaaataaattgaccgtatacatatggaatagaatagacggtccagaagtagactgaacagtctgagctgtacttctttatcttttgccaacctcaaactgcaactttatagccagtcctgaaatcaggtagcgtacataaggtctcaaagttttgtacttttttgttttttttttttttttttttttagttgtttgggctttcctaagccctttgcattgactataaatttaaaaaatcaacttgcccatttttaccaaaaaaaaaaaaacctgctggaattttgtttaggattgcattgaatctatagatcaacctggggagaattaccagttccaatccatgattctggcatatctttcaattacttaggtccttagtttctctcagcaatgttttgtaattttttagtgcagagtcataaataccttttattagatttcttcctattttataacttgacattaatgtaaatgaaatgttttaagaattctatttttcaatattttcagctagtatataagaatataaataattttgtaaaaatcttgcatcttgcagattatatattatttctagttgtaattctatagattccttgagatttttgtataaacaataaaatatctgagataggaacagttttacttcatcctttctgatccttttgccttatatttaactttttttaactttagtaaaatgtttaatagacttgatgaaagagtgaatcttcttcaccttgtcctccatctcaagggaaagtaattcagtttttcaccattaagtatgatattggctatgagtttttcataaataaccattatctacttgaggaatttcttactattcctaatttgctagctttttaaaaattatgaatgagcattaattttgtcaaattatttttctgccaatattaaaataatctttttttttttagaccaggggtaggcaaactttttttaaaggccagaataaatatgttcaggtttgcaacctaggaggcaaattcaaggatattatgtaggtatttatataaccatttaaaatgtaaccatttagaaatacaaaattattcctagcttgtaagcataataaaaaacaccaggagcctggccatttttggtctatagactacagcttgacagtgtctgttttgtactattaatacctattgtgatatttttatatagttggatttagatctgtcattttattatgcgttttctctttgtaccatgtttttgttgctctgttcctctctctgtctctctttcctgcctttttaggattatttgaatatgtttgtattgcatgtgaatgtatctcttagctatcagctattcttttgtattgtttttgtggttgctttatgtattacaatatatatacctaacctttcacagtctacttggagttattattgtaccacttgacatctaatgtagaaaccttggaaccatagaggtctctttgccacctcctacctttattttatagttgtgatatgggctatatctgtattcattgaaaacttcacagacactggtataattttagtgctaatgagctatacatatttaaagaacttaagaggaaagcacagtttttacattacccagataggaatcatttctattgcttatccttcatcttgaagttacaggtttcctcttgtatcatttttcttccatctgcagaacttccttcagcatttctggtagagcaggtataagataatgaattttcttaattttttttaaatctggaaatgtcattttgacttcattcttgaaggatattttcattgaacatagaattctaagttgacagttcttatccttgagcactctaaagatgctattctactgtcttatgaccttcatagtttctggtgagaaatttgtgataatttgaatcattgtttctatggatgtaaggtattttttcctagctgttttaagtatttcttctttattattggctttcaacagttggactatgatgtgtttggtcatggtttctttgaagttatcctctgtgtgatatgttgagattctagaatctatgacttctactaaatttggaaagtttttgtcccttatttcttcaaatatattttctgttttaatctttttctccttcccttctggaacctaaagctcacatttcttatgttatgcagtaccttctgcattttgttctgtttcctttttttccttaaccatctttcttatgacattatcctattttatacaagccatgttctattgtgatgcattaaagagttgagtttcatgaaattttgtgctgcaacatacaagtacacaaatttcataaatctgtgctgtctctgagtctactccagatgctatcttctccttgtttgtagttcttttttattggctccaggtggcatttttaattgtttcttatcctcaaacaaagcaagatctcacaagagtcagtgtcagtcaagagacgcaatgatgaatggagctggcccagtgtcctgtgcacagatctagtggccacattctttctcagatcagcagtggttaatgtgtggcactcccagccaaacttacggtttctagtggtggatactttcttctccccagactgtccggtcttctaattttcccaaaagttggaacatccggatcacatttctttttgtctcttccctagagtatgttaattttggagtctgggccttgcaagttgtgctgtagctttgcttcgagtctcacatatgcctgagttcaaggctggcctccaattatccatgttattttgagaaactcgcttaatctgtcttagagtcttctttggtaaattcaggccaataatgtctccattatacagtgaggtaatatgaagaaattctgaaataatgcaagtggagcatttatcctggagcagtgaagttcacggtaactcaaactgtggctgctgtggtctccagcctcagcaatatggccatccttagtgcattttgccaccaccaatctctaactctgtctaaaattttgggagatttacattcttaggaagtggtcctgcttctgggctggaaaatacaacaccttctgcaggaagtagggctctcagggttcagtagggtcagcactctggacttctgccttgtagtcaggggacagctgtctccatatccattttagagaaaaattagaagagatagatttgggttcaggtagccagatataattttaaatcagaatgcataccccatagccacatttttgagcagagaaagcattatgtacatctatcttctttagctatctttggtctttttgttttaaaatccaggttgacatctggcttttgttaagtgtggcactgccggagttctgattattcatatcctgtccacccactcctgcacatctcctctgtttggcctaacctctctctctcactatgatatttgttgagcaaaagagctttgagagaataaaattttctgaaaaataaggaaaaactgaaatatgtttatatttataggctttcactcatgtctatgtcatcattcttgtcatttttagactgatgtaccattctgtgaacagcaaatgtgtttacaaggtgcaaactgtgtgctcatctaacttagttaaattatctaaaatgaccaacctcttcagacatagacaaattattacttttccttgtcattttgttagtagattctatatagcatttttagaccactgcagtgttcaagataataatattcaataaattataaatcaattttctcctcgttgtagaaggaagctaattgtcagaggtaatatctattaagcttcctggattaaattcatttaaaatgtgttctgttagaaaatgtgataacactttatttttagtgaccattagctaatactaaattacagcataacgcctctggaagtgcatgtgacgtccatatgaataccaaatgaactcataattatctatactataataatgaatatcaaaccaatttataatgatatactgaaaatcaaatacttctgaaattttatgttctcatcaattttaaggacgagacatgaatctagcttgttagagcaattgctggcagtcaggaagctgcgctgtgcccagtctgcaattttgttttctggtatttctggcaccagcacaatgattccaaaaactgaaaaatgtaacaacagtatgctggggaggagcataggtattcaagaaagggggtgcgtgtttctaggtatgataatgagagatttttaaaggatagaatgaaatgactatcatgtttcaaaagaagttacaacacatatgtattagttcattactaagcaactgaagaatataatacaaaatgttcagttgattaatttggaaaagtatgccaccccaaagcaggcttggccaatgacttaggaagtaaagtcttctttttttatttcaaatataaagtcattttctaagttcccctcttgtattataaaagagtaattttattgggttcataggttgtctaacttgatgtaataattaatagttatttaatattaactgattgatatttaataaaaatattgtagtgattggggtgtaaggctgccattgcaaagatgagagagactagggagtgattaggacaagtaactgggtcagcttgacctagaggggatgaagccctacagaagctcaaaaggcagaaaggagttagaggtagaccactcccactaccaaaagaaataccatttgggatgagctttctagaatataaagttgtaacaagtagcagtttacgaggcatattttagacgaagaacatagcatgaacaaattcatggagacaaaatagtactgtatgcttctagaaaaacaatatctttttgattaagaaaatattttgtgggtttgtagagttcatgcctgtgatttatgggaaggaactacaaagagacagtatgggattcccaatgtccagggtccagatacgaagttgggtgttaatttccctggtactgagcaaaggagggagtgagtgccccaaaagagaaaaggatcaaaagttcttgttacgaatgatttgagccatgctccagaaaaacgtttctcgtagcaccatgcaaaatggaatagatctagttatagaaactagtagagttcccagctaagaggccagtacaattattagaggcaagtagcaacccatggtggcactgggaagaggaagaaaagatacagatgtaacagacaagggtctgtgatattgtcaggctgcgggttcaaaatgagagtccttccacaaagtactgttgtagttgaatgaatcaatattaattgaatgaaagcattgtgctgaattttactaaattaggtttgtatagaaaaatgtaacctcatgtatatgtattaccctagtgaatatgactcattaaaattcatttaaaatgataaacatttaaaatgtaaaatgtgttacatgatgtaagtagtacaaatagctgtataacagggtcaatatattaaatatatataagatttaaacatataactattttattaaaataatctgtgaatatctagatcttctaaaaagatgatctctctgccatgcccagagcacagtaggtccactgacccccatgtagtcttggccagagcggactcttccagtctcagctcttgatacttttccctcttcactcacaatctcatcattccgcttgccaagcattgatcttggcgcatagaaggtgttcactgttatttacagaatgaagagctaatgggaggaggaaagggaaaaagcaacaaaggaggaagggaggaaagaaaggaggaagtgagggaggaagggaatgagagaggaagagaggtgctctgtatctactatctttaggaccttgcacaattaattaaactccccgaagcctgaatgcttttgtctgacaaaagaaacaataggattgctatgaaaatttaaaaaatactgtattatggcatctgcactctattgggctgatagcagcagctggaagattgctccccatcgaatcacgccacagtttaccatagacacagcacctcccctcttcctctggtctattatgagaactctgtgatggcagagatttccatgggacttgagaagttatggatggatgagtgtaagggatgaaatcactactttttagttttttatttctagcattttccagtggatttttattaatccatctgcattcccttacctgatgactgggtatgcaatgtggaaaagaataatctaacacttcactgtataaaaattgtagcttggcctcctaagtacagttctctgagcaatcagctacataccaggtcactatcacatactagtaaataaggcactctgtcactttcagtagagtactactaatttggctatcaaaattgtgtttttaggcagctgaacagaaggtagagttcattagttcatgtttaaattagagcttgttttcattctagataatagggagaacaaatgctattatttttaaattctatggaaatgtgaaaataaatgctgttcatattatatctgcctaaggctttcataaaaacagttaatttccaaaataatgtatctattatattttatgtttatgaggataatttgaaatatatatttctactcagggacttttgaactaagcagtggaacaaactgcaataattagctgaactacaaaccaaacttgaatgttaatgtgtttttacataaacaaactcttgttacaaaatattgcttgagaaacttagaaaatttttttaactttgcagctaaatcagccagccttgtcacgtagacccaggagagacagagtggggagggaagaggcggccggatcctgcacaatctcatctcctgctagaagaccggggggagcagtgagggccgccaggtggtggggcagggcagtagggaaaatcctcttcatgattccctccaatatctgtggtcagtgtaagaaggaagtcagtactgaaagcctcactatatccttatccatcttggtttcctccggaggctgtctgatttgttttctggcttcctccatttctctgacctctgggggtgttttgcttcctcttcttgacacttttgttcatcaaaattatccagggaactttgaaacatggagatgcttgggctacaccgccagagaggctgactcttgctgtggggtaagacccaggcattggtgtctttgaaaagctccatgtgaaaagtaagcaaattcttccccctacccccatttacttttagttgacatgtaataattgtatacacttattggatacagagttatatttccacacgtgtatacaatgtgtaattattactgagacatgtgggaatcctgtttcttagtcttatttgggagaaagaagtctgccaagtgactgatttagccaaaaaagagaattaattgaaggaaaacagaaagcagagagtttatttagagacacagtacactttgaaagatgaggcagagcggactgctgaaagccagaggcccccctcaccccaagagttctgcattgggttttgatgacgttgaactgtttcctgaagttcgccgctgtcttaagtctctgccatttttccttgtctagttttctggctcctgccttaagtccccgctttttccacgtctagtccccactccaggcttgtgggaccctcccttactatgagttggtgcacatgtgtgggccggtgttggatatgaattgcacccggggtctcttaggaatttccgccttatcagcatgtaggttaactgcagagggagcagtgcctggggggtcttaaggattgctccttcctgcctatgttatttcccctccgccttgctcatatctagcatgcctgtttctggtggtccctggattgtgggatcctccagacctccctttcctcaggggctccccctcctgctcatgtctagctgtctgtctactctaacacagtgatcaaaccagagtaattagcatctccatcatctcagacatttatcattgccacgtgtaaggaacattcaaattcttttaccttttgtaaatataaaataaattattgtgaattcaccctgcagtgcagtggaacatattcctcctatgtagctataatttggtatcccttaagcagcccctccttatttccccccatccccaccagccttcccagcctctagtcaccacaattccactctctacttctatgagctcatttttttaactcctatgtatgaatgagaacatgtgatatttatctttctgtgcatgacttatttcccttagcataatgtcctccaggctcatccatgttgctgtgaataataggattttattctttttttatggctgaatagtatccagctgtgtatgtacaccacattttattcatctgctgatggacattcaggttgatttcatatcttggctactgtgaatatgctgcaataaatacagagatgcagatatcttttcagtatactgatttcctttcctttggttaaatacttagtagtggaatgccggatcatgtggtgattctatttttagtttttgagaagcctccataatggttttcataatggctgtactaatttgcatttcccacatccttgccagcatttgttatttttttacttattgatgatagacattctaaccagagggagatatctcactgtggtcttgatttgcatttccctgatgattagtgatgctgagcatttaaaaaatatacttgctggccatttgtatgcctttttcttcaggaatgtttattcagatcctttgcccattctaaaagtcagatgagtttattttcctattgatttgtttgagctccttgcatattctggtgttcgtcccttgtcagatgaatagtttgtaaatattttctcctattctgcagattgtctcttcactctattgactgcctctttagtttgataaagtcccatttgtctatttttatttttgtaatctgtacttttaaggttttaggcataaaatctttgctatgccaatttcttagagcattttccctatgttttcttctagtagttttatagtttcagtttttacatttaagtctttaatccactttgaattggcttttgtatgtggtgagagataggggtctagtttctttcttctgcatatggatatccagttttcccagcacagtttagtgaagagtgtgtcatttccccaatgtatgttcttggcatctttgttgaaaattagttgattgtaaatacatgggtttatttctgggctctctattatgatgttccatttgtttatgtgtctgttttcacaccaataccatgctgttttggtaaccataggcttataatatattttgaagtcaggtagtgtgatgtctccagctttatggttttgtttttattttcttttgttttgctcaggattacttttggctcttaggggacttttttggttccatataaattttatgattgattttgctagttctgtgaagaatgccattggtattttgatagagattacattgaatatgcagattactttgatttgtatgatcatttttacaacatgaattcatcccattcataagcatgagatatcttttctttttttgggggagtggggtcttcttcaatttcttccgccagtattttgtagttttcatcatagagatcattcaccttcctggttaaatttattcctaattatgttatttttgtataactattgtaaataggattactttcttggtttctttttcagttagtttgtttttaagtgtatagaaatactactgttgtttgtatgtggatttgcatcctgtgcctttactgatttcccttatcagttctatgaattttttggtagagttttaatgtttttctatatataagatcatgctctctgtaaagaggaacattttgatttcctcttttccaatttgaatgtcctttatttctttatcttgcgtaattgctctggctaggacttccagtactctattgaatagagtggtgaaagtgggcatccttgtcttgttccagcacttaatggaaaagatttctcttttttcctttcagaatgatgctaattgtggatctgacacatatagcctttattgtgctaaggtatattcctactataccccatttgttgagagtttttattgtgaagagatgtagaattttattaaatgcttttttttctgttgtccattgggatgataatacagtttttgtccttcattctgttgatttaatatatcacatttattgacttatggtattgaaacattcttgcaaatcgataccctaacatcacaactaaaagaactagagaagcaagagcaaacaaatccaaaagctagcagaagacaagaaataactaagatcacagtggaactgaaggagatagagatacgaaaagtccttcaaaaaaatcaatcaatccaggagctgggtttttgaaaataattaataaaatagatagactgctagctagactaataaagaggaaaagagagaagaatgaaatagacacaataaaaaataataaaggagatatcaccactgaccccacagaaatacccacaatcagagaacactataaacatctctatgcaaatacactagaaaatctagaagaaatggataaattcctggacacacataccctcccaagactaaaccaggaagaagtaggatccttgaatagaccaataacaagttctgaaattgaggcagtaataaatagcctaccaaccattaaaagtccaggaccagatggattcacagccaaattctgctagaggtacaaagaggagctggtaccattccttctgaaaatattccaaacaactgaaaaggagggacttctccctaactcattttatgaggccagtatcatcctgacataaaaccctggcagagacacaacaaaaaaagaaaacttcaggccaatatccctgatgaacgttactacaaaaatcttcaataaaatactggcaaactgaatccagcagtgcatcagaaagcttatctaccacgatcaagtgagcttcatgcctggaatgcaaggctggttcaacatagcaaatcagtaaacataatctatcacataaacagaaccagtgacaaaaactacagttatctcaatagatgcaaagtccttcaataaaattcaacatcctttcatgttaaaaactctcaataaactaggtgttgatagaacgtatctcaaaataataagagctatttatgacaaactcacagccaatgtcatactgaatggacaaaagctggaagcattccctttgaaaactggaacaagacaaggatgccttctctcaccactcctattcaatatagtattggaagttctggccagggaaagcaagagaaagaaatcaaggtattcaaataggaagagaggaaataaattgtctcttttagcagacgacatgatcctcctatatctagaaaaccccaccatctcagcccaaaagtgctaagctgatatgcaacttcagcaaagtctcaggatacaaaattaatgtgcaaaaatcacaagaatttctatacaccaacagtagacaagcagagagccaaatcatgaatgaactcccattcacaactgctatgaagagaataaaatacctaggaatacagctagcaagggatgtgaaggacctcttcaaggaggactacaagccactgctcaagaaaataagagaggacacaaacaaatgcaaatatattccatcctcatggataggaagaatcaatatcatgaaaatggccatactgcccaaagtaatttatagattcaatgctattctcataaaactaccattgacattcttcaaagtattagaaaaaaaactactttaaaattcatatggaaacaagagcccatatatccaagacaatcctaagcaaaaagaacaaagctggaggcatcacactacctgacttcaaactatactgcaaggctacattaaccaaaacaacatggcactggtaccaaagcagatgcatagaccactgaaacagaatagagatctcagaaataagaccacacatctacaaccatctgatgttcaacaaacctggcaaaaacaagccatggggaaaggattccctatttaacaagtgatgctgtgagagaactggctaaccatatgcggaaaactgaaactgggtcccttccttacacattatataaaaattaactcaagatggattaaagacctaaatgtaaaacccaaaaccacagaaaccctagaagaaaacctaggcaataccattcaggacataggcatgatcaaaggttttatgatgaaatcaccaaaagcaattgcaacaaaagcaaaaattagcaaatggaatctaattaaactaaagagcttctgcacagcaaaggaaactgtcatcagagcaaacaggcaacctgcagaatgggagaaaatttttgcaatctacccatctgacaaaggtctaatatgcggaatttacaaggaacttaaacaaatttacaagaaaaaacaaacaactccatcaaaaagtagacaaaggacatgaacagatgcttctcaaaagaagatgtttatgcagccaacaaacatgcaaaaaagctcaacatcactgatcattagagaaatgcaaatcaaaaccatgatgagataccatctccaccggtcaggatggcaattattaaaaagtcaggaaacaacagatgctggcgaggctgtggagaaatagaaacacttttatactgttggtgggaatgtaaattagttcaactattgtggaagacagtgtggcttttcctcaaggacctagaaccagaagtatcatttgacccagcaatcccattgctgggtatatacccaaaggaatataaataattatattataaagatacatgcaaatgtatgtttattgcagtactattcacaatagcaaagacatggaatcaacccaaatgcgcatcaatattagactggatcaagaaaatgtggtacatatacaccatggaatactatgcagccataaaaaagaatgagattacttcctctgcagggacatggatggagctggaagccatcatcctcagtaaactaacacagcaacagaaaaccaaacaccagatattctcactcatgagtcggagctgaacaatgagaacacatggaaatggggaggggaacaaaacacaccagggtcagaggagggagagcatcagggtaaatagctaatgcatgtggggcttaatacataggtattgggttgatacgtgcagcaaaccaccatggagcatgtttacccatgtaacaaacctgcacattctgcacatgtatcctagaacttaaaattaaaaaaagcaaagcaaacaaacaaacaaacaaacaaaaaaatgaaacattcttggatccctgggatgaatgaaactggatcgtggtgtactatctttttcatgtgctgttgaatttgatttgccagtattttgttgatgaatttattgatgaatttccctatgttcattgctaatattggcttgtagtttcctttatttgttgtctttgtctggttttggtatgagggtaatgctggcctcatagaatgtgtttgggagaattctctcctcttcagtttttcagaattgagaaaaatctgtgtttggtcttttttaaaagttcggtagaatttgtcagtaaatccatttgggctttttttgaggggagactttttattatggcttcaacctctttgttcatcattggtctgttaaggttttctagctcttcttggctcaattttggtaggttatatgtgccgagaaattcatccattttctctaggtgttccaatttgttggcatatagttgttcataatagtccctaatgatcctttgtatttctgtggtctcagttgttatgtctcctttttcatttctgatttaaatgtatgtgggtcttctctatttttttctagtctagctaatggtttttttcataattttaaaatattctccaaagaaactatttttaaattttttgtattgatacataatagatttgcatattttctgggtacatgtgataattcaatacattcatgtaatttgtaaagatctaatcagtgtgactgtgatatccatcaccttaaagatttgtcttttctttatgctagaaagatttgaattattctcttcttagctattttgaaatatgcaatagatcgttgtatgctatagtcaccctacagatctatcaaactccaggccttattcttctatcatattgtatatggctatatgtatgtatgtttttattttctccccctactccccactctttccaacctctggtaacaaccaatttgttttcttcttaataaggtccacttttttttttagctcctacatataagtgagaatgtatggtatttgtctttctgtgcatggcatatattacttaacataatgaccatgagttccatccatgttgctgcaaatgacaggatttcatccttttttatgctgaataatactccattgtgtatatatgctacattttctttatccagtcatccactgatggtcacttacgttgattccattgtttgcctattgtgaatagtgctccaataaacatgacaatacagatatctctttaatatattgattccctttcttctggataaatacccagcagaggaattgctggatcatacgggagttctatttttagtattttgaggaaccttcatacagtttttcttactggctgtactaatttacattccccccaacagtgtaaagagttccccgttcttgacattcccaccggcatccttaatttcctttttggtaaaaggcatttaactggggtaagatgtttcattgtggtttgaatttgcatttctctgattatacacccattggctatttgtaagtcttctttggagaaatgtctattggatcttctgcccatttttaaattgtattatttactttttgttattgagttgagtcccttataattctggttattaatcacttgtcagatagatagtttgtgaatattttctcccattctgtgggttatctcttcacttggttgattgtttccttgctgtgcaaaagctttctagcttgatataatcccatttgtccatttttgctttgatcgtctttgcttctgaggtcttacacaaaagatgcttacctagactcatgtcctggagcattttccccaatgatctctccgggtagtttcacagtttggggtcttaaatttaagcctctaatccatttttatttgatttttgtagatggtgagaggtaggggtctaatttcattcttctgcacacacatgtccagttttcctagtaccatgtattaaagagagtgttcttttcccattgtatgttcttggcaactttttcaaaaatgagttggctgtaaatgcatggatttatatctgggttctctattctgtttcattggtctatgtgtccatttttatgccagtaccatgctcatttggttgctatagcttcgtaatatatattgaatctagtagtgtgatgtctccagctttgttttgttttggggtattttctctgctcaagatttctttgggtattttgggtctttcatgattccatataatcttcaggatttaaaaaaatatatatttctgttaagaatgtcattggtattttgataaagattgcattgaatttgtatgttgctttgggtggtaactttaacaaaattagttattccaatccatgagcatggagtatctttttatttttttctggtctctccaagtccttttatcagtgttttatagtttcccttgtatagatctttcactccttggttaaattgattcctagatattttatattctttgtaacttttgtagatgggattactttcttgatttctttttcagattgattgcttttgacatatataattatgactgatttttgtatgttgattttgtatcctgcaactctactgaatttgtttattagttctaatggtttttttgcagtaaatctttaggcttttctatatataatatgatatctttgaacaagactaatttgacttcttcctttccaatttggatgccctttgtttatttctcttacctaattgctgtagccaggacttccattattacattgaataaaagtagtaaaagtgggcatccttttcttgttccatatcgtagaggaaaggctttcaattttccctgttcagtattatattagctgtgagtctttcatatgtggcctttgttatttttaagtttatttttctataccagtgtgttgaaagtttttatcataaaggaatcttgaattttgtcaaatgctttttcagtatctacatggtttttttcttggtactgttaatatgatgtatcacatttattgagttgtatatgtggaaacctccttgcatccctgggatgcatgccacttgatcatggtgtattatctttttgaagtgcttttggattcagtttgctagtattttgttgataattttttcatatacgttcttcagtgatatgggcctatagttttctttttttgttgtgtccttgtctgattttggtatcagagtaatgctagccttacagagtttgcaagtattctttcttctacaaaaaatttttgaagagtttctgtttaattgttttaaccaatttttgattgaattgttttcttattgatttatgagagttctttttatatatctggattcaacttctttatcagatgtatgctttgcaaatattttcttccagcacacaagttgtctttttgttctcttaacagtgcctttcaaagaaaagatatttttaaaatgtttacgaggtccagttttatcaatttattctttcatggatcatgcttttgatgtcatatataaaaaaaaatttgcctaacccaaggtcacaaaattttttcctaggttttcttctagaagttttatagttttatgttttacatttaggtccatgatagtttgagttaaattttgtttatgccatgagatatggatcaatttttgcagttgatatgatatgcagttgtttcagcaccatttgttgaaaagattatccttcttccattggattgcctttgtacttttgtgaaaaatcagttgtctccaaggatatacagaaagcaaataaacatatgccaaataccacatgattagttcattaggaatgaaaattaaaataacagtgataccactacacacctattagagtggctacaatgaaaaagacttattatgtcatgtgttggtgaggatgtagaggaattggagcattcatccactgttgatgggaatgtaaaatggtacaaccaatttagagaacagtttgccagtttctcaaaaagtcaaagatacaaatgccatatgtagagccatttcacttctaggcatttatccagaaggaaagaaaatgtatgttcatacaatgacttcgacatgaatgttgataagggctttatatgtaaataccctaaactggaaataacccaaatgttcacctacagttcttgggtaagcaaatgatgatgtacgcatactacagactactactactcagcaataaaaagaaatgaattactgacacacttaacagcatggatgcatctaaaaaaagtaatgttgaataaaagaaaccaaacaaaaaggagtacgtactttatgtttccatttatataaaactctagaaaatatacgtttattacatttatagtgacagaaagcatggggtgggagaggtaagagaggaatcgtaaagaagcatgagaaaacttttggggttgatgggtatgttcttcactgaagtgatagtgtttcatgggtgtacacatctgtcaaaacttatcaaattgtatactttaatagtacatttttcaatattaattttacttcaataaagcttctaaaaacacacaatttttttttgaagagtttgagtataattggttttagttctttaaacatttggtagaatttagcagtgaagcaactgggtcctgggcttttccttgataggagacttttcattatagcttcaattttgttacttactattggtttcttgaaattttccatttcttcatggtttaatcttagtagattttatgtgtccagaagcttatcatttttttctaggtttctaatttgtagttgtatagttgtttataataatctctaattatttgtatgtctctgatcatatttgttaagtgtccttttcatttctaattttacttatttggctcttctctctttttttctttgtctagctaaaggtttgccaattttgcttatctttaaaaaacagccttttacatcttcagatttctaaaatatttttgtctttgtttatttctgctctcatctttataaacgttctaaaaattttgggtttagctttttttttcttgcttttctaattctctgagatacatcattaggttgtttatttgaattctacttttgatttaggtgtttattgctgtaaactttcctctgtgtacagagtttcctgtatctcatatgatttggtatatgtttagtgtttttattttcactagtttcaagactttttaatatttacttcttaatttcttcatagacccatttgtcattcagaagcatgttgtttactctccgtacatttgtattttcaaagttcttattatttctggttttattacattgtgatgtgagaaaacaataggactttcatttcttgaaatgtgttgagacttgttttgtggcctaatatatggtttatcctggagaatgtttcatgtgctgatgagaagaatgtgtatattacagttgatgaaatgtcttgtctcttaggtacatttgctctgtagtgcagtttaagtccagtgtttcttggtgaattttctgtctagatgatttttccaaacctaaaagtggggtattgaagtccccagcttttattgtactgaggtttatctgtctctctttagctaatatttgcattacatttgtgggtgttttggtgttgtgagcataaatatttacaattgttagattatcttgctaaatttatcattttatcagtatataatgactttctgtatctttttttttttttttttttttttacttaaagtctgttttgtttgatataattacactactcctgcacactcttggtttccatttgtgtggaatattttcttccatttgtcttagtccatttagagttgctttaaagaaatatccaaggctgggtaattttggggaaaaaaaaggttcgtttagttcatggttctactagaaagttcaggattggatttctggcaagggcctcaggctactttcatcatggtggaaggcaaaggtgaacatgtgtgtgcagagattacatagtgagaggggaaacaagagagagggaagggaggtgctaagctgtttttaacaaccagccttcacataaacgaataagaatgagaactcacaactgggcgcggtggctcacgcctgtaatcccagcagtttgggaggctgaggtgggcagattacctgatgtcaggagttcaagaccagcctggctaacatggtgaaacccagtctctactaaaaatacaaaagatagccaggcatggtggcacactcctgtaatcgcagctactcggggggctgaggcaggagaattgcttgagctgggaggcggaggttgcagtgagccgagatcatgccactgcactccagcctggccaacacagcgagactgtctcaaaaaaaaaaaataaataaatgaaaaaaagagaatgagaactcacttccctggttgggagggcgggcgttaaactcttcatgagggatctgcacccatggctcaaacaccttccattaggccccacctttaaaattggggatcaaatttatacttgaggttcagggtgacaaatatccaaactatagcaccagcccttctctttcagaaagtctgtttccttgtaggtgaaatttcttttcagcaggatatagttgtttcactgtgtttgttttgttttatttatcatgtagccagtctatatcttttaggtggggaatttaaaccctttacattcaaagttgttattgtattcattttgctaattgttttctgattattttgtatatcctttgtttctttcttcctcttttattgtttatcttttcagtcttgtggttttctgtagtgttaatgtttggctcctatctctttctcatttgtgtattgtggcagaatatgaaactctgccaatgagttttatattttcatgtgttttcatgatggtagatatcatcctttcactcacacatgcagggttcccttaaacatttcttgtagcactagtctagtggtgatgaatttccctcagtttttgcttgtctgggaaagattttatttttcatttatttatgaaggatagctttgctgggtataacattcttggctgatagttgttgttttttctttcagtactttgaagatatcatcctgttctctccaggcctgtatggtttctgttgagaaatctgctattagtctgatggggattctcttgtatgtgattggatgcttttctcttgctgttttcataattttctcattgtctttgacttttgatagtttaactataacttgccttagagaggaccgttttgggttgaatctatttggggatttgaacttcctgtatctatatgtctaaatatctttctagacttgggaaattttcagctattatttcgttaaataaattatctaggactttttctatttattgttcttctggaactcccaaaatgcaaaacttttttcacttcgtggtgtagtgatgtcccatgtgtcggataggctctcttcattctgttttattctttttttttttttttttgactacgtaattttaaagacctgtctttgagttgagaaattctttttattcctgcttgatgtagtctgttgttgaagttctcaattgtatttttttttatttccctcattatatgtttcagttacaagatttttgtttggttcttttatatgctatttcttttttaaaatttctcatttggataatgaattattttcctgatttatttcttctgtaacctgttgagttttcttaagatcattattttggatttcttttcaggcatttcatagattttcttttcttttcactgttactggagaattattgtgttcctttggaagtgtcatgttttcttgtttttcatgtttcttgtgaacaggaacatttctttctgagaaattagagatcattgaaaattgcaagatagtataacttaatgtttgttatcatatattgaatattaccaaatttaaacttcaagttcaaagactactgggagcaaaatgaaacatacttcaacattactgttcttcaaaatcaagccatcaccagtgctgtattagtctattttcatgctgctgatgaagacatacccaagactgggcaatttacaaaagaaagaggtttaatggacttacagctccacatgcctaggaaagcctcacaatcatggcagaaggcaaaaggcacttcttacatgacagctgcaagagagagaatgagagtcaagctaaaggggtttccccttataaaaccatcagatcttgtgagacttattcactaccatgaaaacagtatgagggaaaccacccccatgattcaattgtctcccatcaggtccctcccacaacacatgggaatcatgggagctacaattcaagatgagatctgggtggggacacagcgaaactctatcgagtgctcacacatgcagaagaattgcatagacttgccataagtagaatctcaagctcaattttgtttataaatgtattaacttaaacaatctttgctattcactcaacatgatatgtttttggtaaggcttagtgtgtctcaaagctattaatatagtgatatagccaattccattgagcaagcattgccttgcagtgcctaaaaatatactcagaattggtagtgagaggacattctgatactgaatcttgccaaacacactatattgcagaaaatgttactatattatccaaaaggtaaatgatcccttgccaatttattgtttccattataattttatattttaattacttaatattatatattgctttgttaagcatgcattctaaatattgcttctgttgttaatagactgctttaacaattatcatggtattaaataaaaagcaaataattcatttgaaaagtatatatctgtaattgttcagaatttttttttttttagtttggcttatagagagacccatttactttcatggtcttactaagatgtgcatttctaaaatattttagaaatcatgcatctatacaactgggttaagcattcaatagagagaggtcaaggccatcttttcagtttctgacttaaataagagaagcatttgaaaaaggatacttttctcatgagaacgagataaatgagttgaatttgaaatacactgagtttgaaagtgccagagtagaaaaggaataagttgatttgaagttcaaaagaaaggtctagactgatgtcatttgtcagaataactgaaaaggcatgggtggagcttagacaatcctgatgaaccttgaagagcagcactgttcaatagaaatataatatgaatcacgtattattttatattcttctagtagccacattttaaaaagtaaaataaaattggtaaaattaactttaatgaattaacctgatatattttaaatatcatcttaacatgtggtatcagccacatttcaaacacaaccacaggtagctgctggctgctgtgctagacagtgcaggtgtagagagagaagggagtgctaagaacaaaacctgtgggatcccaacactgaaagaatgcgggaggatgcagaagaccctcacatggaggccaagagacacctatctagatctcagcttgtccacaggcggtgagcagcatcttcacatctatgtctcgggtgttactttctagatgggtgacacttgcagggtgaattaggagatctctcattctgtcagtgacgtagacctccctccccaaaccagtttccattgtaagtatggtcgtatttgccctaggttacaaattagccagagcccttgtaatgtaaggcttgtgggtatatttaccaaccacatcttaatcaaaatagtgtaatgtggtagcatccctgtaacaatattaaccatttagtaacatattctgttgtctcggttggaccaaaacttcaaatctaggaagtgaaaatttgagaaaagtataaaacaacaataccactcccttgcttagtgctttggggtttatttgcagtcattttttaatttttttttttattttcataggttattggggcaaaggtggtatttggtcacaagagtaagttctttagtggtgatttgtgagattttggtgcacccattacccaagtagtatacattgcacacagtttatagacttttatccctcacccccttcccatccttttcccctgtgtccccaaggtccattgtgtcattcttatgcatttgcatcctcatagcttagctcctacttatgaatgagaacacacaatgtttggttttccattcctgagttacttcacatagaataatagtctccaatctcatctaggttgctgtgaatgccattaattcattccttttttatggatgaatagtattccattgtaaatatataccacagtttctttatccactcgttgattgatgggcatttgggttggttccatgtttttgcaattgggaattgtgctgctataaacatgcatgtgcaagtatctttttcgtataatgacttcttttcctctgggtagatacccagtagtgggattgctggatcaaatggtagttctacttttagctctttaaggaactgccacactgttttccagagtggctgtactagtttacactcccaccagtagtgggattgctggatcaaatggtagttctacttttagctctttaaggaactgccacactgttttccagagtggctgtactagtttacactcccaccagcagtgtagaagtgttccctgttcactgcatccatcccaacatctattattttttaatttttttgattatggccattcttgcaggagtaaggtggcattgcattgtggttttgatttgcatttccctgatcattagtgatgctgagcattttttcatatgtttgtttgccatttgtatgtctttttttgagaattgtctattcatgtacttagctcactttttattggaattgtttggttttttcttgctaattcatttgagttctttgtagattctgtatattagtcttttgtcagatgtatagattgtgaggattttctcccactctgtgggttgtctatttactctgctgactgttccttttgccgtgcaaaagctctttagtttaattaagtaccagttaggcaatagtcaccaagcagcatggtactggtataaaaatgggcacatagaccaatggaacagaatagagaacccagaaataaatctgaatacttacagccaactgatcttcaaaaaagcaaacaaaagcataaagtggggaaaggactccctattcaacaaatgataattgcccagccacatgtagtagaatgaaactggattcttacctctcaccttatgcaaaaatcaactcaagatggatcaaggacttaaatctaagacctgaaactataaaaaacctagaagataacattggaaaaacccttctgacattgacctaagcaaggatttcatgaccaagagcccaaaagcaaatgcaataaaaacaaagataaatagctgagacttaattaaactaaagagctattgcagccatttacatccagtatctcatttgggcccagagccaacctgatgaggactcaaagattatttcaagggagggaaaagcacaggtaatgaggctttcttctttttggtgtttttctttattccttactcttcttgctcttctctacttctttcatctcatctctcctatcttttttcctcctttctcctattctttgttctccttattccttttccattaattttacatctcctgtatttgacgtgtgtgtgtgtgtgtgtgtgtgtgtcacttagctgattctagcatgttctggtaatgaatgttttctatctgttatattgttgaacactgcctttggtgctgggcttttattttacttcgatttaagcaatattttaaattcataatttcatttaagttgctaatttgcaaaatttatttagcgcctgctgtcagtctttttcttaaattaagaaccatacagtaaattagttcatactggtaattatattttctaaaattattgaagcaaatcaaacccagaatgtcaaagtattttctcaaatgaagctaagccaaacccattatttaagtttgttgctaattctaactgcaaataaacactcagtataatagatttctatactttttctggatcatggatcaggagccatggactattatagtcataaagaaacatcaagagcaactttttcaaatatctcattttatagatattcatgctaacgctcagaggggtgccctgatatgctcaagatcaggcaacaaatgagaagtagaggcaggtttagaagaaaaacttaagagagaactcaaacttactgccctacactctgttctaggcaaggcagagattgaggcccctcttctccttggctctctgacttctattttgtttcctgctctttatatctgactgtcattagtgggtggttctctatgttctctctctccctctctctctctctcctgcccatttctcctatctctctctgtctgtctgtctgtatgtgtcttctttctcttcttcctttctgtgtgtgatgttttatctctgtgtgtctcttttatctctctctgtcctctctatttgagtccagaataaagcaaaaggagtaagtggaatgtttccctatgaatcagatggcagcagaaagggatttgtttttcacaagacttgaaagtcccacgtgaagctctcccgctctgctccgtgcctggaccggctgctgctgtcagcaggccttgtttctcaccagcagcaggggcaagtgacagttgctttttctgcttcgggtttgattttgtgggcattttatcattggaggggtgaaatgttatgaaggaagatgacaacaacagttttttgtcatattggcaaacagggtcattactgtacattcgtaaccttagagaaatgagtttttactggactatcagaaactacagcacaggatataatgaatgtatcagagctcagaatttgtttttaaatgaaattacgtggaaaaatgtaccaatccttaatgaatgtaatcactgtgtttttcttcctggcatgtgtgtttgtgtgtgtgcgcgtgtgtgtttgtatatgtgtgtgtttgtgcatgtgtgtgtgtgtgtgtgtttgtgtgtgtgatcatgcatacacacaatccagtatcttccaccgggtgtccccacggcttctagcctttggggttaccctcttctctaatattaaagagaaactcaagccctcatcccacggactgtgagagattgggtggcttgttttcctccttcttctctccagtagtcccaaggatttttaggaggttatttcatttcttctggctcccgccctgtgactccctgttctgttggattctcagtccttcctttgcgtcttgtatccagcacatgacgttcccttccacgtgtgccacatgctgccctggattctttcatgtcccaaagtactgcgagtgcaaggtcctgcacgccacaaaatttcactggaggtttggggacaggcctggcgagttaagcacatcacagtgaaaggaaatcagatcagagtaaaatgaaatcttagacagcaatgccttcacaattcacctgcattttcctggcaggaggagtttctgggtgattttactgtcattgttgctgttggttttgcctgctatgcctcctttaagcctcgctgattattccacactctccccatgcactttctttttttatgttaattagctttatttaatcatgctacattgtatgcatatttcaagacattgtaccccataaatacatacaattataatttgttaattaaaaacttaaaaagaaatttaaaatgtagtggctgaaaagaataaacagaaatcaaataaccatgttagagattattgttaaactccataaaagttatcagtttgaactttaaaagaaaaaaagccagttgctttcattactagtttgagctttgctctacccagctgtaaaaattcctccctttctataataaatgtccactcaccctctcactagctgccagattcaaatcccaagctgctattcttttccatgtcaagcacttgagctattcaacccttacctcagagtagaatctaagccacctttgcagaaccaaaattgaagctttgctaaataaacagtctaaaactccctgtctaacctttcgcaccaaaagaaacctctatggaattttgaaatcatagtttctttaacatgatcaaaatcttaggcaagtttctttaatcagggttagagtagagctattctctccacatactgaataagacctaggggagggaggattatttttcagtttgtgaaaattatcactggtattgctttcaatatgacttcctgtccccctctcttcttcagggactcaaataacaaagtttattagacctttctttctgtttcatgcatctcctactatgtttacttttcattctatttttttttctctgcatttacctgggtattttgtactgacacttcatccagttctttattcccctattcagtgtggataaccagctcccaaacctatatattaaatccctaatttcaaaatattatagtgtttttccattctagaatttctatttgattctttctgtatgttccagttctttggaactggacggaaactcttcacattttcctctttttgaacatatttgtcataattaaagcccatatgttataatgatacctcattcacctgttgattactctgaattatttttttcttgggtttcagtcatttggttttggcttctggcatgacttgtaatatttgattgattcagtgccagaaatcgtatatggagggggcttcaagatagctaactggaggtatctggtacttgcctcctccacaaagaagaaccaaaatagtgagtagataatcaaactttgaatagattatctaagaaagacactggaattcaacaaagaagtgacaggaaacacctaaggcaaaaaaggagagagaagcaaggcagccagctcagctgggattggccaggagcccagagaggctcccagtgcagggaaagggtaagtgagagacccccagctgaccacattcccaccatggacttctgcaatcctagtgactcaacccctgcaggctctgagactaacatggggagctgcctggaaactctgtgaccgcattgctcgagagaagctcatgctggctcccacacacacccttatgtcttaagtggctacaacaaagtgccactttgagagcccagcccccagcagaatgcatcctgttctggggacccatggccccacatctttacatccctgaggcccattgatatcccccatccatagctgccatcgctgctggctgctgttaccagggccaaagcaccagcccttggcagcactctcaccaccagcagcagtgggctgttgtgcatttataagtgccctgaggacaaggtaccctgcctgccaccaccaccaggctgaagtgcacactccccagctgcctgcgtatggctgctgccactgaaaaagcaaccctgctctcctcagtagcagggccgcagtgcagccgctggttccccaacccaggcatttcactgggggcctggggatcaccctgtcactgcctaccacagccagtgcctgcaggcaccacttggggagcctgaggacagactcacttagcctggctccaccacctccagtgcctgagctcgccgtctgggtacctgaggattctcctgccctgtgcaccataggcacctgagcatctctcccagggacctaaggacaggcttacccaacctgccactaccaccacagctggcacccacctacatgtgctaccacctgtgggcctgaggactggcccacccagctcattgcagccgccacagaccccagcatggaccacttggaaaccagaggattgtcatgctgctactactgccattgctcacaccacacctgccatccaggtgcctgaggacccacccacctgcccagcccacagctggcaccggagaaagccacctggaggcccaagaatatgcctgcctggtcctgctagcgctagtaccagcatagcctaccctgaggctgaaggatgggtattcttggcccgtcactgccaccactggggcctgtggactggcctacctgtcctccttatctcagcaaaacttcaccatagcttctagtaataactaccgtaagccactgaggaaattacagataccactgatgctgtttacagccaaataaatcatagagaaactatactactgcatatatccagaatcaaagccaaagtgcactaccaaaccaacatcataggtacatcttgaggaaaaaatccttccttagcaagaaaattcaaacaactggagaagtgactgttgtgtcagatgtgcacatatcaatgtaaggacacaagaaacataaaaaagtggggaactatgacacctcaaaagaaatacaataattttctagcaacacattccaaagaaaacaaaatttatgaaatcctgggaaaagaatttaaaatagttatttgaaaggaattctgtgagatgtgaaagaaaacagataaataatacatataaatcagaaaagcaattcaggatatgaataagatgtttaccaaagagatagatattataaaaagcatcaaacagaaattctggaactgaacaatttattgaatgaaattttaaaatatgtttgaaagctttaacagtagactagatcaaacagaagaaacaatttcaaaatcgggagacaggtcttttgagataacccagtcagacaaaaaaaaggaaaaaggattaaaaaaatgaacaaggactttctgacatataagacaccataaagtgtccaaatatttgaaattttggtgtaccagaaggtgaagaaaaaaacaaacaaaaaaagggatagaaaacttatttagccaaataatagctgaaaacctcccaagtttagaaagatatttagacatacagatgaaggacatttactgatccccaaatagaaagtgtaaaacctatgggtaaaaataaatagaagactgaaatgttaccactacagaaagccaccaaacaacaatgctaaacattaacagagaaaaaaaaagatatagaaaacaagcagaaatcaattaataaagtgacagcaataagccttcacatatcaatgataaccttgaatgtaaactgattaaacttttcacttaaaagttatagactgactgaatggataaaatacataacccaactgtatgttgcctacaagaaactaatctcacctgtaaagacacatatagactgccagtaagtgatggaaaaaaatattccatgcaaatggaaaccaaaaacgggcagaagtagctatacttatatcagataaaataagctttaaataaaaaacagcaaaaaatgaaggttattatataataataaagggatcaattcaacaagaggggtaacaattttaaacatatgtgcacccaccaacagaacactcagatatgtaaagcaagtattagttttaaagggagagttagagtccagtacaataatagttgagggtttcaacaccccagtctcagcattagacaaattgtatagacagaaaatcaacagagaaacattgaatttaaactgcagtttagaccaaaaggacctttggtatttatagaatatttgaactgacagctgcagaatacacattcttctcatcagcacatggaacattctccaggatagttcatatgttaaacctcaaaacaagtctcaacaaattttttaaaaattgaaatcatgtcaagtattttcttagaccacaatgaaatcaaactagaaatcagtaatgatgaactagaaatcaataacaatggaaactcttcaaacacatggaaattaaacaacatgttcctgaatgaccactgggtcatggaagaagttaaggaggaaattaaaaaatatcttgaaacaaatgaaagtcaaaatgcaacataccaaaagctatgggatacagcaaaagcactgttcaaaggaaagtttatagtgataaatgcctgtgtcaaaaaaatagatttcaagtaaacaatctaatgatgtatctcaaggaaatagaaagtcaagaacaagccaaaccccaaactagtagaaggaaagaaataataaaggccagagcagaactaaataaaatagagacaaaaaaaggatcatcaaaacattgttttaaagatcaacaaaatcaataaaccactagctagagtaaccaaggaaaaaaaaatgaaaagaaaacctcaaataaaatcagaaatgaaaatggagacattacaactgataaccaccaaaatgcaaaagatcatcagaaactattatgaacaattatacacttacaaactggaaaacctagaggaaatagaaaaattcctggacacatacaggctacaaaaattgaatcagaaagaaatacaaaacctgaacagactggtaataagattagattgaaacagtaaaaaaaagtctcccaacaaagcaaagttctgcacctgaggctttactgccaaattctacaaaatttacaaagaagaactaacaccaattctcaaactattccaaaaaatcaaagaggagagaattctcattaactcattctaagaagccagcattacgtttattccaaaaccagtcaaagatggaacaaaaaagaaaactacagaccggatgaacatagacacaaaaatccccaacaaaatactagcaaaccaaattcaactgcatatcaaaaagataatataccatatcaagtgggatttatcccggggatgaaaggatggttcaacatatgcaaatcaataaacatgatacatcaaatcaacagagtgaaggacaaaaaccatatgatcatctcaatagatgtagaagaagcattggataaaattcaacaactttttatgttaaaaatttctgggaaagtaggcatagaaggaacataccttaaaataataaaggccatatatgacaaacacacagctaacatcatactaaatgggcaaaagctggaagcattccccttgagaacaggacaaggataccactctcaccactcctattcaacatgctactgaaagtcgtagccagatcgtcaggcaagagaaagaaataaaagacatccaaatgggagaagaagccaaatcatccctctttccagatgacatgtatgtgtgtgggtgtgtatgtatatctatatataatatagatatataaacatatatcatatataatctatatataaccatatataatcatacatataatcatataatatatataatcatatataatacatataatcatatatataatgattacatatatataatgtaatcatatataatcatatatataatcatatataatatataatcatatataatcatacataaaatcatatatataaaatatatataatcatatatataatcatatataatatatatataatcatatatatactcatatatatataatctatatatataatcatatatatactcatatataatcatatatatataatcatatatatatactcatatataatcatatatataatcatatatatatataatcatatatatatatatatatatatatatatatatatatacacccaaagattccaccaaaaatctcctagatctgataataaattcagtaaagttgcaggatacaaaatcaacatgcaaacatcagcagtgtttccattcaccaataataaactaactgagaaagaaatcaagaaggtaatccatttacaatagctacaaaaataaataaataaaatctagagataaatttaaccaaggaggtgaaacacctctacaaagaaaactacataacactgatttaaaaaattaaagaggacacaaacaaaggtcacccatgctcatggattggaataattaatattgttaaaatgaccttattacccaaagcaatctacaaattgaatgaaatccctatcaaaataccaatgtcatttttcacagaaagaaaatataattataaaatgtgtatggaactgaaaaagagcctgaatagccgaagcaatcctgagcaaaaagaaccaagctggaggcatcacactacctgacttcaaaataaactacaaagctttagtaaccagaacaggatggtattgatataaacacagactcatagaccagtggaacagaatagagaatgcagaaataaatctatgtgtttacaaccagatgatttttgacataggtgccaacaacatacatagggggaaaacacactcctcatcaaattgtgctgggaaaactggatccgtgttcagaagaacgaaactagacccttatttctcaccatatataaaaaccaatccagaatgaattgaacacttaaatgtaagacctgaaactaaaaactagaagaaaacagaaggggcaatgcttcaggagattggtctaggaaacgattttatggctaagaccttaaaaccataggcaaaaaaccaaaaatagacaaattggactatatcaaactaaaaccttctacacagcaaaggacacaatcaacagaatgaagagacagccttaaaaatgagagaaaatatttgcaaactattcatctgacaaagaactaatatttagaacatgcaagaaactcacaagtcaacagcaaaaaaccctaataatccaattttaaaatgggcaaaaaatccaaatgaacattcctcaaaaaaggacaaacaaatggccaagaagtatataaaaatgctcaacgtcactaagtattggggaaatgcaaatcaaaaccacaataaaaatatcatcttactccagtgaaaaagaccattatcaaaatgtcaaaaaataaatgccggtgagcatgtgggaatgtaaattattatagccagtatggaaaacagtatggaaatgactcaaaattttaaaaacagaactgccatatgatatggcaattttactactcggtgtttatccaaaaaaaaggaaatcagtatatcaaaaagatatctgcaccccatctttattgcagcactactcacaacagctatgaatcagcctaattattcctcagtatatgaatgcattttaaaaatgtagtacatatacatggaatacagtggaatactattcagccttaaaaaaattgaaatcatgtcatttgcagcaacatggaggactaggaggtcattatgttaagtgaaataagccagtcacagaaaaattaatagtgcatgttctccctcatatgtgggagcttaaaaaatgttggttttatggaggtaaagagtagaattatagataccagagactgggaaggatgtgcaggtagttgggcaggaatgaaggggttgtttaatgggtctgtacaattacacaggaagaatacagtgtaatgttcaatagcagagtagggtgactatagttaataacggtgtattgtatatctcaaaggagctagaagggagcagttgaaatactctcaactcatagaaatgatgtatctctgaggtgctagatactataaataccctagcttgatcacaagtgcctgataaataggtacacatattatgtgtcaagttttaaaaagaaaataaataaactgtgtatgaaaaaatttaatgacattttatttccccagtgatacatacttttgagtgaaaaatagagtgagggcagaaactaagtcagattcttggaggctgtgatttaagttttgtgagggtttgttgtatttccaatttctcttactcctagggcccagctctgaagagggctgaactggcaggtgtttaccaggtactaaaatgtcttaatttctgcttagatttttagccttttaacagatgctgtctgcatggtttctgggcctctctcctaggatgtggaactgaaagactggcaaatgtctctaagggaaattgcattagatgaaacataaaaactctgagcaactttgatcctgaaagaagttttgattttgcaatggtacatattttacacctgtttttaaataatttttagtgttttttaaaaaattaagaaatcacattatgaatccttgtgaaaaaaattatctttttctaagtttttgtttccattttttctttgaacattttgatttttatgtattaacttttactgatatgatgcagtaattattaaaagtagtcgaacaggctgggcacggtggctcacgcctataatcccagcactttgggaggccgagacgggtggatcgtgaggtcaggagatcgagaccatcctgactaacacggtgaaaccccgtctctactaaaaatacaaaaaagaaaaaaaaaattagccgggcgtggtggcgagcgcctgtattcccagctacttgggaggctgaggcaggagaatggcatgaacccgggaggcggagcttgcagtgagccaagatcatgccactgcactccagcctgggctacagagcaagactccatctcaataaataaataaataaattaattaataataaaagtagttgaacagatcatattttgtacagtgaatttcatgccttctcatctccaaattaaaatatggttttggatatacgttcatgattcaaaatttgtttcagtatttaaagcatattaatcctttcaagtctatttttcttggtaaatgaattaaaggaaaaaatactacaaatatctaattgttcctgaattcaatacaaactgatattttaaacttgtaaaatgtatatgggaaaaattcaatataaacattgaaaaagctctttcagtgtagaaagggctaatagttaaaaagaaaagcctagacagagtggacaagataaaccagttgatgaaaataagcttgttctagcacttagtgaaacaagtgaacaaagattggggactgcagtacagcttttaattaatataaaaaatttaaaacagacggagtgtttaatttgtctctgaatatgagatgaaggattttaccctcttcaggtgaaattgaatcttgtatgtaacacagatggtttgtgggtgtgtattttccctgtaagttgggtattatttgtttcatgaatgaaagttccctgaaaaggaagtaggaggaaagcaactttgttccagtgaacagtttgcaaactggggagacacagcttttgttgtaatgcaatgatgttctacagaataaagaaagggtttgggctttatagcaaaagttccctcccaggttttctatcaagtctatttatgcaaatgaaagattgaaactcgcttagttcttattggtcagcacagctgagctatgactgatcaatatagctgagccctgattggttgatacagctgagcccagattgacacaggcaggaaggctctgattgattggcctccaagccccaaaccagaattctctgtcagatatttctttcaaacagcagttggcggggagggattctcagccacagtctgttttatcaccaaacataggaactggtttggcttcattgtagaaagggaggtcctgtgatacgtccacaacatctttctgagaacagagtacctgaccactccctctcacagctattgctgcctgtttctgtatttactttgagcacctcagttggccatgcagagtctgttttgtctttcagctgggggcatactttaacggtttatgttttaatttctttttattttaaagatttcatcagttacagggtgcaaacattccagggatggcaattcagtatttctttcagctgatggttttttaaaagggccagtctgttcagttttttgctctcgttgtagtcttactggggaggggagcactagcaagagagctgggagcttcctctagcagccaacatagctttcctggtcttaacccatcagctttgcttgtgcctccaagaattcccttctgctttccaggtttctgctgctgaatcttaggagagaaatgctctgtgcatttctcaagcacagaaatgagatttgtccttaaacaaaaatgtcaatagttcctacgtagctgaaactgaaatgacaggggtaatgatcctttatctctacctctccgtcatgaaagagagagactcatcttctagtaaattagctcttccctccgtttattgtaagaaattatttatttagttgctaacccagtctcttcttataagacagtgctaaaggaaaaatggaactttaaaaacattacacagcacactattgtaggtcatgaaatagtctgaacctatttacatctagtttttttgcctttcagcagctaggtattaaaacttaggaaccccttgttgtatatagattactaaattttcatattataaccctttcctctttaatgtaaaatagcctaaaagaatcttccatcagaaaccacttcaacaaaacctaaggaattgggtggttcaatagataaatagtactgttccacagggagtgaggttcacgtccagcctcaagtctaaattaaatgagcttgatcgtatctcttcagtctcttgtgagcagcagtccagaatactgaactgtatgaataattccacagtttggcgtgattgatagtcttggctcaggagagtcccagaattgaactaacaaccacactaaattgtatcacatctttaaaggagatagccctgtttagtgagggctcagttacacgaaagggccatgggaagtagcatgcatcatccttagtctgggaagaggtagagaatggcttccagctctgctcctgggctcataattgaatcaggttttgcagctcaaatggcaccaaatgatttattttcttctcttgggctacctctagcttcgacgtttttgcatgtgatatggttttatatctactgataaatatgtgaatttttcttgctaaataatttgtctctagcagtgataagaaatatctgtatttcaaatatataaaaaaatctccatggctgtagtctgtgtacattctttggcgtacaaaaattcattgcatttatctacctattatttagctattttttaaatattttgtgtggtgaaacctgggaattcaggggagtgtgttgctttaatttaaagaaccacaagtgtcataactgcattaaaattttactctccttataacctatatttaatcaatcatattcattgacttttaggctctgtagtcacggtagttaaggaggagttcaaacagaaatatataaaaggtatagctttagcaatctgtattatttaatattttaaaatttttattaagctttaactgaacgacagctacttgcaatgttcaagcttattaattcagttatttaaatgacatagaaaacttcttttaatgtatgtagatcagtctctggaagaaaacttagaagataatactgtaaactaatgattattaaataaaatcaacctttttttctgaaaggcaacatgaacaaagcaatacattttatctagtaaaagtagaaaatgtaagattaattgcttccaaaaatgttagggttcacatgaccttgagattattctctgactgactatcaagctaacatatgagatagcagagatttttccttggaactgtctagaactgccatagtacttgactgacagagcttgctgtcctcccgctctctctccctaacccccccacactttctcccacccccatttctctctcttattgttccactagcaaatgttaagcatccatgataacacaagaaagaacagtggcatattctgttcttaaatgtaaattcactttttctctaactctgtagacttcagagtgtacatttaggctgtggtttggttttgcaaaaaagcagaaatgaaaaatactatatgaacttatcaatactgccttttaaaaatctattaactatcaagatggaatattaatgtagaataccaattttttatttttacaaaattctaatatataatgaaatacctataacctcaatattttccacatagtttttatttgctaattgagtagtaaataaaacaatgtaaaataattgttttgcctgtggataggcttatttaaaagtaatatcatctttacaaagtgtgcattcttattgtatgttagagtatcatctaccacttcagagactgatgaaatgtttcagtttgtatgtgttgctactaagcagctcaaagcaattgtctagtttaatgtatttccaattaatttttagttgcattagaaaacagaatgatgctttggttatttagctgtgaaaataatgaagcaggtgttttgaaatccctgaccttcatgttcaacatgaaaaacatgggtaatgtatataagtttgtctttagcttccctcacttagacttacagactagaaaaacagttacaaaatttcctgagttgcttttttttttttaatggcctaaaggttctcaatttagaattggttgctctaaatatttaaacattatttttttactgcacaaccctttagcctaaaatattattatcattgtatcagtatttctggtgtccagagctgcaattacacttcccactaattaatttggagtgatttttttctccaccttattagcattcattcattaaccgaataagttttgaggcttactgtgtactagacatgtgctggttgaagaaactgtactgatgaatgaaaacctcatgtcaagtagcttttggtgagtatagggaaacaaaaagagtaagcaaataaatgcagtgttatagcaagtgtatttttttgtctcttcactctgtacattggttcatatagtactttttagagatcagtgttgattattcctgtcagctggttttacctttttataaattaagtattagcctgatattagtagctgagaatactagcaaaatgagcttaggatggtaattaatccatcgtgacaaaccagttgcagaccaacagcatctgctactgctgggtaactagacgtatatcagatattatgtagacataaccattactccctgtttcatgttaacgtacctgggtttgaaattaaattattttgacattgtctgtagttgctcacacttacaagaagggaacctgcaggcaagtgagatgaagagagaaagaaaaggaagaagaaaaagcaaaaggggagagcgggctgaccaggtgaggtgggtagggttcataagcaggagagaggggaagcatttcaaattcccctaatggttttgaaatctatttttgttgttgttgttgttgtttgtttttgtttttgtttttttgagacggagtctctctctgttgcccaagctggagtgcagtggtgtggtcttggctcactgcaagctctgcctcccgggttcaagcaattctcctgcctcagcctcccgagtagctgggattacaggcacctgccaccacacccggctaattttttgtatttttagtagataccgggtttgcccatgttggccaggctggtcttgaactcctgacctcgttatccacccaccttggcctcccaaagtgctgggattacaggtgtgagccaccacgcccagcccaaaatctgttttaatgttccatttgtgttttcaggggagacatagaaatagcgtatgatttattgatgatactgatcctgcctcaacgttttgatattctctttgtttggcagaaaggaggctgaaggcccttctgatcctagtcagcagcagctggggtgttacagtcttggtgtccaagggcccaggtctggcactggaaatggatgtgtggggcccagcctgaatcacaccccaggtcctttccgtactgcttccatttcctttttggacttctttctccggggctggcaacagccttgtacgtgtacacatgcctggggggacagctgggctccattggcaggtgggagcagcctggcgacatggtggtggtgggagaggagcctctggacatggtgggaagcacaggagcctggaggcttttctcctgctgttttctctttgctccccagggcaagcacataccctgttgcttgcactgagtctactctccaaagcaaccatgactcgtgttaaggtggaagatcaagtgcaaggcggtgccagttaaatagtcgggaatatttactggtgcaaaactgaggatcaaagagaacaagagcattcggttttagagaaagtcagaaaccccagagaccagccacagacttgcatcctgatgcatcaagagccccaaaaggtggagattattttcttttgtcagcaggttttgctgttagtctacggtgacagtttccttttaagtagtttaagttgtcaaattacccttaatcagcttcaccacgatcagcagctttgccccgctttacctggatattaataaatgttggtcaggtcaatgttatgttatttgtttcccagggctgctgtgacacagtaccacaagaaagggaggctcaaaacagcagaaattggctgtctcaaagctctggaggccagaagtctcagatgagagtgttggcagggccgtgctccctctgaactctgcggggcagaatccctcctcgcctcttccagcttctggtggtctcagtcagtccttggcttggggcagcattgctcctgcagccgcatggccttctccctgtgtctcctcacacagccctcccctggatgtgtctctgtttccaacctcctctgtttggaaggacatcagtcatactaggttaggacctgtctaaagacctccagtcaacttgactacatctgcaaacaagctcacatcacgaggccctgggggttaagagttcaacttggctttttctggaggggagggacacagtgtaacctattatcagttttctggggtgttcaagttggagtatatttctttgtatcattcatgacgtttactgcatttttaatgtaggtagtgggtaaatctcacctgatctttttagaaacacaaatacttacctttttgtcagtaaagcgtttaaaaaaaaaaaaccaagcaaacataagaactagtgatttagaggtaggcagtagagtgagacagacttgagctccagcctcatgtctgagactcactagaaaatgaatttgggcttagcctccctggtctcagggtcctcacctggagaatggatgtgtggggcccagcttatgccttcaacactttcacagcttcaacacttttgaagtgcttatgctgtcaacactttcacaatgattttctgctcctcgataaagaaagcacgcttgatcctgtcctgaacacatttagcactcatggaaccaccacaggccctgctgacatgtttttttgttttggacaatctcataagaactttaggtctcacagcacggacccctcaaagtctgcctgggcacacaccacatgcagagttttggtgttttccacaccttcttgggataaaggtagtcaattctattacaaggggctcgggacagcctagttttgctagagctgtattgtaggaagcctaaggcagtatgtctaagaccattctgagtgcatgtagacaacgacgtccatggaagaggctgtgcgtttcctagggcaaaggaacattttgtttgttttatttttatttcactgtttacttttttttttgtctcacatgcatataaaaaaggatcatttggaatggttttccttttaaaattaagaagcccagaactcgaatttaatctgagttaggaaatctaacttgaattttaaaactccataaaggacatatatctagccccaaccccagtacctagagacacaaatagaaataagctggacttagactctcagccatttgctggagagacaggccaggtatgttactttgggtgcaaagcaaggctagatgaaatttagttggaatttctatcgatgatacttgaatttcatgtttaaaggtattaacattttttcactaatgatataaaacatgcttatgctttagtgagaagggaaagccattgaaatcctgagaataataagatgtttgactacatgcatcacctagccatccttcagaactttaagcaaaagaaaataaattactaaaaacaaagagccattaattagaccagtgtggcttatgaaacgtttggagctttggaggtagtgctttgcaaatctagctggcaaaaggtttggaaaactatgccagccttaagattaactctattttatgaaaaataatgaatttcaaatattcatattctatattaatatttaaatattcatttaaaaacccatttttaaaatagctcagataaggattttttacagcctatctcgtttgtatgacagactgttgcacacaatggctcatatacaattcttgaaactgagattcccaagcataccagacatatttttatgtctttagacttctaaatcaatcatatttggtagctcctcttaattacctgacctatggtggtcattttagttgtagcatctgttccatttatccatgtgtaaaagtatgctttgcttttaacattaatttattcacttgacaaatatttatcaagtatttataatatgttggacattgacttgacactaaggataaagcagcaatcaaaacacttaggatcctttgtttatggagcttagattcaggtatgtggaggcagacaataaaaatgggtacacatatgcgtgtgtgtgtgtgtgtgtgtatatatatacacatacacataaatatacatatacacacacatatatatagcatatagagcatatatagagtgtatatatagagcatatatagagcatatatatatatatatatatatatatatatatatagagagagagagagagagagagagagagagagagagagagagagagagagagagatgaaatctcactccatcacccaggctggaatgtagtggtgtgatcatggctccctgaatcctagaactcctgactcaagcaatcctgcctcagcctccggagtagctgagactacaggtgcacgacaccatgcctggctaacttttttttttttttgtagtggagatggggttctcattatgttgacaaggctagtcttgaattcctatcctcaagcaatcctcctgccttagcctaccaaagctctgggattacaggtgttagccaccgtgcctggccaacacatggatattatagcgggtgtattggaagacaataattgttaaaagatggatctgggaagggggataaggagtagggccggggatgggaacttgtataactagaggggtcagggtgagcttgctgagaaggcgacatttaagtgaagacctgaaagagatgaaggtccaccacacgcactctgtggaggagacctgccgtgcatggaggggtgggtctggtattttctgcaaagaacaaggaggtcagtgtccccagcatggagtcactgctggggcaatggccagcatggttatggggccagaagctttaggctatacagaccatggtaaggactttggcttttactctgagtgataaggcgaggcagtctagggtttcagcattggaataacatgatctgacttacatttttgaaggatcccttgggctcctgagttgagaagaaattggagaggagcaagtgtaggaaaaaggaggccatttgggacataagtgcattcatccaggagagagatggttctggcttggaccaaggtgcagatggtacagatggtggaatgtggttggatcctggacatatgaatgtgccagcagtatgacagaaaaaagaattctgtatatatgcactcagtcataacaaaggtctaatacccagaatctataaggaacttaaacaattgaatgagcataaaacaaataaccccattaaaaagcgggcaaaggacataaacagaaacttctcaaaagaagacatacaagcagccaacaaacatatgaaaaatgctcatcatcactaatcatcagagaaatgcaaatcaaaccacaatgaggtaccatctcacacctgtcagaatgtctgttattaaaaactcaaaaaacaacggatgctggtgaagctgtggagaaaaaagaaagcttataacactgttggtgggaatgtaaattagttcattcactgtggaaagcagtttggagatttctcaaagaacttaaaacagagctaccatttgacccaacaatcccattactgggtatataccgaaaggaaaatagattattataacaaaaagacacatgtactcatctgtttattgctgcactattgacaataccaaagacacacatcaacctaggtgcccatcaacaatggattggataaagaaaatgtggtacatatacaccacggaatactacacagccttaaaaagaatgaaactatttcctttgcagcaacatggatgcagctggaggccattatcctaagcaaattaacgcaggaacagaaaaccaaatactgcacattctcttttataagtgagagctaaacattgagcacatatggacgtaaacatggggacaactgatactgcagactactagaggagggaggaagggagaagcgtgcgggttaaaaaactacctattgggtactatgttcactacctggatgcaatatattcacgtagcaaatctgcacatgtaccccctatatctaaaataaaagtagaattaaaataaaagagagggcattggctaacataatttaaaaggatattgcttcagacccagctagatccagagacacaaacaatgtcagaacattcagcctgtttttcattattcagatgtattttctttggtgttggcttcattctcagctagtttaacagcaccatcaggaaaacattttctctttcccaatagttaagagccaaagttaagactgtaatgcgttaacctggtttaggtcatgtgcccatgccagaatcaaatattgtggccatgagaggtagaataactttttggccagatgaggattgcatacttaccttgctgtttgaatttttgctgtcactcatagccctgtgaacctattcatgacacagcacatagatgtactcaaacgaggcaagaaggaagtcactgcaaggtttgcatcagtagcccatgtgaaagctgctcataaccttactgacatattgtgtcatccctgttactttcacagtttcaggggtttccatgaaaatgctgactgttaagattgttaaggaagctgtctagaggaagaataagattcccccaaatcctgattgtctcacttgcaactgcaaagtatccagcctcactccaagggtgtcacagcatgacagcaggtgaagttgaccttgttattaaacacagtctggagtttctactatcatgtgtctatctataactccaaccttgtatttctatcagagctgcagatccatctcctcctgcatcatgacttttgtaatccagtggttgaccaggcacctggattacaaacgcaactaatctagtaccaaagtcttcatcctctcctttttcttcaccacctctgagtctaccacactccactccacatctgatcttctcatttcctcattttgaatggtggcaccaccttctgcccagtcacttaggactggaatcgatgagtcagtcctagtgtccaccttctcctccaccatcttcatttctacccgcttccctagagtcctgcctttagtctagtgtccttctaatcagatccataccccaagccaggatgatgcatctaagctgtgagcagaggcatgtattcccatatgtaaaatgctttagtgattcttccttcttggagcacctgaggctgtctgtgagctggcccctacctacctctctgtctttgctcacactctttctccttagtaaacggttagtgctccaattatatatttcttgtggttccttaatcaaccatcatttgcatcactgctaaacttttgttcctccttgaatttccttttttctctagtgtgtgtgatgaaaaccagcctgctcttctgtctaggctcaggtcaagtgccccctcttctctgaacccttttctggccctacctcatttaacctctgacacttatgggcctccaccttaccttgggaaactcttctctctgcctctgtaccaggttagggatttttgtccatctctatgcctaatgccctttaccaggctctaagccccactggaggcagagactatgtcttactcatgcttgtactccagtgactaacagttattagcatgtaatacatgtttctgaagtgaatgagtgcatttgtttttctgagaaagttgttgactccactgtttcctctgaaggtgtagttgatgtgattgggccatgttatgggctgaattaaatgcccccagattcacaccttgaagccccaaaccccaatgtgatagcatttggaagtggtgtgttttggggtaattaggtttagctgaggtcatgaaagtggggcccccatgatgggatttgtgttcttatgggaagaagaagagagacctgagctctcttaccaccaggtgaggacacagggagaaggcagctgtcatcaagccaggaagagagccctcatcaggaaccacatctgccagcatcttgatcttggactttgcagcctccagaactgtaagaaataaatgcctgttgtttaagccactagtctatggaattttgttccagcagcctgagctaagacaggtcacatgctacaaatgtgtgctgggaggttggaagacaatggatagtgactgaagaacaaggtagatagcagcttctctgaactgtattcctgacgatgaacgtgcctctgttcaggttgttatgaaagcaaattgacttggatcttgtgttcttcatctcataattaggggactttgattagaagacctctagggtcactttgagggaccacattctacatttatagatctatattagttctaatgatacttgttttgctataataagatgaagatgtctaggaaagtataggataaaaatcagaataactaaaaacttagttatgaaaaggaaggcaaggttttccataattaattgcttataaaaactaccaaagatgcttgtttgggcaggtgaaggcaggtagagtaatttaaagtataaaagatttcctttgtttaaggaatgtagttattaatgactaactctacataacaaaagatttttccaagatgtgattatattagacattaaaagctgttcacatttcaagtaggcaaatatcaaagtttgggatttctaatctcttgttatgtgatgtatttataaggtgctgataaaactctcatgggtcacaaatttattatatgaaattttcagttcaaaatcatgtgtatataatgacatagaataaaacagaagtacccagaattaacattttaatatatagtatgtctatttgtgtctatataaatatctataaatacaaataatgtgtatttatttacacattattgtgtaatacaatgtgtaaatttgtaattatacatttatttaaatataaaatgtatttaaacataaaaagtataaatttataattataaatttattgcacattttatatatacattttacatatacttttataaatttataattttatacatataaaattattttatatgtataaaataattgttactgacctcccaattcaccagtatcaggaggttgttcagtatcaacagaactctatccaggcctgcatattttcaccatttttattttgctattctatttcattgcaattgcaatatatcagttagatcatgggttgaagctacagaaacaatcacctttctagcactattttaacctagattgttattcccttgggcagaagactcttgcctaatacatctttgtcagcccataaagactagtgagatgtcttgccaggaggagctggaaatcagtaaatacttatttaatgaattggtttgaaaatgaataaacaaataaccataacagaagttgagtagggtactagtaatgctggaatacaacaccgtgaaagcagaagcagataatggattacagtggctgaaatcctgaatgtagagtcagccctgatttcacatttcagctctgccatttacaaactagataacttagggcaaattacttaatatcattaaaacttactcttcttgtctataaaacaagtgagcttctctgaaggtaaaatgagataatgctcagtaaaattttcatcacagagtaaactctgatgactttttgaactatttttatggaaagtaacaattacaaaaatagtaagttaatgaaatcataaaggccttcttttatcttcattattggcattttcactaaagatgtgattttaggaactgctttagtaagaaagagaagattcgaagtcctgaggggcagcattccagaagtaggatatggcctatgaaggctggaaggaagggcttggaatgatcaacagatgttctggacatctgagaatctccagacaagttaactgcacacagcaatctagaagagaactttaacctggacatgaatgcgttaggaggctccaagtgagctcttggaagaaggaagccatgatcaatgccttatgcaggaaagtaacctggccgccagcataaggaatgagcaaagagaaggcagtttttgaaggaaaatcctgagctaagattaggaagtgactcactaagtcactgacccccaggatcagaattatgggtttagaaagataaacaacaggaactggtatttagggagggtggcatcttttcaaggaggcttcctctgggaaattctccaagagctttgaacatctgaatgtaacgacatcactttgtactgtagttatgtatctgctgctgtctcctctagagagtgtgatgtaggacattggaactcgctgagctgttatctggaagcatgcccagtggggctgtggctgtgaagatggaagtgccttaaggactcacagctggagttgggtagggtgcgagtagacacatggacgaagggttgcatcagtgattatactttatccctgtggggagccaagaaggattgttaaagcaggagtataatatgaacataattgcatttacaagtacctcttggccagagtcttgaaggatagatagtagaagactgatggcagagacaccagaaaataagtcattaaagtctcgggtcagaggtaaggcctgcctgttgtcttagtccatttggttgctataaaaaatactgtaaactagatatttataagcaatagaaatttatttctcatagctcaggatctgggaagtccaacgttaaggcactgtcagattcagtgtctagcaaagactgctttctggttcaagatggtgccttctatctgtcttcacatagtagaaatggtgagggatctgttttgggcctcttttgtaaggggactaatcccattcatgaagggcttaatcctcatgacctaatgacctcccaaaggcactgcttcctaacaccatcacataggggttaagatttaaacatgtgaagtttgaaggaacacaatcattcagaccactgggccttggctaagaaattggtgaggggaagaagagtaaggaatggattatagtgatgctttagaagatggaattcatggaaactcacagccaatgacaggcctggattcagataaagatgtaaatttggtagaaaaaatcaaagtgagttttcacccactgacctcttcttctcattgtattttgaagtaggaagcaaaagcagctgatgagaataaggaggctaaagctggactagagggcttgagattgtgcagaaggtttgggatgggagacgaaatgcatccaagtcaactgagaggaatatcgtgcagctccgatacaccaatgtggatggtttcaggagtgaagcaagttgaaggatgagttgatgtaggtttggagatttgtttctctacaggaaaagacagggcctggctaagcaggtgtttagtatttgttgaacgaataaatgcttgcctggacactgttgagaaggaatttattagggatatggtgcaagaaaataaagatctagaaacaagtaactaatcttatttcctaagacatctttatcagagaagcctcatgtgacccagagtaggttcagcgccaccttgtatgccccatggcacttggtgccttccgttcattggattttgcttctctttcaattagaagtaggttattcatgaccatttgcgtgatgtcatcatccccaggggtctgttatttctgttttgttgacatggtatcctaagtgctgacacacagtagtcactccatcaatctacagtgctggatacaaagatgttaatggagggaatgacatgtatttttttttttttttttgaggcggagtctcactctgttgcccaggctggagtgcagtggtgtgatctcggctcactgcaagctccgcctcccgggttcatgccattctcctgcctcagtctcatgagcagctgggactacaggcgccctccaccatgcccggctaattttttgtatttttagtagagacgaggtttcaccgtgttagccaggatggtctcgatctcctgacctcgtgatccacccacctccccctcccaaagtgctgggattacaggcgtgagcccccgcacccggccccgacatgtatttttatatattttgttacttgatggtctcttgtaaggttttgtgaattgctttaattagtaagaaaactggtaagctaaatgacaaatggtactttattggaatatagtctctttctggctcataaggaagagaaatttgtgtaattacatcaaaattatatggatattacacagtgattagataaataaatataaaaccgtacagcttcagggcaacttacacctagcctctgtaataattacacttaaccttgacattatttatggtttccttttcccccttattacacgttttatcatactaagtgttttaaactgataatgctcaaaagtagcacatgatgtgtattattatagaaattaatgcttgccttaataacagatgctttctatttggggtttgaaatgaagaagcagatattttcctagaatacatctggaagtgattttattactaaaactgaaaaaaaaaacctttcaggtatcaaatgtgtctggtctgtgatacgtcagatttctgaattcttacacttttatttcctatagaaatctgaaagtgtgttattaaaagttaaactgttctgtagattgtctacctaatttcataaggtttagtgtaatagatatgaaatctatgtcacatctactgtgtggtcttcatatcttagttatatttagaattttgatcaatagattttggtagaacattattgaactttctcttttttttttttttgaagatggagtctcactcagtggcccaggctggagtgcagtgttgcgatctcggctcactgcaagctccgcctcccggtttcacgccattctcctgcctcagcctcccaagtagctgggactacaggcgcctgccaccacgcccggctaatttttttgtattttttgtagagacggggtttcaccatgttagccgggatggtctcaatctcctgacctcatgatccgcccatcttggcctcccaacgtgctaggattgaactttctcttttttaatgatattattttacatcataaaatgtgattttacttaacagcacaaatatgttcttcaaaaatgagtctatcaaacaaaacgttcataaattaaaatcagaatgaaatataaatgcaaattttgaaagctaaatcattgtttatattttaaaatattctatatttcctcaccttaaaaattggatgctattcacaaatattcctaaagaatatttttgttcagctaacatcaaactgtggattacttacatagtgagttacacactacctatcttttcctctgccaagctgtattccagactgccataattaattaagtaggtgaatgaatctctgatgggttgtatgtctgtttctatactcctcagagagtttctctcttccactgtgttagaacaccaaataaattgggtctctatcactactccaggttattatgaaagtaaacatctggttttaccttcagaaaatagcattggttgttcaaaattcaagatatgcgtgtgtacattagcctaaaatttattttttgaaattataatgggattgttatataactccttctgcaagaatattgtcaaacaaaaaaatctgtatctgtctttctcactgaaatattgtgagagttaatgagacatttgtggctagatcgtgcaatcctttcaggaatctcaaagcaagaacaaaacagcatttccttttgaaaggcatatgttttactgtcaaaccaaacttaaagcagtaggaatgatacacatttctgagttaacttcctgctttcttggacgtgtcaaaattactgatgttccagcgtgacagaagcctagtaatgaaggaaccatgtaggtggaaaaaaattattacccgacttgcaatcaaataatagaacataggtatataatattcaaagaaaagaaagtgagagtctgaagtcatgcataaagcaaaatcttcacagtaaattgataggctgggcgcggtgggtcacgcctgtaatcccagcactttgggaggctgaggtgggtggatcacaaggtcaggagtacgagatcagcctggccaacatggcgaaaccccgtctgtactaaaaatacaaaaattagctgggcgtggtggcgggcgcctgtaatcccagctactcaggaggctgaggcaggagaatcgcttgaacccaggaagcgaaggttgcagtgagccgagatcgcaccactgccctccagcctggggaacagagcgagactctatcacaaaaaaaaaaaaaaaaaaaagtaacagactggagtcttacctatgtcttactttttccctaattttaagttagacactaatagaggtccggtaactaattgtattcacttatgtagtacttggtatagattttcatcttaggaatgtcagaataatggtacttactgctgactgctgtatattactgctcaggttcaagacagaaaaccgagagttacttctatttcctccatttcacctcatcctcccgtttcaagggattggtgagaacctttgatgttatcatctccaaacatacatcaaattcctgccctctctctctcctgtccactgctaccccatcatctcttctgtccattgctaccccatcatctcttgcctgaaatactacaaccaacccccttgtcgctccactgtctctcttgccacccatctccccccactattccatagccacaagaagcaaaagtgaccttcaaatgtcactcagattgtatcactccactgcaaggacttaccattgcacttattttaaaaccctaatctctcttcctggcccctgtctgccccttgctcccaagttctgtccattttgatattctttcctttccttaaaaccctgactgtttcctcctggagggcctcggcatggtgtggtttgctctttcccgtgacttaggtctcagcttaaatgtcactatcttcaagacgttctacttgactccttttgtaaagttggctgagaccatttccctccctgctttatcctctcagttgtaatttattatgatgagtgttattcatgtagcagaaagtatctcctttcatgcatttgccgccaattgccactgtttatctgcatgtttgttgcatgtgagctctctgagcacaggaagctggcttacacacagcaccttggagtaaatgaatgaatggtcgaatgaaaagtgctgataggccgggtgcagtagaggttcatgcctagcacatttctataaaatcagttggacgtgaagtttgacagtggctttttcactctgtctgctgccatgacatgcaaatagtgccttctcatgtgagttgcattgttggtgaaatgggcctcggtttcttcacctgaagcaaaagaaatgagagcagataatcaccaaaattccagctctaaaatcccccaggctgtgcagatgccacctatccccagaaatggcttgaaatgccacgtggagctaaggagtctcttcctgaaggaaagaatgagcacagtctgaggagggtgtctggggagcgcatcgatttcggagctgctgtgggaatatacttaggttctactggagagctcatcttgcagaagctgactgcattgaacgtgccggggaccacctggtccccctcttctcgtttggcaagaatcccggctatcgatgaagaaaccagctgctttcctatgtagtgaacaagcacaataatgtttatacagtttcccagcctctcttcccccacccactttcacccttcctcacccaagaataatcgtgccaaatagatatcagattaagaaaatgcttctcattagttgtctgctcaaaacaactttggaagcaatcctagaacatcccgttgtatcttcacagccctttatctcttgaaagttgttgagagagctaaattaaagttgcctaccattaatccttgctctcaacactgtaaatcaaaggaatgaaatacttctcatcacaattcagatcccaaacaggtaaaaattacaacataaagcaaaatctaatactggcattgcccctgtcacctgagccacgtatcctgactgaagtaatcagcaaggggcaggcttgtactgcaactcaacaattgtttcagtggccatgggttgtgtaaatacattccatttttaacgtccccatactaaaaacgagatgtggtcatcttcacttggttcttaaaacggataggttagatccagtctccacagctgttttgcaatttcacgttatagtgacagcttccataatacaaattcagattgtaaagactgacctctcttcactgtcacagagcattctgggtgaaggctttttatctgcaagttgcacttgacaagcgttttagagagggaaggtagcaaaataaagaatcagacaacgagtcaaaggagctaagctctgttccgagaggccctgatattgatttgtggagccttgtgtcattttctctatctgggctccagttcttccatttacaaaatatggatcatggaccatattgtcaacctgtgtaatccacgaagtcagtttttatagatatagagccagcactgatcaaatgtgtcagcctcttacaaccacagcggcattatgaagatctgtaagtgagcacttacggagcttcctaaacaccttgggaggaaaccagtcagtgtctgaacacaaagaatttatctacaacataaaacaaaaaccactgcagagtcagagatcccagtgccctcatcatcgcctcttctaggattacacagtcacggaacgtgtgcatccgcctccagaatcgctccccaaattccatggggtaaatattttactagaaaatgtgagtcaaaaggaaagcaacctgtctctaaagtaaatcttatggaataaggtttttaatattgtgaaaaacacaaactaaccattctttcctaacaaatacccctagggatgggggaagcacaaggatctctgcgatcaagccctgccgggccgcagctttcattaggttgcagaggcagctcttcctttccctgagtgttcctgcatccttgaggcccctataaagaggactcagcgtctgtttggcaccgcctgttctcctccttccttgtgtctcttcgtccactctgtcaccacggcgctcgcagttttctcaggagacacctggatctcaggctctaaggcctgtctcactctgtgacgcatgtggtcatgagcactctgacctccgcatgaggatggtcagatggcagagggcagaacactgggtcagagatctgaaacccagcatgcagccctacctctgcctgtcacaggttttaagactttggcgagtctcaaatcttcaagacctggcttcccttatctataagacaaagagatcggcttgagtgatgtttgagatgttttccaccctgcagtgattcattataaaataatagacatcctctgactcctatggaccagtcaaggattgaagcttcttaaggccagttattcctctgccatctgactcgcacatgtagcagtctctaaagattgcctacttcagtcatctgattgcgtctgtttcacagattcttctggaatttttcttctttcagttggcttttttttatcgtggtcaaaacccccatagtcgactatgatctaaataagcagtgccctctctattaagaacagtgttgaattacctattcttgcaaccacattgaccgagcttcatctctgttataaatcataacctgaacagacaatctcagtgcatcccggcacctgcagattggatatatcagtagaagttccctcatcccccagttccacatgcacagcactcattgaagtgaaagcatgagtctcccatattgaaagacgagaagatcccataacacatctgtgaatctggacatctcaagctgcctttcaatggattttagactgtgatcatacggagggctgaagaattgtctgctctacgtcttccacagtgtactggtcttgtatgtctaacaccctataagagtaaacaatgtgctctgatagatgagaattctaaaaaaatgatatcttctataatgattctttagatttaaatgttcattatggcatttaggaatccctgttataaagcaggttttaaaaatgttttatccaccatgtcatacttttgaagaagctatgatctcaggaataagagataggttacaagagttctctatcatggagaaacttacttttaaaactgtaacatcagtaaagaaaaaaatgtagaacatggacaactaagctttgttcctagtacggtaaagtgatgctgatgttggtgattgctatggattttgagtgggacttagttgaaacacagcataagtccaacatcagtcctcaacttggccccagcactgaccagtcatgaggcagcagaggagtcactgcccctctctggcctcagtcccttgtctgtaaaattagtaaaaggcggtttgccctaaccagttcacactgctgacttgaaagccagacgatgtgaaagtctgttgcaagtgtaatgcgatctttccatctaatgcgaggcctggctccatttcatgcatgatcaccttcagctgtgactgcagcccttgctggtaggacctctctcagggactcccactcacccctaacctttagcactgaatgtcaggttggtgactcccactcttgctctgtagcaagcaaggcaattcttttacttaaatgtcattttgtctttaaagttctaagtcttcttttttgagattcccttctaccagttttttctccccaaattagatattccacaattttcaaccttttttgagcttattcagcatatttatgttgtactaagtcattgtttcaataaagaagaactaaaaaagtgctagaaataaattgtcctgctttgcataaaaccttaagagtagtgtgtgtgtatgtgtgtgtgtgtgtatgcgtgcgcacgctattacagagatagatcttttgcagaataataaaaataactatgggggtcctattatttagacagaaggggttaaatgaaccctacaagcttcttactgtcaggagagaatagatttcagaaaaaataaagacaaggaaacaagccccaaagctataaatttacccacagtgtttaaacactcctttgtgattattttctaaattttctcaggtaccctttttcatttgaaatgttagtggaaagttctggagaagaatttattgcaagtaacgtaataattataaaatagaagaaaagggccctgctgacttgccagagcttgaagcaaaagagaaagttgcctgcattgacggggctcgctcaagtatttcagtttcaacacagctgtcctttctcattgcagatggagggcggctgccaccatatgccacctctgtaataaacaaaagtagtgcaacaatataattaatagcaagccattttcatttttaaaattccaaaaaggaatatgcttttcacgaaaattcaagatgtaatgcccaagtaaattgggcaaaatacagcaatgtatcaatgagattccactttaagaaagccaatatacaaaatattgtacttgaaagttaacattactgtcatcacaaattacttgcttatatttctttatagtactttaagaattgtagtctcacctacttcattcaaaatgactcatcctgtaaccagtcttttcctgggatctgttgtatctccattatataccactgaaaatatttactaaataggttccccaaataaaaatatgatttgttacatagaattttctgcctttttcctgtttcctattgacatgcattgtttccttaaataatgatgatgatattaataattgctaacacatatcatgcttagtgtattgttaagagctttatatttaatcatgaataatcttatccgggagatattattatctccacgttacagatgataaaactgaatcatagaaagattcgtcacttgcctttcttataactcgttagtgatgagtggggcttgaacctggcaatccttctccaaatccgtggtctgagtcactgtcctgtgaattagggctcagtagcaatggctcttttgccacggcttgctatgattgactcttacagcagtgagctctctctacagtactcaagatctgactgtggtactccatctgacttttctgacttttgctgagaactttatggaaaatatgtgaatgtggaggaatttcaagagaatccctgcaataatctgagcttgttttgttgtgttctctctgccttcttgtctggacaatgcctaccaaggtatccagacaggaagtccatgttggctgagaggctgaaaatacataagccaatagatggtaactcaagctgtgcaagggacccagccaccgtcatgtaaattgctaccatgatctaagcttaattatcatagacagtactaattaaaagacaatattgtaaatataaactggccctgatatatggcaaatgattagtatgtattacaacttgctaaatcaaaaacatgtcttaaaatacaagatagtattgcaataagtactagagaatgcgacaagaaaattaatcatctgctctttaccacaaattccttgtacaggatatctgctctttgtgttttgtttcacactttaatgcaataaagtgtttacaaagcataaagcactctgttcatttgtcatgttttactttagcttttccatttttttctctctacaacacttttcactgaagataagtttgctgacatatggcataatcattttttctcttagttacccaattctgcttcacaactttaatttttatatctattcgaaattagttttaattacctcaacactttaaattgatttagctctggttttagaaaaaaattcaaataaaatctttagcaggtccttcttctctccctcccttcttctctcccttttctccctttttccttcttgccttccttcctcccttcctccctctctccctccctcccttccttccacaaatactgctcaagtcctaccataccgagtactgcactgtaaatacaaagatgaaaagttacaaacctgccccctcggaatttgcacatccagtgaggcgattgacagaatgtgctggaaagggctgggtgtgagacgggatttgagacaagagcagaaattcatggaggtgggcagggcagggaaggcttagcaaaaacaaacaaacacgaagatgaacagaataaagtgtatgtttgagaaatcctgaaacccggaggccgtgagtagtgagaaatggaagcaagagacaccagacaaggcgagaagggatgtttggctccagaataacagaggcactgagtagcgtgttttaaaacttaaattgtaagtttgagatttaaatagagaaggaaaacgattttgagttttgacaaaataactttggaaaccattcaaagagtggactgcagctgaatgatgctggcaggtgtggaacagtctagccattatgagggccgaacgaagtgaccctatcatggatggaaaggtgggagggagatagaaatctttaactaacaggactggataaaggactggagttgaggggggaagaaaggtagttgctgataccctccaggttcttataatgaatgagttggaggcagtgctgtcaagagacacaggaggaacagcaggctgtacagaaagataataagataactctggtgtatagatgtagagatggaacagcagtgtggtatccagattaagtattcaagtcatagccactgaaatttggaacgaggtacatatgcctggtttcatttttatcgtttaacttcttttagagaatctaactaatgtaataaatatctataaaacaatattttcttatagaaatatactatcacacacacaatggatgacaaatattgaaaagaagaaaaattattttgttatataattatgtcacacaacaacaaaatcaagatattctaaattctaaatactattattagaagtatcaaataaaaatgaaagtagggtgcatgaatataaaaaaatacgcaaaatgaaagtggttttctttatagtattgataaccaattggaaatgaaaacagggtaaaataccacaaaaataacaacactgtacaagtcctaagaaaaatatagcgagaaacttgcaggacttgagtaaatgagaaatatttgttaagtaagaacaaatataatggtattgcaggttaataaattgtttattatataaatatttaaaattttgtacagctaaaaatactttaaatatagatatgagttgaaggatagactcaaagaaaatatttgtaaacatttgataaataatatcactaacatacaaatagctcctttataatgacaataaaaagatccatagcgtaaatacaaatggaaaagtcttaacaggtaatagataaatgaatataaattgtcatgtaaaagtccttcttctgaactaaaagttaagaaagtgaaaattaaacatataaacaagataccattttcttttattaaaatttcaaattaaaaaaaaaaaccagcaataagtcctagcaacggctgtattgatatttacctggtaagctaagtatcaccaataaaatactaatgttccacttcataaatattcgccaccctgagccccttttttttctcctcgaaccccatcccacccttctccgactgaccaaacccttccaacttcaagagcaataattagaggattaatttgtggcacttgaatgttcctgcctagcttattattaaatatttagaatagtatttctgggtatgagtacagcacaatggggatactcagttatactgcagttgggaatatgaagtgttaaaactttttaaaagagttacattactatgtttattaaaactcagtatctgcttatttttaaacaccccaaaactaccttattttttaatcttataaaaataaaagcactgacatatgtataaagatgtttatggccaggcacagtggctcacgtctgtaatcccagcactttgggaggccgagggaggcagatcatctaaggtcaggagttcaagaccagcctggccaacatggggaaaccccatctctactaaaaatacaaaaattagccaggcatgttggcaggcgcctgtaatcccagctacttgggaggctgaggcaggagaatcacttgaacccgggagccggaggttgcagtgaaccaagattgcaccactgtactccagcctgggtgacagagtgagactccatctcaaaaaaaaaaaaaatgtttataacagcataaatagcccccaaactataaacagcatgaatgctcattacttagaatatggctgaagaaattatagtatatttctataagaaaatattgtgttttatagatatttaaaagaacagattaaatttgtgtttactgacttagaaagatgcccataatgcactgtttacaagaaaaaacacaatgtgtagggtaacatgtacttttgtttagaataccagttttattttagaaaaagaaatacatctctctctggctctatctctgtctctctatctctgtctgcctgtctgtctgtctctctcacacacacatacacacacacacacattgtagacataattctatatggtgtgaggattaaaatgtatgaacaaatacactcccagttgttggggatgggtgaaggggatatgcacaggatattaactttttcttcatataactctgtattgttagacttattttattcagcattttattcttgcccttctaaaaaaaactgtagaaactccagacaaagagaagtctagaaatgacattctccagagttgaaggaaaatagtgattataatagagcatgacaaattaaacacagactatattatttaataagaaaagaaaaataataaaaatttaaacccaccaaataatgaaatgctttgttgaactaagcaatttcctctagaacattgatttttaacatttttaagggtgactcatccttagaagaattggatgaaacacttttcccggataaaggtagctgagttctcaaatccataaattgcatagaattgtataggtttgctgaatccctgttctccagtctcctagttaattatttaattaaaagcaattgtaaataagtgcaaaacatatattcgttatataggtcctcttctcattgttttgataataacctgtctttataatgacctgctttcttaggacgaatatgtttatttcagaattaaagctttaaagctaattcaaccccactttgccagtccaagatgcctttactcttctgttaagcttgccactcccttcctcctggggtgaggtgacatctcactgtggttttgacttgcatttccctgattattagacatgttgaggattttgtcatctacctgatggccatttgtatgtcttcttctctgaagaagtctatttggatcttttgcccatttctttattggattatttttcttgcactgcgttgagttcatttatattctggatattaactccttgtcagatgcatcatttgtacatattttctctcattctgtaggttgtctcttcactttgttgagtgtcttcttggctgtgcagaagaagcttttcagttcaatgtaatctcatttgtctactttcgcttttgttgtgtgtatcttggagatcttatccaaaaaatccttgtccagactatgttgtgaagcccccttttgagtggtgctaataaattacaattatgtttaaattatttgataaaattgtatctcttacacacttgaaatgttggtataattttataatttatctgatttttttagctttactttgagctaaaatcaccttttgacttattttcctgtcagaataaataatatatgcagcaaagaatactaaagatagactaatgaaagtttaatgtgctttctatttaatagtaattcggaagtttacttaaataaaataaattcacaggtattaaaaattctccctcagagcttttagggcctaaagttggtaaataatattcagtccagaaaaaaaatgaaacttagaaattaacagaaatgaatactaaactgcaaaaatttatatttagaaagaagaaaggcctgcgagttttagaaagatatgtagtttaatggtggaatttaataaatggtcgatatgttagcttctttgttcagctaattcatactctttagaaggttcaaggttttcccagtactagttctcatcacaattatgtgaaacacacacatacacacacacacacacacgcacacacacacattttcagtgtaataattactagcataagtttttaattacactgcatacagatctcatgtcattaggcccaggtcataaatgtatgcctaatactcttcagtcagttcaccattgttttacctagtctcttaaaaataaatgtgaaaatgtttattcctctggcttttcagtaggggcagttgagatctcatgtctttcttgccatatattaagaaaaaatgttaattaggtgctaccatgatgtttttctaccaggattaagtaaggttcagaagcagataaatatggcagaattggagaattacaataatactcttgtttttggcatttgttggcttttttgcttagaatttccaagtatgtttttacattaatattctccatttaagaaacatcctatggagtagcaacagggaaatactgttttatctactcaacctacagagacaaagctaaatgcagaaggataatttgctcatttaggatctgatgttctcgaccttccatcacttatgtggaagatatttcatatttgcctgatataaatattggcaatgtatggccccgcctttaagaatctcattaaatttatctgtaataaactatactacaggaaactatggtaattactacaatacaagttaagtgtcatcgtaacaggaagcaggaatgggagccattactttctttttttttatttcaataatttttggggaacaggtggtgtttggttgcatggaaaagttctttagaggtgatttctgagatttgggtgcacccatcacccgagcagtgtctactgtacccaatgtgtagtcctttatccctcaccccctcccaaacctcccactgagtccccagtgtccattatatcattctcatgcctttgtgtcctcatagcttgactcccacttatgagtgataacatacgatgtttggttttccattcctgaattacttcacttggaataatactctccaattctatccaggttgctgcaaatgccgttatttcattccttttgatggctgagtagtattccatggtgtatatctataatatatttatatatttttatgtataaaacatatatatatatatatttacaatggcaaaaatatagaaccagcctaaattcccatcaaccaatgattggataaagaaaatgtgatatatatatgtatatatacacacacacgcacacacatatacatgctgttttcatgactatggccttataatatagtttgaagtcaggtaacgtgatgcctccagatttgtgctttttgcttagtcttgcttgctttggctatgtgggctcttttttggttccatatgaattttaggattttttttctagttctgtaaagaaagatggtggtattttgatgggaatttcattgaatttgtaagttgcttttggcagtatggtcattttcacaatattgattctatccatccatgaacatgggatgtgtttccatttgtttgtgtcatctatgatttctttcagcagtgttttgtagttttcttttagaagtctttcatgtccttgattagatatattcctaagtattttattttatttattttggagctgttgtgaaaggggttgagttcttaagctgattctcagcttggtccagtaagattggtaccaattcttttttgaatgtcagctgtgaatccatctggtcctggattttttttttttttttttggttgacaaattttttctgttagtgtttcaatattgttactattgttacttgttattggtctgttcacggtttctatttcttcttgatttaatctaggagggttgtatatttccaggaatttatctatctcctccagattttctaatttgtgtgcataaaggtgtctacagtagctttaaacaatcttttgtatttctctggtatcggttacaatatctcccattttgtttccaattgagcttatctggatcttctgtcttcttttcttcttggttaaccttgtgaattgtctatcagttttgttcatctttacaaagaaccagctttttgtttcatttatcttttatattgttttctttttgtttcaatttcatgtagttctgctgtgatctttgtcatttcttttcttctgctgggtttgggtttggtttttgtgtttgtttctctagttccttgaggtgtgatgttaaattgtctatttgtgctcttttagactttgcgacgtaggcatttcatgctatgaattttcctcttggcaacacttttgctgtatctcagtggttttcataagttgtgtcactattatcattcagttcaaagaatttttaaattttaatcttgatttcattgttgacccaaagatcattcaggagcagattatttaatttccatgtatttgtatggttttgagggttccttttggagttaatttccagttttattccactgtggcctgagagagtacttgatataaattttgattttcttaaatgtattgagacttgttttgtggcctatcatatggtctatcttggagaatgttccatgtgctgatgaatagaatgtatattctgcagttgttgggtagaatgttctataaatatctgttaagtccatttgttataagatatagtttaagtccattgtttctttgttgactgtctgtcttggtgacatgtctagtgcattcagtggagtattgaagtctcctactattatggtgttgccatatatctcatttcttaagtctagtaataattgtttagaaatttgggagttccagtgttaggtgtatatatattttggattgtgatattttcctgttgaacggatccttttatcattatatgatgtccctctttctcttttttaactgttgttgccttaaagtctgtcttgtctgacctaagaatagctcctcctgcttgcttttggtttacatttgcatggaatatcattttgcactcctttctctaggagtttatgtgagtgcttatgcattaggtgagtctcttgaagacagcagatacttggttagtggatttttatccattctgccattctgtatcttttaagtggagcatttaggccatttacattcactgttaatattgagatgtgaggtactgttttattcatcatgctaattgttgcctaaataccttatttttttttccattgtgttagtgttttataggccctgtgagatttatgcttcaggaggttctattttggggtatttcaaggttttgtttcaagatttagaactccttttaccatttcttataatgctggattggtagtggtgaattctctcagcatttgtttgtctgaaaaagactttatctctctttcatttaggaatcagttttgctggatacgatattcttggctgataattattttgtttgaggaggctaaagataggaccccaatcccttctggcttgtagggtttctgctaagaagtctgttgttagtctgatagtttttcccttagaggttacctatgctttcgcttcacagctcttaagattatttcctttgtcttgactttaggtaacctgatgactgtgtacctaggtgacaacttttttgtgacaaatttttcagctgttctttgaacttcttgtaattggatgtctagaactgaagtgaggccaaggaaggttttcttaattgttccctcaaatacgttttccaagcttttaaatttctcttcatcctcaggaataccaattattcttaggtttacctgtttaacataatcccaaatttattggaggttttgttcatttttaaaattcttttttctttaaaaattttttttatttcaataggtttttgggaaacgggtggtgtttggttacatgaataatttctttagtggtgacttatgagattttggtgcacccatcacctgagcagtgtacacagtgtccaatgtgtagtcttttattcttcaccacccccaccatttcccctgagtttccaaagtccaattatcattcttatgcctttgcatcctcatagcttacctcccacatttgaatgagaacatactatgcttggtcttccattcctgaattacttctcctagaataatagtctccaattccatccaggttgcagtgaatgccattatttcattcctgtttatggccaagtagtatttcatggtatatgcataccacattttctttatcaaccccttgatttaatgggcatatgggctggttccatatttttacaattgcaaattgtgctgctgtcaacatgcatgtgcaagtatcttttttgtataacttcttttcctttggatagatacctagtagtgggatttctggatcaaatggcagatctacttttagttctttgaggaatctccacactgtttttcatagtggttgtactagtttacattcccatcaacagtgtaatgtgttcccttttcaccacatccatgccaacatctagtatttttttattatggccattcttgcaggagtgaggtggtattgtattgtggttttgatttgcatttccacaatattagtgattttgagcaatttttcatatgcttggttttccatttgtatatcttcttttgagaattgtctattcatgtccttagcccactttttgatgcgattggttttttttttttcttgctgatttgtttgagttgtggattctggatattcatcctttgttggatgtatagattgtgaagatttcttcccactctgtgggttgtctgttaactgtgctgattacttgttttgctgtgcagaagcttaaggaaggaatagaatctctgaacaggccaataacaagcagtgagattgaaatggtcatttaaaaactgtcaccaaaaaaagttcacaaacagatggatttacagctgaattctatccgacatacaaagaagaattggtaccaatcatattgacactattccaaaagatagagaagagggaatcctcctttcagtcattctatgaagccagtaccaccctaataccaaaaccagggaaggacatttaaaaaaacgaaaactacagaccaatatccctgatgaacatagacacgaaaatcctcaacaaactactagtgaaatgaatccaacagcatatgaaaaagataatccaccatgatcaagtgggttccatatgagggatgcagggatggtttaacgtacataagtcagtaactgtgataaaccacataaacggaattaaaaacaaaaatcacatgatcatctcaatagatgcagaaaaagctttttgacaaaatccagcatccctctatgattaaaaccctcaccaaaatcagtatagaacagacatatcttaacataataaaagccatgtatgacaatcccacagccaacattatactgaatggggaaaatttgaaagcttcctcctgagaactggaacaagacaaggatgtccactttcaccactgctattcaacatagtgctggtattcctagccagagcaatcagacaagaaaaagaaatcaagggcattcaaaatggtaaagaggaagtcaaactgttgctgtttcctgataatatgattgtatacctagaaaaccctaaagactcatccataaagctcctagaactggtaaatgaattcagcaaagcttcaggatgcaaaattaatgtacacaagtcagtagctctgctatacaccaacagtgacaaatctgagaatcaaatcaagaactcaacccctttcacaatagctgcaaaaataaaataaaataaaatacttaggaatgtacctaaccaaggatataaaaaacctctacaaggaaaactacaaaacactgctgaaagaaatcatagttgacacaagcaaatggaaacacatcccatgctcatggatgggtagaatcaatgttgtgaaaatgaccatactgccaaaagtaatttacaaattcaatgcaattttcatcaaaataccaccatcattctttacagaactagaaaaaaatcccaaaattcatatagaaccaaaaaagatcccacatagccaaagcaggactaagcaaaaagaacaaatctgaaggcctcacattacttaacctcaaactatactataaggccatagtcaccaaaacagcattgtactggtataaaaaaggtacatagactgatggaacagaatagagaacccagaaataaagccaaatacttacagcctactgatcttagacaaagcaaacaaaaacataaagtggggaaaggacaccctgttcaacaaatggtgctgggaatattggcaagccacatgtagaaaaatgaagctggattcccatctctcaccttatacaaaaatcaactcaagatagatcaaagacttaaatctaagacctaaaaccataaaaattctagaagataatattggagaaacccttctagatattgggttaagcaaagacttcatgaccaagaaccttgaagcaaatgcaacaaaaatatgataattagataggactttattttttgtctttgtttttgtctgattggattaattcgaaagccttgtcttttaactctgaagttgttttttctgcttgttgtagtctattgtcgacaatttccagtgcatttcatatttctttaagtgtgtcttttatttccagaagttgtgattgttttttctttatgatatctgtttccctggataatttttcattcttatcctgtattttttttcaattttttaaagttggctttcaactttctctggtatctctttgagtagcttaataataaaccttctgaattttttatttggcaatccagatatttcttcttggtttgcattaattgctgaagagttagtctggccttttggtggtgttatagagcctgttttgtcatattaccagaatgtcttttctgatttcttcttctttgggtagactacttcagtggaaaaatctggaactcaagtctgctcttcagattcttttgtcccatgagttgatcccttgatgtgttgtgttcccacttcccctaaggttgaggctttctgagagccagattgcattgattgttattgctcttctgggtctagccactctgtggagctaccaggctccaggctggtgctgggaaatgtctgcaagcttcaggtctcccagccatggataccagcatgatatggtttggctatgtccccacccaaatctcatcttgaattgtagctcccataatctccacatgtcatgggagggaggtaattgaatcacgggggtgggtttttcccatgctgttctcatgacagtgaataagtcccacgagatctgatggttttctaaagggcaatttccctacatacactctcttgcctgctgccatgtaagacaagcctttgctcctccttcaccttccgccatgattatgaagcttcctcagccaggcggaactatgagtccattaaacctctttttctttataaattacccagtcttaggtgtgtctttattagcaacatgagaacagactaatacacaacacctgctctggtggaggtggcaggggattgaagtagatagactctgtgagagtccttgtttgtagatatgtttattgtgctgactttctcaaatgctgattatgctagcagtgaagttgtcccatggacagacccaggacctctggttatccaggatgctgcaggcagtggaattagctgttgttttctccttccttggagcagggttattatgtcatgagttgctgtaatgtcctgagttggttggcctccacccaggtggtggcacattcaagagaacaccagttttgcacccgtctcatggaatttgcagtggcatgccatttctttcaagggatctgtgaattcttttggttttcctggtacattcttgaggtggttcttggagcaaaagtccatggtatgagtctccacatgcttttctctccatccaagtgggagctgcatgttagccctgtcttctatctgccatcttcctctctgagtccaggagcaattacttttaaattgaggaagaatgttgtgaatttcactagggacacagagtgggattggagcagagatttaactgaataaagaggagaagggtcaatcgaggtagagagagcaatagatgcaggttcagcataggtgaaagctgggacgcttgagttgaggagacagtagcaatgaagccggacagatggatatgcatggggcaagccttagaagagcaagttgaggagttcagatttcatttattgggtatgaaaacagccacatagctgttttggaaagggaagttgttttggataggatcagctatgttctacagaaagctattatgtagccattctatgtagaatcgttggaaattggtaaattttaaaatgttcatagactttaatgaggtaatcctgtttctgagagtttatgctaaggaaacaactgaatctattgaaacagttttatgtgcagcatattcattaaaatgccaaacaagaaagggaatggttatataaactatggtgcaatctcttaatggaaaattaagaaaacactatgaatttaaaagtttacaaagagttcttaataatatgagaacaataacaggttatagtaaaagaaaaagcaaaactgaaaactatgagtatggtttgattacagtagttttacaaaattttgtgggggcaaataggcaggagctactgactggtgaaactattggttttctttctacattacaatgttcaatacatttctctaagcatgtattagttatgcgacgaaaaaattcaatatactttttaaatagcccaatcaagaatagacacgtccagtgctactactctggcaagacatgaaccaagcaatggcagtgagaatgtagagaagggggcagattaagatttcaggtggaacattgttctcatagacataagcataagaaagacctaaggcaaaaaggacactacagctctgacttctacagctggttagatactgatgctctaggtcacaacagcaactgcaggaggagaaacagggtcagaagaggaaacttcctaagtttgatattgaatgtgtttatttggaaggatcctgaggatacctgacagatgtatcataatggcagatggagataaaagtacggtcatgcctcagtagtggtggaaggtttgttccaggacccctttcagatgccaaaaaccatggatgctcaagtacctgacatgaaatgacatagtatttgcatataacctacacacatcctcctgtatactttaaaccatcttgagattacttataatacctaatacaatgtaaatgctatgcaaatatttgttacattgtgttgtttaggaaatcataaccaaaaaaatgtctgttcatattcagtacagacacaacaaatccatttttatgaatattttcaatccttggattgaatccacagattgaaaacccgcagatatggagggctgactgtgttcagtacttcctttttttttttttcttttctttttttttattatactttaagttttagggtacatgtgcacattgtgcaggttagttacatatgtatacatgtgccatgctggtgcgctgcacccactaactcgtcatctagccttaggtatatctcccaatgctatccctccccgctcccccgaccccaccacagtccccagagtgtgatgttccccttcatgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagcctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgagaatcgccacactgacttccacaatggttgaactagtttacaatcccaccaacagtgtaaaagtgttcctatttctccacatcctctccagcacctgttgtttcctgactttttaatgattgccattctaactggtgtgagatgatatctcagagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttccttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggcgtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagcctttcatcccagggatgaagcccacttgatcatggtggataagctttttgaggtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttaatcttgggagagtgtatgtgtcgaggaatgtatccatttcttctagattttctagtttatttgcatagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgagtgcgtcccagagattctggtatgttgtgtctctgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttagaataggtgtggtgtggtgctgaaaagaatgtatattctgttgatttggggtggagagttctgtagatgtctattaggtccacttggtacagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctctggttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacacttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagtgtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattgggaaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcttgaggcttctgcattcttcacgtagttctcgagccttggttttagctccatcagctcctttaagcacttctctgtattggttattctagttatacattcttctaaatttttttcaaagttttcaacttctttgcctttagtttgaatgtcctcccgtagctcagagtaatttgatcgtctgaagccttcttctctcagctcgtcaaagtcattctccatccagctttgttccgttgctggtaaggaactgcgttcctttggaggaggagaggcgctctgcgttttagagtttcccgtttttctgttctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccgagtgaggtgtcagtgtgcccctgctggggggtgcctcccagttaggctgctcaggggtcaggggtcagggacccacttgaggaggcagtccgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccatgggcgtaggaccctcagagccaggtgtgggatatagtctcgtggtgcgccgttttttaagccggtctgaaaagcgcagtattcgggtgggagtgacccgattttccaggtgcgtccgtcacccctttctttgactcagaaagcgaactccctgaccccttgcgcttcccacgtgaggcaatgccttgccctgcttcggctcgcgcctggtgcgtgcacccactggcctgcgcccactgtctggcactccctagtgagatgaacccggtacctccgatggaaatgcagaaatcacccgtcttctgcgtcgctcacgctgggagctgtagaccggagctgttcctattcggccatcttggctcctagtacttccttatttttaagcctgagtaatatcctgttgtgtgtatatactacatattctttacccatccatttgttgaaagacatttaaattgtttccatatcttggctattgtgaataatgccacaatgaacatgggaggatagatatctcttcgtgatcctgatttcaattcctttgaatatatacccagaattgggattgattgctggatcatgtgatgttggtcaaagggtacaaagttttagctatgcaagaagaataatttctggagatctaatatacagtatggtgatggtagttacaatacttcatatttgtatacttgtaatttgctaagagaataaattaaatcttctcaccactcgtgtgtgtgcatgcacacacacaccacacacatgcacagagataattatgtgagataatggacatgtttattaggttgattgtggtgatcatttcacagtgtacacatatatcaagacattaagctgtataccctaaatatatacaatgtttatgtgtcaatgatatcttaaagctgttatttaaaaaggggtcattactggcaaaaatacaataaaatcatcactttcaagtcccataatggaggtgataaaagtaatttagtaatatgttcacatccttcaaatcaaatatagaaaattcgtttgtgctttgatccaaaatagacccccccaaaaccattatacacaaagatgctctaggttagagctagagaaaacagaaactgagaaaaatgaaacattccaccaaactaggggaatggctaattaaattatgatgaatccattcaatggaatattatataacaatttaaaataatatattaacaaaatgaagtactcatgccaaattttaaaaatagcatgtggaatttatacacacagtaagactttggccttatacaatattatataaataagtctagactaatcacatttcaaagtattaacagtaactgtctcaactcttgttagtaacattatgggcactctactctttcttctcttgtttttcaaattcttttctaccaagagcacacattactcttaaaactagagttttttagaaaaatagaaagaatatatgctaagtaatcagggttaaaatgtagactggagaatcctatagtggcataagtcatgggtagtcattaaactccagggagacattatgttgtctctcttaataactgtttagtactagattttataagataaactaaaacattttaatgattcagtcatttgtttaccaaaagtcaattagagccttaggcctttgtcattttgtgatgttcaatgaatgaacatagtgtttaaaattggtttgataaagataaaacttgacattaatgtacagtaatccattttcttacttttcttcagaaaatatgtcatgctcaattttaatttcaagaaaatatagagcaaatctacataaggcaaaaaccctaaagatttgtttgccctaagatatgttgtgctgactataattggattgtcggaatgcatctgacatatgctaatgaaaaagtaagaaagccaaagtatggtttatttgcttatattagtcctttttgtagtcaaaccagcaacacttatttacctccttcttagattctaggaatgaaaaattacaaaaccacatcaccttggcccttaagtaacagatgaaaactactgacagacggcagcgaatcatgtcttccaatgaatagcagaataatgctggaaattggaaaaattcaatgtcaaggtgggcccaaggattcataacagacttcataaaagaggtgacaatttgacataggtcttgaaagcaacgcagtggtaaagaagagagaccttcagataaactcactagattattcttcaaagtggtgatttcagtttccattctaatcagccaggaatgggagttcccatgttcctcctgctagccaatacttgacattgtcagacttttaatctgtgtttgtaacattggacatcttttgctatattaacttgacactatatgtcttctcttcagtgaaatgcctgaatattatgcccaatttctcttgagttgtttatctttttcttattgacttggaggagttctttttgtagtctggatgctaattccttgccaggagatacactccctcctttctcagagccagactgcctgaattgtacacgtcataacagtatgtccttaaacaagttacttagcctctctggctttagttttctcaggagttagattgggataataatagtacctaccgtaaagaattgtgaagatgaaatgggttaatatatggagcacatggaactctgttccgctggtagtgcgtcataataggggcaggctgtcaatgttgttactaacattattgcaacctcccacccaggtgaacgattttctaacccaccttttcctgaagggtgctgtcctctaggagtcctagctttaagcaggaatcttaactccaacttcgtacttgatgtggatctgaggacttgtctccagtcctcatgccgtatgcaactcaggatctccaggactgagaaagccttcaggaggcccatggtctccatcacctggcatgactttcctgcttcctcttcctttctggcccttactttttaaaggattaatgtgagcaggtatttgttattttgttctgcaatgtttctgcatctttaacaaaaattttaagagagaagttgcttgtaaactactcagtatgtcatgttgatgaacgtagaagtctttgtccattcttccctctagcatggtgttcttttctttatgagaattcattctttgttaagcatatgaaatgttttctctcatattgtgggtatatttttatatgcagtacaatttcatagtcaaatctgaccactttgactttattatttctgctctagaagcatgcttagaaagatccctcttaccccaagattacattaaaaatgtttttattatttgtatttccatcctatatgttatatgataccaaatgtcatttagaattgattctgacatgtgaagtcaattagggaatctaacccttttcttcaaaaatgtttagccagttatcacaacccctcttattgagtgatcactctttccttagtggacaaagccctagatgtgggaatttccatcgacctggctgccaactgtactttgtattccttctgcagggcatggccagcagtcacagcaccagtctgctgtttctcacacctgaataggaaagaacttgcactattccctactggacagacattcatattggcagaaagaatatgaaaaaaaagtgacattttaaattacttgtgcaatgagtccaaaaacattatgactagaaatacccaaataattatgggcagaaataaacataaataagaggatatcaagagattgctggaagccccattcttattggtaggaagcagtcagggcatcttcgttcctctcattagaactattacgtttcagaatgcaaatcctagctctggtcctcactgagtgtatagaatggtacaatttatttaacttacctttgctaattcagcagacatttttcagcacctgttatgtgcaagttgtttactggcctgtgagttttaggtaccttaatcatagcctgcattagacagatgtatgccagagccctgctcttagtagaagctcaatacaagattggatagttgctgcccacctaactcttcagaccctcaaccaatttaaattggattaaacacacacaaaaaattcagaaacaagactggcttggccttctatgtatttccttaacattttagtgacacatagaattcctttcttaaaggggattagcattctacatagtaaaacattttaattataaaaattatatttattacatgaagtctgttcttcccaggcaaggtctaatccactatacatgactcattttcttgtgagttttactttagcctcagcctttcaaaatttccgagtgaaatatcattaatcctggtgattcatggcctgcgcctggtattttgcagtctttagtgtgaaatccttcatttagaaaactgcaaatggaggtgagaacctaacatattactttggaacattaattatgaaacataattacaaacacaaatgcctacaatggtaataattttacagtttgtaattgtaccagaaacctccaactggatgtacttgtaacatcctatggttggattcgtttcaatggattgcaaaagagtgagccatcagcagggttctctgtagattagtctgatcattaagatccttgtcctgggttacacatccgaggtagcagtcaactgagtcattttagtctaggccatccaggccagattcacttttcctccctcttgaagacctggaggacagtctctaaatgcaatcaggcttcatctgtcagtgggcagtgcctagtccctgagatagtgccctcccgcaggttgtggtgcagggtactcggagggtcaaaaacttcttgctgcattttctgttttcgcgctggacagacttgcccagaagtcaccctctgagaacactgttggagatcacttcctgggctttcgagtgagggaacccccattgcactcccatcacactccccataccagtgggtcctgtgtggtccaaaggggtccctgtcgctccaaacagaagagagtgtggtggcatccttatagcatcatgttgggagcctttgcagagaaactgatctggatttaaactgtagctctggcattctctccctgtgtggccttgggcatgcatcttaacttgcttcatgtgtaaaatgggtacatcgcagggtgccatgaggactggggatgacacacatggcccagcaggaactcaacaaatggaaattcacgtgatcgtcatttcatatcacagtacacagcatttatctatctgaggcttgatattgaacactcctatgctgcaggctctgtgttagaaaaggaagacacaacaatgaaagatgcagtctctacccttggggagtttatggtttagagaggagagaattaggaaaatgtgaaattacctatgagccaaggcaggcctgaatagtaggggctcctgaaacacttagggagctcttagcccagcctcagatagctgctgaggcaaaaacctcctgagaagctgatggccatgattttgaaggagaggcaagagtctgccccgggaaggccgaaagagccctgtctgcagaggtggtggcacttgcgaggccttggggatgggttacaggtgtgcatggctcccaaggaccttggcacaaccacacagctgagtcctttgtatgctgcagtgtaagctgaagactctgaaatgggtgggttgtgaactgttcaataacctatttgatgcactgtccaaagagttaatgaaatctgaacaaggaggaaatgggtctccaggaggagaatagcagacaccacaattctccaaagagcttttgagtggtgctactggccacggggagatcagtgctctaggatccaataaacctgctctctccactgtacacacaactttcatatttatgtatctcccagtcctagctccagagaacgtcccataagaaccagggtgagccaagagttttttataatgaagtgggagtggcagccggtaaacagaaagcagaataggtttgaaagccttcaggccaaatcaaagagaacagagaaagagaaaaccacaggtctctgtgggtaacttctgatatgactcaagtctctatcttgtacactggaaatagcagcttttctaagaacatgatatcctttctcatttatacggtataattgttactttagggaattgtcttcactctatttggttcttggtggaatttgatttcattatatgatcttgtttgtgggttttggggcttaagctgtagacagcattcacttattcacacaataaaatatagaagttacgctgataagattttgctataatttttatacaaggtaattaaattccagcctaatgtgccaagacagaacattattatatacatttggcatttgtttagccccagaaaattcactcatccaagaagtccactgatagtgtacccatctaatataattaccctattatgcataaaataatgtgtttaaagagttagggaacctgctttcttcactgcagcaagttgtaaatgaaatgaaatcaccctggctataatattaaaagtattgagaacattttttactcagtctgctctaactgagtgaaggcaaatttttcagaacgacagaatattgtacacatttctttggaggtaagaatcttaagaacttctcattaaaatgttacttaggttgatctatataacacattctaggcctctctagttgacagcaaagtaatactggtgcctgtgtgttgcatgtaactgtggcagttcaggaatcagttccaatttgctgaccatcacagcattcgttcattgctagataaggtttctcgtagcacaatttcttgattgacggtcagtcagactcatctgtttatctttaaagccttccttccacttgaccttcaaaatgccttctaatgctatatatacaaatagaaggtgaagaaaaatcatttgaaccaaacaacagagtaatttcaaaactatctttttcaggttaaaaaaagagcagaaatgattaagaaaagagcaactataccttaattatcttggcattgcccacagtgccttgatcatgatatacacccaaaaagtagtcactgaataaatgaatgaatcagttaatcatttagttaatgaaagaaatgtcttcacgttttgcaaaacagtttggttaagtagttggtggaagttctgtttattgacaaatgactagaggaaaagattactgtagataatcaagagactagaaatggctactttctgtgtgtgaaagtgttttcttgcattcaaactctatttctgagataggtctacctattagtgactgccagacctcagagaaccttgactcctctgcagcaggaccataaccctgagtcctaaaggctggatgctgtcctcagatgtgtttgataaacctgtgcaattattttttgagactctcaaatattgagaattttcatgtccaaatttctggcttctttggcatactgcaatttctggcaacactagacccatattcttatgtgtcaatgaatgtctgtggttaagtaacacccaccccttctagatggcatgtcttgcctagttttcttcattctcaccagctgctgctaactccaacatggcagtctagtgccaatcgatgtttattatcttctttgcattattacttctcttaaagtaggtgaatacttctatggccccagattgcctggataagtacgtgttgtcagaaaaaatgaaagagagcaaattttcatttggaaatgggataatcatctcttgctgattaatatgcaaatgaaccatgtgtggggaaagaataccataaagcttgcttcaataattcactttacttgcataattcctgtaagcatttgaatgttaaacccttgctttacaaatatctgtgaggaagggaagaggaaattgagcctgtttgcaataccagaatcaagtcagaaaaaaaataaaatggaaaaatctgggaaagtatagacagcaggagataaaaggagaaaggaaacatttccaactcaaacttcccttttttctatatccacttcttgccaaatattgtttttaattattctctctcttttcattttcagttttaattattcttaaactcttcccatcttctccccaggaattttttggcttatcaacagctggaggtaggatgggcttataaggaaatgaagtccaacaccaacaatagtaatcatgataacaatatctgtcatttattgcccttcttctctctgcctgccaccaggttaggggatttaaatacattagccttaatcctctcgataattatttaagatagcattgcacccccattcttatagatgacatgaccaaagcttacaatgattaagtaatcttccccagctaaaaagagcagaacagagattcaaattagatccacttgatcgcactatgcatgctctttccacttggacttgcttaatagttggctaatcattccaactggatcattaactcatgcttaaaaagataatgaccatatcaatctctttcagagttcattgatcttgaattagaatttacaaaaaaaattctcttccaataatgtaaaccacagttagtctttactttcccaaacaaactcatgaaaagattttaaaatttcagagctttcattgcatagttttctaatatttgaacatatatattattatatatacagaatattagctataataaatatatatttcaaatatgtatatgaacatatatatcattatatataaagtatattagctataatattgtattagtttgttttcatactgctgtaaagaactgcctgagactgggtaatttataaaagaaagatgtttaattgactcatagttcaacatgctggggttggcctcaggaatcttacaatcatggtggaaggtgaaggggaagcaagacaccttcttcacaaggcagcaggaaggagaagtgccaagggaagggggaagagcgccttataaaaccatcagttctcatgagaactcactcactatcaggagaacagcatgggggaaaccacccccatgattcagttacccccacctgatctctcccttgacatgtggggattatggggactatgagcattacaattcaagatgagatttgggtggggacatgaagcctaaccatatcaaatgtatacaaagttctagtgtgtgtgtgtgtgtgtgtgtgtgtatatatatatacacacacacacacacacatatctgcaaatttaatctatgtatgggatttaaactattttctaatgaaaatacttatttgttcgttcattcattcagagcagcagtatagagatgaaaacggagaggcaaaatctgatcctaccatttactaactacaaggtcttgctcaaactacttgcctatctttatttcagtcttcttattttaaattaagatgaagaatgccagctttatatgaaaaataaatgagtatatagggatattcaggtcatctatttctttttgactatgcttgaatagcttgtttgtttcaagaaatttgtccatgtcatgtaagctgtattaattgtcataaagttcttaataacttctcttattatacttttaatgtggaatctgtagtggtatcacccctctcattcctctaagtggtaatttgtgtcttctctcttttttgtgatcatttttgccagaggtttattaatagtatttaccttctcaaagaaaaagttttaggtttcattgatttttccttattattcttctattttatattttactaatttccactcagatatttattattttctttgttctgattactttggtttgcatttgctattcttttactcatttcttaaggttgaacctgaggtcattgacttcagacctttcttcttcttttctaatagggattttagtgctgtttccttctaattattactttagtagtggcccacaaattttgatatgtttactcttcactcagttaaaatacttaaaaatttttcttcttatttgttctttgacacatgggttttgtttattttccatctatttagggattttcctgttactaatgctcatttaatttcatgtggtcagatagcttaccttgtgtaacttgaattatattaaatttatttgtttacaaatgtatttgtttatctctatttttaatttttatgggtacctagtatatatgttcaaatattagaaaactatgcaatgaaagctctgaaattttatatatatataaaacgtagttatacatgttatatatatacaacatagttatacgtgttatatatatacaacatagttatacgtgttatatatatacaacatagttatacgtgttatatatatacaacgtagttatacgtgttatatatataacatgtatatatataacatgtataacagttatacatgttatgtgtataacattgttcataacagttatacatgttctgtgtataacatttatatgttatatacattatatatgttatatataacatatataactatgtataacatatatataactatatatgggttttgtttatatatataatatataatatatagaaacaaaacccatatatattatatattattatatataatatattatatataatataaaacatacatatatataaacccatatatatatatatatcccatatatatatatatgtatatatatgggttacatgagatattttgatatgggcatacaatgtgtaataatcacatcagggtaaatggggtatccaaaattcttttacatttattgagtcttatgaacacgaatatgttctattttcgtaaatgttctgggtgtaaagaagatacatgtgtgatactgtgggttatagtgttctataaatgtcaatttaggtcaataagttgacaatatcatttagatcaattgatagataatgtccaatttttctatatgtttactgatttttttgtatacttgttctatcagttattgagagaatggcattgaaatatctgactatagttatagattttttaattctttttgcaattctattagtttttcttcatatattttggagctctgttattaggtgcataactctttagaattattatgtcctcttgataaattgacccccttatcaatataaaatgaccttttttattcgtggtaaatttctgtactctgaaaactactttgttgacattaatttagccattccagctttcttttcaataatgttagcattattttatcttttttcattttttaattttaacctatttgtgcctttatatttaaagtatgtttctcggaggcagcttataatgttggcttctcttttatacaatctggcaatgtctgccttttgattaattgcttctattatgattatgatgtggttgtttcataaatgtgttattttgtatttttatttgtcccatgtgtcctggttccatgtttttccttttgttaaaatcttctgttgggttaagtattttttatgattcccttgtatttcatgtatttgtttcaaatttttgttgtgtaattttagtggttgtcttaaagtttgcagcacatatttttaacttaccacactagaatgtcaaaagagattataccattttatatatagtataaaaacatggaacatttttccattttccctcttaacctttgtgctgtattatagcttttacttctatatattatagatcctacaatacattattacttttacttttaacaattatcttttggagacttaaacaataagaaaaaatttttctattttcccatatagttgacatttctgatgctcttcattcctttatgtagctccagactttcatctggtgtcattttccttctccttaaataacttcctttcatatttcttgaagtgcagattggctggttataaattcctttgtatgtatgaaatgtctttattttgtgctcccttttgaaagtgagacaccctactctgtctcctcagcttgggagaccactggactctgctgggatcccctttttgctatactgactgcagactttctccaggcagtgagctgggcagtgacacccttcccccatttgtgtcctgcttcttaggggtgactgcttccattgtcagatgtccagtgccttgagaaactattttatctcttttacctgttttttagttgtttcaggcataacaattaatcaggtcgctcttgctccattttggtcagaggtgggatctctgggctctagatggaactggattttcctgagagttcttcccagtccacccagctagaacagagcggccttctcactggacactgggcattttggtcccaggtcatagaagagcagcatcctcacagtgtgacctcagctgagccttccactgcgtacttggtttcattttaagtcccctctctcaagacttcctaaatgtcaattatctgacccacctgggcactacatagaatattcttattgttgttgtactggatttacaaactctagaagcacattagagaaaatgaagggactttgctaaattttaagctgttccttgagctgccctcaatgttattttatccttttagagtccaagtttttccatagttccccctaacgcaaatgcacactcatgctcactctctctcacgcacacactaagacacaagggagtattgctcaggccctcaaagacagatcgccacagggacttctgtgagacactttctcagcacatattttccagccataatgtcttccgaaatcaaagccaacctaacaacagaatttccccagtaaaatcacagctaattgactctgaatttgtaaacgaggcacacatccaaatccatgtgggatcttgttgtgaccagcgtgtgttttccagattctctaaactcacagagtgaaaagagggtcatctataacaaatcctctcagtaggagatcccttcctttctccaatttgagaggcccacagagtaatcattagacaaaggatcgtttgtgtcaagttttaagaaaatttggccaaagcgatttaatcaagcccaacggaaagctttctacgagagcctgggccaccaggaactttattctcgccatccgagatagcggctcagcacctcacatggtaagaggactatgtattcctttcccttcgtgaaggctctcaagttctgacctgggacctgagaaatgtttgaattgggtaacgtgaaaggagcttctaatctactaaacagaacatccatacatgtcatgtcctgaggataaatgttggcatctcctgtgattgaagcttagcactcctgacctcctgaggtgaaacttcaatgagctttagctctttcagccatgagttgtttaggcttgagctaagcacattacctgagctggtttctgtttctttatctgttggtacaaaagggaggtgacaatttgctttctaagatcctttccagatccaacagactttgattatttttgtttaggtactgggcaaaattactctgaatataatgctgtttagttcagtaaattctaagaaacagactaaaatgtgtatgaccaatatactgggtccatgtgacaacaacaacaaaatccagataactggcaaaatctaagccattgacttaattctttacaccttattgaggctaattcattaataaaacaggtcatccattgagatttcatgtgaccataaataatgagtggcagagttagaataaagtctaagatagctcaaagtttttcatcctgtgcaaagctttcactctatatattattccataaaataaaaatatgccatattaaaggaaagagagctcagaattgaaaatgtaaaacttcccatcacttcaatttatcctgttagcatctcaaattcaacgttacattaacatggttcattacacttaatgatttcaatagcaataaagacaatagttttcagaaatcacttagatcttcccatggtctttagaaaaagatttggtttactttcctgcatagatcctttccaggatttttaatctaaacatgatttctttggcaatccaaattatgaaaattattagcacagctagccactactgcatccttacagtgatgaacaataagctaattaggtgtgtagtggcatattctatcggtgattaaccagctgggatggagttatttacacctctggaagctgtgtaaatcttacacttctgaagctggcaatagaattttaaacttacacttaaaaggctgataaacactttaaatataagctttattgttgttataaaatttcattttttatgagatttgcattcctttcattgattaaatactcatatcttcatacatttatatgtttgtgtttatgtgtatatatctggtcctgtgtaggcagaaaacattaaaatgtgcagattcaaaggaaatgagaattgatgctaaactttgtggccttgttaatgttttggattcaaaatcattttgaagatctaaggtcccaatagtatttcatctagtaaaaataaaactgcgattcccttagcaacatgctacagtacagggcccataaagtacatttgaaaaccaaacgactgtaaagtgatccactataatcaaatctgtcttgctgtgctagatgatatgaactgttctttaattgttgttttgcagagataaataaagcaaaacgctagattctgatttatgtagcattttacaaaccaaaatccatttttaaaaaaattttgtatcgcattccctcagaagcaccagggagaattgaggacgtcatgctgatgacttttattagtgtgctgacatataaatgatgctacctgtgaggagtgggtaggagaatgggcctaaatgcaattatctcccacttcatgtccaatcctactcatccatcagtgcagcccctggctcctttatagacgggccctgcctgccccacctcatttagccctcctcctcctgtagtcctagcaactgttatcctacctttatttcatcatgtagccagagtctgccaaatgacaccttttcagtcattgttagacgagtcttgctatgttttatcttccaagtgtgggtctctgggagcttcataaatagcatccaccaggattctgaataaattgcaaattcggtcactcaacgagaaacactcaatgtatcaggcacggtgctgggcagaaggagaccccagggaatgacacggatataaaggtgtgttctcctggagcctgtattccaactggaggagacaaaagtaaacaataacccgagaggctgtgcagtgactgagcgcgggcccctccagagttactcagtggggcaggcactgcagggttgctgagccgggtccgggctcccttaggaggatctgctgcagtgagatgtgcggcccagaggagcagaggaaactcttttctgcacataggtgctctcaggtggaaaagggagaagctgtgccagatttatcaatcaggtgaattagctcacctcccctggaaagcagtgagtaaggggtagagaagaggaagaaaaggggctgggagggtgggcttcctgtcatggaagatttatcaggagtggagaccttcctcctgctgcagtcatgcgacacttaatgactgggataccctctaagaaatgtgttgttagatgattttgtcactgtgcaggtagtgcacttacacacacctggacgggacaaccccactacacacctaggccctgcggtgtagccgattgcccccaggaaataaacccctacagcaagtgatcgtcctgaatactgtagacaattgtaacacaatggtaagtatttgtgtatctaaacatagaaaaggtgcagtgaaaatgtagtataaaagataaaaaatggtacacctatatagggcatttgccataaggcttacaggactggaagtggctctgagtgagtcagtgagtggtaagtgattgtgagggcctagggtatcactgtacactaccagggacctcatagacactgtgcacttaggctacactccatttatacaaaatagttttcttcagtaaaaaattaaccttagctcactgtaagttttttactttataaactttccaattttttaacttttgactctttagtaaaaacagcttaaaacacaaacacattatacagctgtacaaaatattttttctttacatccttattctataagctctttatttttaaaatattttatttctttttactttttaaactttgttgctaaaaacaaagacacaaacatacacattagcctgagcccacacagggtcaggagcatccatgtcactgtcttctacccccacttcttgtcccactggaaggtcttcaggggcaatggcaggcatgaagctgtatctcctgtgatcacagtgcctttttctggatgcctcctgaaagaacaggtgtcacactaactgagctcctgtcacacggaaggaaacaccaggggtaggaaaaaagttccaccctaacatccacaaatagatgtgtttcatgaggacaaggagcaagttcttacacttcttgatatttacatgcctaagatttgttgtcctaattaacatattgtaccccttttattctaatcctaaggtccaaaagaaaataagttagatatgttttttcaatagccaaaacagaaatatgaatgcaattgttattatgacatttcacattcattcagggggaaactcagcatctgcaaagccagaagacaaagtcttgcttttcaccattcagtaagagccaatggatcttgaagtgaacagatttggaaaagtgacctgaacagccaagatcagcaaataacaaggaacacaaagaaaagctagtaagaaagtaggaaaatcaatatggaaattgaccactaatatatccataagtgtatatacgattttaaacaacagatctgaatctgctgcacaccagggctgctgtgacgcatagccctggcaggtgctttctcattgtcatctgtctgaccgactgggcagagcccagctccagtggctacattcaatgttcatgcaccctctggagctgtgccaggctgtgaacctatttacaccctataatgttctaactttactggagaaaggactgaaacagtatggttatcattctctagttatgggactacccattcatttccctgacagaagtgtaaatacttgagtgcaggcaccatctccgcttcacctttgcacccttttgaacgcacaacacactacaggtgtagagcgagtactcagtaagtgttcatttaatgatccaaagctttcacggtctgtgtaactctctatagctgaacttccaaaacagtagccaatatctatacatggttaataagcacttgaaatgaggttaacccaaattgtaaaatacaagattttgaagacttcagatgaaataatgcaaaacatctcattaataatatttatattgataatgttgaaatggtaacattttggatatattaagttaaataaaatatattattaatattatgttttcctgtttgtttttactttttactttggctttgagaaaatttaaaattatatgtgtggttggtgtttgtgatttacattagatttcttttggataaggacggccaccttagacaaaaacctggatggtaatttgacttaaagtttatttatttatttatttatttatttattttggtagccatactcataagttagcactacgccaatggagtgtaaaagttttgctgccattagaacttgcataataatttcactgtggcatataaagaatatttgtattgcaataataacatgattaagaatatcaatagtcagtattacctgtacgcctgatgaacttagaagtaaattatgctctgttcgacaatgtggattgtctttcccttctgaagttaccctcagatatagtcaaatcagttatgttttggatgtccttctaaaaatgatcactgaggtcatgcagtggaaggaattcagattttgaggagctgtgcacatctgaatgttagactctgaaagaaactcgtgggtgtggaaataagtgtttctggtgctgcattagtataaaaatccatcacatctaactttgcacactatttaaaaattataaatcaagataatgtattttacatattcacttttaaataattgctgataaaatgaaaaatattcattaagggtaaaagtaattttactttatggaattgacaaatataattgctttaaaattagtttttgaggtttttttttttttttacttgaccaaatcttggcttttggttaatttgaaaataacatgatagaagcatacctgatgaaaaattataagatgtgataaaattacttgaaccatttttgtcactgttagtcatagtcttagttaaattttgtaatatacgtcacataggaacatcttccttaaaatttttcaatattttgaaaaacatccctctcaaatatttttaacaagtgagaatatgcagtgtttagttttctgtttgtgcgtgaattcgcttaagatagtggtctccagctgcatagatgttgctgcaaaggacatgatttcattcttttttatggctgcaaagtagtctatggtgtatatgtaccacattttctttatccaattcaccactgatgggcaactaggttgattccatgtctttgctattgtgaaaagtgctgcaataagcatgtgactgtatgtgtcttgttggtaaaatgatttgttttcttttggatatgtgcccattaatgggattgcttggttgaatggtagttctgttttaaattcttggaaaaatctccaaactgttttccacagtggctgaactaatttacattctcaccaacagtgtataagtgttcccttttttctgcagtcttgccaacatgtatttttttttttttacttcttaataatagccattctgactggtatgagatggtatctcgtggttttgatttgcatttctctaataattactgacatgagcattttttcaggtttgttggctgcttgtgtatcttcttttgagaagtgtctgttcatgtattttacccattttaatgggtttacttgttttttgcttaattgtttaagttcgttataggttctaaatagtagacctttgtcagattcatagtttgcaaatatcttcttccattctgtaggctgtctgtttactctgctgatagtttcttttgctgtgcagaagctccttagtttaattagatccatttgtcagtttttgtttttgttgcaattgcttttgaggacttagtcataaattctttcccaaggcccatgtccaaaatgacatttcctacattttcttctaggattcttatagcttgaggtcttatatttaaattctcaattcatcttgagttaatttttttgtatagtgaaaagtaagggtccagttttattcttctgcatatgactagcaagctattccagcactatttattaaataggaagtcgtctatttgttgcttatttttgtcaacttcatcaaagattagatagctgtaggtgtgtggttttatttctgggttctctattgtgttccattggtctgtgtgtccagctttgtaccagtagcatgctgtttttgttactatagccttgcagtatagtttgaggtcagataatgggatgcctctgggtttgttctttttgtttaggattgctttggctattcggcctcatttctggttctatatgaattttagaatggttttgtttccaattctgtgaaaaacgacatttgtagtttgataagaatagtgttgaatctggggattgctttagacagtatggtcattttaatgataccaattctgcttctaatccatgagcacagaatgtttttcattcatttgtgtcatctatcatttttctagcagtattttgtagttctgcttgtagagatcttgcacctcctttgtcagatgtattcctaggtattttctgtatgtggctattgtaaatgggattgtgttcttcattttgctctgtttgaatgttattggtgtatagaaatgctactgatttttatacattgattttgtatcctgaaactctgctgaaatagtttatcagttccaggagctttttggtggtgtctttagggctttcaaggtatagaaaaccacaaagagcgaaagtttgacttccttccctatttggatgccttttatttctgtctgttgtgtaggcactattttaaaaggagtgttatcttcaatgtatttgagtgactagaaattacattttaattgttattaaaatcataataagtttttatgaacatttacttggctgaattagaagcaaagagagagggtatgacctgtgtaataccttgtgtttattttctttttctctgaatttctgtcttccccttttattaagtaaataagatacaaatgatgagcatcattttgttgcaggcattaggtgataatctaggaaggtctggagacaagacgaggtgttctcaaagccaccggcaggctgccctatcaccaggctagcatcgcatttcaaggggcacagtcgtctttctgaacagttaacttgtattgcctgtttcaaatgtgacagtgtgagttgggttctccctgcctgactagctttttaaaagatttttaaagagggatgggcaagatataattttttaaagagggatggacaagatataatctgatgggaaagatctactctgggaaaaatacaaaaattctgtgtgtttaattttagcagattaagaaatcactgaggaaaggaacaattccagagtcaagattttttttttttttattcctcaaatctgccactaggttcagcctgttaatttagaaaattgatgacagatctatttatagaactgcaagtatttttgtaatggtaatggttttgtataacccttgaaaaaatatttcgtctggcttcccattaattaatggttccaaagatgaatatggggtcgaaatgaatctaaatgagctagtaagtttttttatgatatgcaagcacaggaaagttacaggatgagagcattttcatctttcatatatttgacagggaaactagaatatcaaagcttttgtcattgaactctacagtagttattcagtttgatttcaacaaatgtaaaattaggagtccaatatattggaatttgatattattataaattgtaatatatttatatatactgggtaatgtgaactaattttacttatttaggtctgtctttttctcttctattatttggacagtgcttcataaaattagtaagataaggtcaaaatatatttcatattatttcatgtaaaatgtaatatacaaaattaaaatcagaaaatatatgtgatcctaaaatatatttaaaatttgtattgtctagaaatacactcatgaaggagagctgtgttctttctttgaatggctactttcagttaacttttccttagatagactcggtcaagtccatcacttgaataaactgtaaaataagatggaaaacattgtataaaagaataagctaatcacaagtcatgactgagctattttgtacataattgcatacatgaaaatgtgtacatagtgataaatataaacgtggggggagatacagctccaaggcaaggaaatattgacttcagagtatataatcggatttttactacacttacattacatgctaacaaagctattagcaacatcatttacaaaatctacaggttctaagggttgatgatgacataggtcatcgtgaagtacccttttacaaagtcacaaaaatattacgaatctcttttgcagccttcttcaattcatagttgttattaacaggagcttaaaagcaaattaaccaaaagagagagagaaactattaataattccacacttgtctcttgtaaggcatactctgggtccttttcacgtgagtataaaaagtgaatgcagagaaatagaaaaaaatgaaaatacattgtatccaggtggttgttgcagaaagttgatgtaatcttgattgagagagagagacagacagacagacggacagagatggacataaatgcagagatattcttctgaagcagaggacaatatgtaatttagagagttactactcttaaaaattcttacattttacatttttacattttatctttttctattcaacctaataaatattttattagtgagggtttttcttttttcacattcacttttaaaatctctatttgcctctccatttttatgtgacactgtatttagtgtatgagtaagactcaaattcaggcaccttcccatgatttgctatacatggcatccatttactccagtcaaatacattcttgagagggccagtgtgtttatgtcactgtgtgtgtatgtgtgtgtgtttatttttatccctttctcttagaaaaatgttagcattttctgcacacttttaggaatgctaaatgttcccccttccctccttccactacatctgatttggagtaatattcctttacttttatttagtaggcataatgcgatcagcaaacattctactttttacatgttttcctactctcctacccctcatttttactactgtagctacactaccaaagcattatagccatacttaccctccttgcttctttgtaactgtcacttcttcctagtttcataagtaaatatatacctaaccttcaccatcaatgcttaaggcaatgcctcaccagatagtttggttttctgaatcttttcctctagtagaatcctcaagaagttttcatgagaccagtattccctcatttgttaagttgtttcttaacaatttgtttgagacttcatattggaaagttattatggctgagtataaaatctttggctcaaattttttttcctcaagttgcccaatttcttctggtagaaagtattattgtcaaaaagcctgatgacaacctttatgagtgaattggtaatttcgcccagattttatttttattttcagtgaaggtcagtaactttactaaaatatgccccagtgttggtctttcaggattaaattctccagtaatacggcctatccttttagtaggtagtgtccagtcttttggggagggagttgtcttgagtttaatatgtcagcactattctgttccgttgctttgagcttcttgtttggggctatatgcatgttgagtctcttctgcctatcttcatctgtcattttctctaaaacacttcatcactcttttgattttcaatttttaaaaaatcctcttttttgtctcctgtgtttcttaaactgttgtctgttatgattactttgtcttttgttccttccaatttaggcatcatttcctgatatttattttgcattttaagttctttcattaagttctatgtttttaatgtcttctatcatttaaaaaatatgtgatcttgttttgaagcagtatcttgcaagttcttctattgaggggcatgtcttgctagcaggcttttattgtctgtagagacattatgatatttcttattctctcctttttaaaataataattttgtaagggatttgacaacactctttttctatctgcctactcttttagaagggaggattggtcaagataacttttctggttcacagctccagagcctcctcttctattgcctctacaaagtggtttttaaaatgacctcatatttctaggatctgccttctcttctgtctttccctccttttagctggattttctctttcttttactcctctggacctgggcagctccgctcgatttggattttatccctttgctttcctcagtggagagatttgtactagaagggaaatgggggattttaggcttaagatccttttcagacctcgtcaccacccgtgaactggagcgtgcacaacctctcccagcttcaaatatggcatctgttggtgacgttcccattctggaatcaggagatggctggctactctcctctgctgcctctagcaccgttgctgtggtcacatgggtcttagtggtcagaggtctgtccccattgccttatattttaaggaccatgagtgtaccttgcacacaatttcgatgtagttcttctgtatataggttttggttttgctatcctagttgctttacctgtctgtgttaatgaggggatttggagagattaaaaagcaatattgctttcttatttccttaattctccccctttcgcctatagaaacagactcccaggctaaaagcagcagataacaaatatcaagtcttaatttttccaagataaatgaaagctcagcctcttcaactaaagcaaagtgaagaccacagtcatttcccatgtctttggcgagatgtcttcgtattggcaaaaacaggaatccttagaagatcctaattacaggaaataattactcacagacaagttgcccttcatttaaactgtcagggtaacaatgtaaagaaaacataatactttcagtctctaccaatccaggaatggtgtgatcttaaggctgactgccaagagcacaggccagctgttacagaacttaattaaaacagttttgataattagcacaacttgtatatgaatgtgagagtatttctaatgtgaatacaccggtcaccttgtcagttacagggaacagaggaaaaaatcctatgacatatggagttgtgaaccagttattaaaaaacaagcaaacttagaattgctgttgaactatcctccattctttgccaccctcataaaaacaataaaaataaaaccaaacacgcagagacccctcccaatctgatttttgcaagtagtttaagaagcaaaagctgttatgctttgttaaaagtccttttggttgcaaacaaatagaaagggacccagaccggtttgagcggtgagtattccacagagcggctgcctgagtccagcagcagcgttcgcatcatggtgctgctatttccctgcgacgacacacagcaatctttcttaattttgtcatattttcacttttatttactaaggaatgacagatcaccgagaaaatcttttttttcctcctttctatgtgtttcattctgaaaggtccattgctctccactgatactttgcagtctgagcttagtgttataactgttctaaaaatgtctcatttggaaggaagagctgtagcctgctctttattgcccagtacctctaacagccctgccaccatcaatcagcaaaatgtctacaattaactcttgctgttgtctccaaagcctggttgctgcccccacggcctcagcaccctctgcctgcacctccctccatggcttcatgacacgatctcctccttatcttgctcttcagaggctgtgtccctgtgcctgcccgtcctgggcaggtggagcccagtggatgggccttggacctcttctttctccccaaaacactctccatggtgagccatcactttagcccagattctctcccaagttccaaagtcacacctccagacacctcccgggcaccagcactccacttctgtgtgcacagtagccactgcaaagctcagtgtgtccatgatgcaatcataacctcgcagctcccactctgcctgcccctcctagagctgccctctcccatgttggcccccatctgggttgatcgacagcactgtgcacacagtacccaagatagaagccaggagttgtccttggccgtggacacttcctcactctcatgtttaaatcctttatttcaaccatttccttctgtttcctaaatgtctcgtgaatgtctgtgccttcccatcctactgaccctgtaaggttaagccaccttcctaactgagcaatgctgggcaggagatgtttgtctcgctccaggcttgtctcttcccagctcatggctcccaccgcaacctgatcgttcattcttgaaacagatcccatttcttattctcacaattagcgtctttccatttcctttctgatgaactctaagctcctgacagcctccctcctgacctggctccttccctgaagtccagcctcatctctcgctgttgccccaccttcagacccagcttcagctgtcccgaattctgcagttccccaaggccaccattcaccatggtttccatcatggtcccctgcctttgcctgggatgcccttcctgcctcaagggaggcactgtcgtttcctcaggggagcctgctccctgttattccgagttaagcatcagaataatgtgtttacttttcataattttatgataacattctcttataaagatcaattttaatatcccaaaatatttgatttcttcttttgagaattctgacttttcaaaagtagtgatgcacagccgaccacggaccccctgctgggaggcagtctccgaagctgccagtggtcttcggccacacacattcacttggccagccagacacacacctgctgctgccacagtggggcaagtgcactcagaccatctgaaggaaggtggggctgaaacccactgactcatttctactttcaacagggatttattgagcacctactatgtgctcaataatatacagtacctgttgaattgggagtttcatgagaaataaggcagccttagtccctgcccttgctgtactctaaaaacagctaaacacatgatgtaataattgccgtgtaggaagagaacatcagtgtctctggctgagctctttgctacctcacagtcacactgtctgaaatgtgtgcttctcttactgctgaaggctgccgagataaaagcagtcacctcagggtgagagtccaaggattcaaccggaagagagcagcagctagggaccccttggtgggaatgtggttcgtgaggaactggagttctgacgaggagcagcttcgaggcatttgcttctcactaacaggagtgtcccaggaaacaccgaaatccatctaagcaggcgacatgccaattttaattacctgctccagtgagtcatcagttattacatgtaatgaaattaactgtagcactgaacccacagttatgtggattatttgccattttcctcacagtattcaacattttaaaaatctgtggcaagtctgagatttaggaatagtgaaatttccttcgatttgtcctggatcatgatttatttataatatgttaacattgaattggcttaaataatttcctgcttctctttctttgagatttccatcctattaagagcagaaaggagcaatttttgtgagtatcccagttctgatgggccaccatgctcagcaacatttcctaattttttttcatatttttactttgacttactggagaattgcaatgcatgtagaccttattttcacaaaatgcaaatgttaacatgcctatttagctctcccagccatgttccttttcttgggcaattgtcttcttttaaatctcaacttttatttagatacaggtggtacatacgcagatttggtacctgagaatattgcatgatgctggggctgggagtaggaatcccgtcaccctggccatgagcataatacccgatgggtagttttttaacccacccccctccttccaccctccagtagtcctcagtgtctcttgtttccttgttcatgtccacgtgtgctcagtgcttagctcccacttatcagtgagaacatgcagtatttggttttctgttcctgtgttaatttgcttaggataatgacctccagctctatttacgttgctgcaaaggacatgatttcattcttcattatagctgtgtagtatttcatagtgaatatgtaccacattttctttatccactccactgttgatgggcaccggggttgactccatgtctttgtcattgtgaatagtgcagtgatgagtatgcaagtgtatgtggtttttttggtagaacaatttattttcttttgggtatatacacaggaatgggattgttgggtcaaatgatcgctctgctttaagttctttgagaaatctccagactgcttttcacagtggctagactaatttacattcccaccaacagtgtataagtgttcgcttttctctgcagcctcaccaggatctgttgttttttgactttttaataattgtcattccaactgtgtaagattgtgtctcattgtggttttgatttgcatttctctgatgactagtgatgatgagcaattttttgtaagtttgttggctgcttatatgtcttcttttgagaagtgtctgttcatgttttttgcccatttttaaatggggctgtttcttttttgcttgttcaattgtttaagttccctagagattctgcattttgttgaatgcatggtttacaaatattctctcccattctatagtttgcttgtttaatctattggtagtttcttttgctgtgcaaaatctctttagtttaattaggtaccacttgtctatttttgtttttgttgcacttgcttttggggacttagccaaaaatgctttgccacagccagtgtcaagaagagtatttcctagattgccttccaggatttttatagtttaagatcttacatttaaatctttaatctattttgaattaatttttgtatatggtgaaagataggggtccagattcaatcttctagctagcatatgactagccggttatcccagcattatttattgaatagatagtcctttccccattgcttgttttcattggccttgttgaatatcagatggttgtagggtatgcagctttatttatgagttctctcttctgttccattgatctatgtgtatatttttgtaccagtaccatgctgttatggttactataggcttacagtatggtttaaagctgggcaatatggtgcctccacctatattctttttgcttagaagcgctttggctattcaggctctttcttggttccatatgaattttagattttttttctgattctgtgaagaatgacattaaagtttaataggaatatcattgaactgtaaattgatttggacagtatgaccatttttacaatattgattcctccaatccatgaacatgagatttttttttatttgtgccacctcagcagtgtcttatagttctccttgtagagatctttcacctcaagaaaacatcagacaaatatccctcatgaacatagacacaaaattcctcaacaaaatgctagtacattgaatccagcggcacatcaaaaagttaatacaccatgatcaagtaggctttatttctgggatgcagggctggttcaacatatacaaatcaataaatgtgattcagcacataaatagaatcaaaagcaaaaagcctttattgagatatggttatctcaatagatgcagaaaaagctttcaataaaatctgacatccctccatgataaaaaccttcaacagactaggcattgaaggaacattgctcaaaataataagagccatctatgacaaacccatagcccacatcatactgaatgggcaaaagctcaaaccattctccttgagaagtgaacaagacaagaatgcccactcttacaaatcctattcaacagagtattggaagtcctagccagagcaatcaggcaagacaaagaattaaaagccatccaaataggaaaagaagaagtcaaactatctctctttgctaacgatatgattctatacctacaaaaatcataaagactctgctaaaaggcccctagaattgataaacaactttagtaaagtttcaggatgcaaacccaatgtacaaaaatcagtagcatttctatacgccagcaacacgcaggctgagagtgatatcaagagcacaatctcacttccagtcaccgtgaagaaaatgaaatacctagaaatacagctaacaaacgaggtgggccattctttgatgtttcatacaaaccactgttttaagcaaaccaccttgttgtgcaattgtgagaggaaaatgcagaaggagattggctgcaaatattaaacccagcatagttaggatttattttccttttgaatttcaagtttgaagccttgtctttgatttgcatggaaaagaaccagaaggtgctgaggggctgtggttcccaacaggattctggggcctgcagttctttccacgcagcctcagagctgagctggaagccagggggcaggcccaggaccatgtacagaggtgcacaagttaagagcacaaaggttggcaaatgcagatgagtgtccagtttaggcaattaatgaggctttggttaaagctgttctaaagctttagctgtaaatatacataaaataaagctattctataaaatttagctaaagctatagttaaactattctaaaatttatagggaaccaaaaaaagagcccgaatagccaaagcaaatctaagtaaaaggaacaaagttgggcacatcacattgccccagttcaacctatactataagactatagtaaccattaaactaaagtctcattaaactaaccattaaactacagccttttataagaaatcaatttgataaaagggaacaacataaaagtttatctcactgaaagccttgtgtaagaattcagaaattagaatcagagggaaaaattatatgcatttagctagtcaatgtcttttgattcagacaaatgtcaaggaaatctttcttcttccctgcatatttcacacttatttatgttttcccaaaaattattttggtgcagtttaactatgactattgaatatatgtgacctttctaattattaaattgctttggtagaataattttatacactgatctatggcatttctaataataaaaagcaagaaaatgcataatagctagatgtatgctagattaggaaagaaatgtgagaaaatatgtttacaaaacactgttactatagtgctgtgtccttaaatacatgttggtaggagaagcatcaaggagtccgctaaggtcacctcccaggttcccccataagacctcactctcatgcaagaatctattaacttgtgttctccattttactgtcaggtccttgagggagggattatgcccatcctgtgccaagagcatctagtttgtggcacgtgggagcacttagcaaatattttgttgaatgactaaataaggcgtttcatagctggaaacttcagaaaagggccatgtgcccaggcacagagggactggttacagaagaggtgccgtagcaaattagggtgatccagaagcttcttcccaggaaaagtcttcttgtcagggtgtcttttgggattgtattcatattggaagccctggggcagccaggttattgttcatcagttctgagcaacgtggatatgctccatatgaacatggaaggataaaaatagcatcctcctgtgcttgctgcaaaaggagcactcaagacaaatgataggcccaccagggatggctgaaaggtgcctgcatcttttaaacatctactgtggatttgaatgaaaatgcacataattataggatgagaaatttacttttgatctgggctggaaatagagtgtgactctggttgcgtgtattttttcagacaaaccctgcttgcaggcattctgcatttatctggggtttgcagaacgtttttttcctcaaggttcgtctgactgctcttgattttttcatcttttaatactgagcagatctaatttctgtacaatattgcgttcattacactgaaaattatgctatatttaatgatgcaagtaaattgaaaagtattggctaaaatctggaaacatttctctcttaaaattgctgtttccaaatgtcaactgaatttctagaattcatttaatgtccctttgtctaggttatgggagcatttccaaggtgattctcaatgtacacttttagcctcacatgaatagaaaaaaatcttattatggtgttttagaacaccagccccttaattctcccctacactcagagctacaggatataataacccaaccccacagatacagaggggcctgcctggctttaaccccagaagacatcacgtcaggttcggcagagagcaatacagaagcacttctataaaggctcttttgcagctttcatggccagtcaagagatgataaaacagaatggggaggaagtggcacccaacagggtgcagctccttcatctgcatagaataagcagagcctatttctcattcatgcgcccatgaaaatgggtgtttctgattggagagcatctcttttccagtggtaataaggggccaggactctcccacactgtcccccaccaaccaccttcagcactggcttcccagatctctgtgcagcactgcacaagccagggaagggaaagggcacgccagccttgagagaagtcgtgagtcacttcctccctcccatggtgctctagatgccagccacatggtcatgcatactaaccccaaaagaggccggcagaggtggttcatttgggtgaaccccaagtgaaatggaagtaagttttataaacagctatctagtctctaacccattccaataagccaggaaattataagtataaaaaagttaaatcctacatgactgaaagaaatgtatcctataagatcatctgttataggctctgtgcctgtctttttttctgcttagaagctgctgtatcaaaattacagaaggtctccaggtacctagtgacactctttgggcattcaagagcataactcacaccttccaaagttagattttgatcattttgcacctccatggatgggtagtgtcaaattcaggttctaacacaatcaacctttaagatcatgcagccctgtaggacagagatagccatccacaagggcttgcttctggatctcaggtggcaccactgctttctgttctgctaatgagtaaaactggctccatacaaatacatattaaatatgattcactgaaatatgaaaaatatatttcaaaaaacaaatatttaaatattcgttttttcatatataaagtttaaatgatcaaaaatgacatcaataatataaagacattggtagtgctttacttaatacgaaactctaaatcttatcaggactgtgtgcaggctaatctcaatgatctcaattatttttcttgtgcctagttttgtcactctaattccaagtcttgcttttgaagtaatataacaattttcttataaatttgttggaagtatcattttacaacccccaactggggagggcaggaaaatgccccccaaacacattcacatcctaatcctggagcctgtgaacatgccgtcctacacagcaaaagggacatggcagatgcgattacgttaacaggtcttgagatggggtgattagcctggattagccaggtgggctcaacaggagcacaatctctagtccttacaaagaggaggcaaggaggtctcagttagagagaggagatgtaacggtggaggcagaggttgagtggtgtgctttgtagatggagcaaggggacatgccccaaggaatgcaggcagctcctggaggccgaaaagataaggagacacattctcccctaaacctccagaaccagaaccagcctgaaccaatgcagctctgctaccaccttgatgtcagcctgcgagacccatctcagacttgtgacttcagaattatcagatacacttgtgttgttttaatatactaagtttggtgtaagttgttacagcagccataggagatgaaccccaacagcttcaagccagcctctctgagcacctcatggcctggctacctttttaattactctaggttaccatctgtggcagacattttcagtggccttacccagcacacttctccctttcctccaggggataaagatagtgttgtgctaaacaaatctgcgttgccagccatgtggattgcatcaatttggaaggaactttcaactcagtggtggaaaggagagggattgtttctgagaagcttttctacctcttgagacaaaaggaaagtttcgtccctttttttgcttctggatgttgtcatgtctagctgtgattcctggagcccctgcaaccattctgtgattggaaggggagctgcagaccctctgcagactacatggggaatgtctcggagcagagggtacttgatgccattgctgaaccactcagtcatccaaccagctgtagagctgctctagggacttcctgattcttgctgctgaacaagctgattaatacaactgcataggtacttgttgggcatagctttcaggccttccaggagtaaatgaggagcaggagaaaagtaattgtgaacaagagagggtgaaaggaaaaaaggttcatataaatcatagataccagaaacttcatacaatgaggaggaaaattacttccagtaacatcaatgaaataaacctttttatctatttcatggtttgtatttttatatttccttttatattctgttctttttactccactgagtgaaggagataaagtcttgttctgatgtgaaatgtaccatcagagtcacaagggcatcactggcatatgaaactatacctgtgccttacctgggcaggaaggagactgtttcactcaccttgtggatgagcatggccagtccacttctatgatacatacatatgcatacctttttatatgagaaatagatttctctagatatatagaattagccaaaattctatcgagatacagtaagttccaacataaagtttcttccagcttatgagagctgattgacacatctcttcctagtgatttcaagttggaggcttgaaatttataccacaaaaatcagcagctaccgctcatcagagctccccttcccagagccagttgttatgtcacaggaaaggggtccccttccagaccccaagagagggttcttggatctcacacaagaaagaattcagggtgagtccacagtgcaaaacaaaagtaagtttattaagaaagtacaggaataaaagaatggctactccatagacagagtagccctgagggctgcttgttgcccatttttatggttatttcttgatgatatggtatacaaggggtggactattcatgcctccccctttcagaccatatagggtaactcctgatgttgccatggcatttgtaaactgtcgtggcactggtgggaatgtagcagtgaggacgaccagaggtcactttcatcgccatcttggttttggtaggttttagccagcttctttactgcaacctgttttatcagcaaggtctttatgacttgtatcttgtgctgacctcctatctcatcctgtgacttagaatgcctgaaccatctaggaatgcagcccagtagcttcttcaagctgaataggcgcaatgatattcctgcctaacttctagggtctcttgtgttcagggtagagaggagctcagtcagaaagcatcagtatggcaagggccattcatgactcttgagttccaataagaggtgatatctggaagattaataagtactcagtttaagaaaatgttgagtaagcttattctgcattcttactcaaagagtacagcagcaatatattctacaacaataaagccaaataagtaaaattatcccaagtaaactaaattagaaggctttccatgaactaggcaactgttggaaccaagctggtagggggttgctagatcattccagtacatgcccagaattagaacactgatttagatttttacattacccatccctcttgtttcttctgagcagcagtcagagatcactggttggtttgcaggaataagcacggttagcctaaattgcaaaaacaaacttaaaaacaactgatgagactagaatctaataagaagtgtaccatagttcttacaacataacttttttgtttgcagtttcccatttttactaaagacaaatcagcaagacaaatttgctttattatacttggcctgattatttgtataaagtacaacaaggaaaattattttttacataagctctttttaaattggctttgatggaactctattccatagaagaaatcttagataagacttttttaaagctgagcccagccatgggtttctaccctcaaatacctctgagttgggtaaattcctttttctgagatcccaagataacttggggctcctggacctgttagaaagtgacattctttacttaccacaggtcagaaaccttatacagggactgtataataggcaaggtatgaggccagttttccaaacagcttttattggctctacaagtcaagtttgactccttaaacgaatgcaaactattccagtcaaagccctggtaaaataaccagtttctccaattgtgtcatgttgcaaagaaaacagattcttattgcacttatgcaaataactgtattgccataaattaagaatattcacaaatagtttccaacttctggagaaatcagatagagagaaacaaatatgctccagattttgtttacaggagtatagtttacttaattgctaaaaagctgtaaatagctcaaaagttttcttgactctgaaaagcaaaacaaaggatcagcagcattttaagcaaaaagttaaaaaatattactttagactttcattagtttagttcatgcagttaacttctgtttgatattcatgaacatttcagctctctatgagagttctgaaagttttttcctctattctaatgtcataatttccaaagttagcagaaacttgcattcaagagcacctgtcaaagccctatagctgattacaaaccacctttggaagatgatcaaaataagacaattgtttgtggatgacaaaagatgttagaacagccacagtcaaaaacacgattaacaaagaaatttggttacctttgtggcatacaataattcaacacaattataattattactgataatgtacactaagtcatatcagaattataagagttttttataattttagaagacataccaataacatttatacaaatacagcccaaagaaaaccaatcattttatatttgacagtgcttcctgtgtgacttttataccaaataagccaaatgtcactgttgcattagtgcattattgatgtcagacccaattcttagtaaaccttatagataaatatatccaatcttattcagtttgaccataaggtaagattcttataaaccttttataaccctttacaaatttttgtgaaagagcagatcataagcaggtttttgctctaagaaaaacctattatgcttttattccaatgtttagtttatggaaaagctgaaaaatgccactttaattttagtcaatgcagactctcttacaattaatttttcacaaaccttccataacttgcttaagccttcagcttcatcctaacttaaaacaatccattaatcctttaatctaggccaaaaaaattacatttccatgcctttttataatcttttaccaaaaacacatttcacttttcttatacaccttgtgtatagaactgtgtcttcactagtctcaaatacatgttatcctgttaactcttagcagcttttacttttgatgaaaaacctggttagtaagcaattttatttatgtattagatgtggggcctaggacccagacagaagtgcagataaggtctgactctctccagcgtttaacttcacatgtctcaggccttacctagaatctaatgctccaaaataaatggaacagttttcaaaagtcaaagaaacagtgtataaccttaaagcatttagtaaacttaatatttgatctgcataatgtagaccaaatatttatagttctgaagatatttttattttatgaataatctttaaaactctatttcccaaagattacttaagtcacatgaactaaataaaaggcattacactttttacttttctgacaaaatatttgatttaagtgcttattattaaaccaattaattaaagctctttcatttataaacatcatacacagaatacatataaatacatagaaagataaaagatagaggactcattttccaagccaggaattgaatcctgaacccaggccaccattgtgaaaagagaaagcatggccacatggttacaaggtcaagcccccaaggacatagaagacaagagggaaacctcatccagtgttttttcagggacctgtagcaaagtttagaactgaccagtttgctgggtcaccttgaacagcagtcttacaggtgtcctaagcccatgttctatccctagggacccctcattgtgacagaacaataaagaaagacacataaagcacaccagattggctacagcttaagactagcctcacaaatccttttttccattaatcaaactttacagaggagataaacagtgatttttaccattcattcaaccagtttgcacagagagagaaacagcggaaaagcattgcctgcagcagggtgggaaggcaaggcgctcagggaggccagagaaagacccacccattgcagcaacattgaaaagttcaggcagctgcttgtcagtagcaaagggatcttttccagcagtctcatcagctctcaagtttccccttttagggaagaaaaagctccccatgtcccacaatcccgtacatgcctaattctgtcactcacagctattagcaaagagcaaggcagattattccaaagagaatagcagttaacatcctgtagtaccaaacccgttcttagctgagagggactttaatgagagggactttaccaagaggggcctctaaacccctgaatcttagaaggcactctaaccctcctaaattgggcttctaacccaaggttggtcaagcatccgtgccttttatgaagaggggcctctaacccactcattcttaagagagactctaactcccctaagttgggcctctaattcaatcccattctttacctggctatatgcaccccacttacctgaaggccgccaatcagtgccatagtctctttcctttgggttgggggatctcctcagcatcgtcccttccatgttcaccagaaagatgtcaccagacaccaccacttacctagttagcctttgggtccctttatggtagccagaaaaatgttacagggaaggggtcctaatccagaccccaagagagggttcttggacctcgcgcaagaaagaattcagagtgagtccacagtgcaaagcaaaagcaagtttattaagaaagtaaaggaataaagaatcgctactccattgacagagcagccgtgagggctgttggttgcccatttttgtggttatttcttgatgatatgctaacaaggcgtggattattcatgcctccccctttcaaaccatatagggtaacttcctgatgttgccatggtacttgtaaactgtcatggtgctggtgggagtgtagcagtgagtatgaccagaggtcactctcatcgccatcttggttttggtgggttttagccggcttctttactgcagtctgttttatcagcaaggtgtttatgacctgtatcttgtgttgaccttctatctcatcccatgacttagaatgccttaactgggccgggcacagtggctcatgcccataaactcagcactttgggcggctgtggcaggtagatcacctaaggtcaggagttccagaccagcctggccaacatggtggaaccctgtctctactagaaatacaaaaattaggctgggcacggtggctcatgcctataatctcagcactttgggaggccaaggcaggcagatcacgaggtcaggagatcgagatcagcctggccaacatggtgaaattccgtctctactaaaaatacaaaaattagccaggtacggtggcaggtgcctgtaatccagctacttgggaggctgaggcaggagaatcacttgaacttgggaggcggaagttgcagtgagcctagatcatgccactgcactccagcctgggcgacagagtaagactccatgtcaaaaaataataataatacaaaaatgagccaggcatggtggtgtgtgcctgtaatcctagctacttgggaggctgaggcaggagaatcacttgaactcgggaggtggaggtgagccgagatcatgccattgcactccagcctgggtgacaagagtgagactctgtctcaaaaaaaaaaaaaaaaaaaaaacaaagaatgccttaaccgcctgggaatgcagcccagtaggtctcagcctcattttacccagctcctattcaagatggagttgctctggttcaaacgcctctgacagttacacatttgccagtacaccactgggaacaatgaaaggaaatacttggtttctactctcatcgatgattttaactttaataacttttggtattgccttatttctaatcaaaatgtaatgacatgactaatattttaatttgctaagtcagtctgctcagatctgctgaattgatctgctcaaattaattgctaatgctaatagtatgttgcaagactgaaggtttaaccacttgaagcatgcaaacttattttgtggatttttaaaacttattttatctctctatatgttaaaactatatagactatcagaaattggcattagggaattatttagctctctcattttccatagttccaggccttataaagagccacactgtgagtacagacagtactgaatctgactcacagccgcattctggaaactgctaggctgcatattgtggatcataacacataaccctggaatgaggccagatctaataaaactaataagctgcgccttgtttgacacatttcatgaattgaaagtgcaggagcctaaatgaaatcaaaggcccctttcagttggcaaagaacaatgagcctaaataagttaggattgatgagtgggcaattcaatcacctcctgcctttgggcgagtcattttaccctaaatgggatgctggttctcacttgtgaatcaaaaggggattgaaatgagggatttaaagtcacacaaaatgacttgttatcccagatgactaaagccaggaggtctgaaaccaacacttgcttgatgtgttttgcagaaatttccacacactaaagtagaggacacttgatccagagagggtggagtgaattaactaaagagcaatttatttactcttttatttatccatccatccatccatccacctatccatccagctatccatccatccatccatccatccatccatccatccatccatccatccatccatccattcacccaggtctctgtgacagaccctgagccatgctaagttctgggccagatataaagcagaaataaagaaagatagacctaacgagagaggcgaattgtaaacaagtgtgtgtgtgcatgcatgtgtgtacatgtgcctatatgtggtgttgggaacaaatgcctcaatgtgcaaaacactgtaaccctctttgtcatccgtaactgttctcttcttgctttggagattgcatctccactcatgaaatctgggagtggcagaagagaaggaggcatctgaagcccgtccgagggtctcagggcttcacttcccttactcccttctctccccagttgacatcacctgggtgtcagcagacgcttagttggcttctgatgcagagcagagtgtctgcaatctgcctcacgttgtcctctcttctcactcctacaaatgttcggctgagctccaaggtcctcttcacctggcccttggctgtgggcctcctcattgtataccttcttgaggttgccatggttagaacctgtctttggtctgttctcttagcattcatagcacctgctgactgttgcaggtttgtgggtgctggctgactcccaaagctcagctcacaccagtgctcctgagctgcatctgccatcctttccctggctttgagctggtcactgtcaggctctgctgtgacctgaaacttcttcggcccatgccctgagaaacaaagtacagcagggaacaactatcctctcgcaacatactcgggcaccccaggatttccctcagtcgtctccggttacctacagcacagacgcatgtgcacatgcatgcacacacacacacagtttccaccctggaggggagggtctgggactgtactgctggccgcttgctctccactcaccctgtctctcctgcctctgctgccccttcctgtctgggaggcactccctctggcttccctactccaactaggaagacaaaggaagatttactgaataggtaaatatttgggtacccacttaatgattattcatgtaattataatatactacttctaatgcttttatagtaaagtggcaataataatgattagcaagtaccaggcagtgttctagatggtttacatgaattaactaatacattatttaccataggcagctgatgtatgtactgttatcatttccattttaatgaggagactgaggtgagttgcccaaggtcctatcactaatttgtggcagaggctggggcaggatttggacttaggctccaacatgtacaccttaaccactattatgtggaaaggatgcagtatgatttcataaagaataaaaagatgaacatcaaaatggaaaaactggagaagtactccaggcatacagaagagcaggacacatctagcaaatatttggtgtatttggaactgaagatgtgagggtgaaatgttagaatgtgaagctggaaagaaaatggggacagattctggaaaacggagtacaacacagtgaagcgttgaggatagaccctgcacacagccagtgaagggcctttggtagatgagtgacatggacaaagtatttttagaagggagtgtctggctgcaacctgaagaatgagccagagaggagagagactgctatccagaggtcatttgagaactggctcattggttaattaagtcaacaaatatgaggtggcctctgtctcatgaattggtatgaaatgttatagagcaaaaaagaatggatggaatatgccatccagggctcacaagttagtgagggtgacagaatataaacaaatacataagcataataaatgccctcatagatctctacgcaacaggcactgctgttacagagggtttaattctccctagagaggacaggaagggctctctgagctgggtgcaaaggcatatcctatgggaataggaaacacatagaacacagttacatgactttaggtttacaattccataaaattgtgtgtttcaggtgcctgttatactactagtcctgaatagaaatgaaatattttatgagtttgcatataaaatatcctagttaactgatatggtttagatctatgtccccactcaaatctcaactcaaactgttatccctgtgtgtcgagggagggacctggtggaagatgattggatcatgagggcagtttaccccgtgctattctcataatagagaaggagttctcacgagatttgatggtttattgagattttatggtttaaaagtggcagtttcccctgcactctctctctcctgctgccaagtaagatgtgccttgctcccccttcagcttccaccatgattgtaagtttcctgaggccttcccagtgatggagaactgtgagtcaattaaacctctttccttcataaattacccagcctcaagtagtatctttatagcagtgtgagaacaaactaatacagaaaattggtaccagcagagtggggtactgctataaagataacctgaaaatatggaagtgactttggaactggaaaacaggcagagattcaaacagtttggaggactcagaagaagagaggaaaatgtgggaaagtttggaacttcctagagacttgttgaatggttttgaccaaaatgctgatagtgatatggacaatgaagtccaggctgaggtggtcacagatggagatgaagaatttattgggaactgaagcaaaggtcactcttgctatgctttagcagagagactggcagcattttgcccctgcccttgagatctgtggaactttgaacttgagagagatgatttagggcatctggcagaagaaatttctaagcagcaaagcattcaagatgtggcctggctttttctgaaagcattcagttatatgtgttcacaaagagatggtttgatattggaacttatgtttaaaagggaaccagagcagaaaagtttggaaaatttgcagcctgaccatgtagtagaaaagaacaacccatcttctggtgaggaactcaagctggctgcagaaatgtgcataagtaatgagatgccaaatgttaatagcaaagacaatggagaaaatgtctccaggacatgtcagagatcttcatggcagcccttcccatcacaggccttgaggtctaggagggaaaatagtttcgtgggctgggcctagggccccactgctctgagcggccccaggatatggcatcctgcatcccagctacttcagctccggctgtggctaaaaggtgacaaggtacagatcaggccattgcctcaaagtgtgtgagccccaagcattggcagtttccacaaggttttgggcccgcaggtgcacagaagacaagagttgaggtttgggagcctctgcctagatttcagaggctgtatggaaacatctggatatccaggcagatgtctgctgcaagggcagagccctcatggagaatttctgctaaggcagtgcagaagggaaatgtggcattggagcccccatacagagtccccactggggcactgcctagtggagttgtcaggaaagggcaactgttctccaggcaccagaaaaatagatcaactgacagcttgtgccatgtgcctggaaaagccacagccattcaaggccagcccgtgaaagcagatgcaggaagtgtaccctgcagagtcacaggggtggagctgcctaaggccatgggagcccacctctttcatcagcatgccctggatgtaaaatatggagtcaaaggagattttggagctttaaaatctaatgactgcccagccagttttcagactttcatggggcctgtggctcctttgttttggctaatttctcctatttggaatgggaacatttacccaatgcctgtacccccattgtatcttgaaagtaactaagttgttttttatcttacaggctcataggtggaaggtacttgccttttttcagatgagactttggacttggacttttgagttaatgctggaatttagttaagactttaggggactgttgataaggcatgattagttttgaaatgtgaaaaggacatgagatttgggaggggccggggcagaataatatggttcggctctgtgtcctcacccaaatcttatctcaaattataatccccatacatcagccgggtgcagtggctcatgcctgtaatcccagcactttgagaggccaaggcgggcggatcacgaggtcaggagattgagaccatcccagctaacatggtgaaaccccgtctctactaaaaatacaaaaaattagctgggcgtggtggcgggcgcctgtagtcccagctacttgggagggtgaggcaggagaatggcgtgaacctgggaggcggagcttgcagtgaaccgagatcgtgccactgcactccagcctgggtgacagagcaagactctgtctcaaaaaaaaataaaaataaaaaataatccccatacatcaagggagggacctggtgggaggtgattggatcatgggaccagtttctcccatgctgttctcatgataatgagggagttctcatgagatttgatggtttacaagtgcagtttcctctgcgctgtctctctccagccaccatgtaagacacgccttgcttccccttagccttctgccatgattgctagtttcctgagtcctccccagtcatgtggaactgtgagtcagttaaatctctttccttcgtaaattacccagtctcaagtagtattttatagcagtgtaagaatggactaatgcattgaccatgttcattgtgcaatgaaatgggtattcagcaaccatatactcgagtattttattaactcccaaacgaagacagaataatccacatattcagcagcttgattaagactcataggaggcaggggattttaagtagcaaatcaagcactgccctgtcttcacagacatgcaaacatattctgttttgttttgttttgttttgtttgagttggagttttgcttttgttgcccaggctggagtgcaatggcatgatctcagctcactgcaacttccgcctcccgggttcaagcgattctcctgcctcagcctcctgagtagctggaataacaggcatgcaccaccacgcctggctaattttgtatttttagtagagacggggtttctccatgttggtcaggctggtctcaaactcctgacctcaggtgatctgcccacctcagcttcccaaagtgctgggattacaggcttgagccatgcgcctggccacacatattgcagctggaacgtggtggcatagcagtctctatgtaagtggccatggaagatcacaacaaagggcagcagggcacaaagtccagagagccaggagcaaggggaattggtgatgctagaaatttagagctggaaagagcagaaaaaagagcatcctaaatagcgatgcttggtcttctccagcagtcatggaggagtcagggttcactgtgagaagagagacaccatttccacaaattgtctaatgagaatctggagaatgaccctcttattctctgtggatttgaattttctctgtaggcttcaatgagttaaagaaaatactcttcaaactacatactaagaagttcagtctttcttatggcaaataaagaaaacctagtaactttttaaaactctactttattattatgacttgagatgtttgtttctaaaattacaacccagtggactggctgtacatttttctatgtcatttgtatacaatctaaaaggtctaaataacttgattgtgaatactgtgtttgctgtaaaaaaaaaaaaaagagagagagaaaaaaaggcacacttagatgagtggcctacgggtaaactatgaaagcagagattctactacacagataataatttttcattaaaaacttgtcaaggtttagttgataaatgtgattatcaataaattttacatcctgttatttaatcagcttatatatgtatctacagtcattgcataaacatggaattgtctgtacccaaaatgcatttagaagtacattattgtaatacaaaagaagtttccagtcttttatgttcttatcccctagatttattattatacgcaaacccaaaaagaaggtgtcactttctggaaacgtattctgacctattttgaagtaccctgaatggctggcagacattgctccatgtgcagttttaacctgcgagctctctgggctgtgtgtgctgtgtccttcacgaatgacttctgttcttcaatcactgtaaacaaagtgacaggagcaccaagagagtttaagaaagaaaatgttggcatacaaaaagaatttttttctatacaaagtaaaatttaaagaatacagtgagccagacacagtggctcacgcctgtaaacccagcattttgggatgctagtgagggcagatcattttgaggtcaggagtttgagaccaacctggccaacatgacaaaaccccatctctaccaaaaatacaaaaactaggtgggcatggtggtgagcctgtagtcaactacttggggggctgaggcaggagaactgcttgaacccaggaggcggagcttgcagtgagccgagatcgcaccactgcactccagcctgggtgacagagcaagactccgtctaaaaaaaaaaaatcatcagttcgagactatagcagaagttcaagtatgaagccacaggggtctgaatggtggtattgacctacaaggcaggctgaaaatgacaggagaaggaattatatgtgaagaaataatggaagaatactttccagaactggctgatgaactgaacatggagaataacacgagggaatatgtgttttggctataggtttccagcatttgggacagtagaacgacatggacattgtcggaatcagagagcttgtgcggaggccaggattataggccgtaagttctgtttgagatgcagtttatgaggcctctaagtggatgtgcccaaagatttcagatacacgttctgggttttggaagagtcagaagtggcgaggcacattgcagagtcatttggataaagaccataggtagcatgagcgggtaaagcaaggaggtccttgagggaaactttgagggctgtcctcagttagagaacaggaagaggaagacctgggagtcagggagctcagagaatcacgcaagataacagggtgttcatgagctttgcactaagaaaaaataagggttggatgttcagcttgcctataatatgggaaacagatgacttttttttttttttttgagacagggtctcactctgtcacccaggctggagtgcagtggcacgatcacggttcactgaagccttggctcctgggttcatgcgatcctcccacctcagcctcctgagtagctgggaccacaggtgcatatcaccaggcccgtctgatttttaaatttttttgtagagaagggttctccctgtttcccaggctggtctctaattcctgggctcaagcaatcctcctgccttggccttccaaattgttggaattacagacatgaatcatagcacctggctgacaattattaaaactacaaaaacctgatagagtatatgcaatcaggtccataaattatgaaacacaagttgtgatgctagttgtttagtgtcaatataaaaattcttaaaaaaatgtgatggaagtatttacaaaggaacttgaactagcttatgaagagagacttatcatcgtcacttacaaagaccacactcctctctcacaaatactctagtcccgcgggctacgagtgtgctggcaaaccctcaggtcggtgagtcccactctttgtgagttcgcctggagagcaacatggggagagcgggagaggtgtcatgagcaggtgaggagccctgggaagaccctgttgttaaaaatgtcatcatggatttatccattaaggtttttatttcatttctttttagaaacaaaataccttttggaacgtttcagcttacaagctgtttgtatcttgcagtataactataattagataatctggttgctcctctccaatgaatgaaagcattcagctgtttaactgggtaaagtgaaaagaaaggagaggtaattttggtgcctggagtatctcaaggaggtaggcgtggagggagcagccgttgcgaaggttttggggagatgccagcaactctgttgcccatcttttggtgtgtgtagggaaggtgccaaggtgtgttgtgggttctcaggaagggggaggtacctggagggtggcaagggcactggctcaggtcttccctcctctgtggccagcagaggggcacgagggagccacccagcccctctgggcttctgccttctcacctgtagatagggcaacaaccacacccacctcacaggaatagagaaagctaggaacagtgcctgggtaacaggagggaatcaatgaatgtaagccatgaacaactgcaaagaaaccctctgttatttctattatttgagttacctgcctcatcctcccattcttctgcctcaggctcccaagtagctgggattacaggcgcccgtcaacacgcccggctaattttttatatttttagtagagatgggtttcaccatgttagccaggatggtcttgatctcctgacctcttgatccacccaccttggcctcccaaagtgctgggattacaggtgtgagctactgcgcccagctttttttttttttttttttgagatggagtctcgctctgtcccccaggctggagtacagtggcatgatctctggtcactgcaacctccgcctcccaggttcaagcgattctcctgcctcagcctcccgagtagctgggactacaggcgtgcgctaccacgcctttttgtatttttagtagagacggggtttcaccatgttggccagtatggtctcgatctcttgacctcatgatccacccgcctcagcctcccaaactgctgggattacaggtgtgaggcaccgtgcccggcccaaactgatgattctaccccaagatgttcactcctatacgttgatcttcccaggtcagcctgcacttcagactatacttaccaaattgttattcaatcatctctatttcccttgatgcctaaagtgtccagtccagactcagcctgcagagagggctccctcctggctccctgatatcacctgccagttcattccaactcaggccaccttaaccctaacaacgagccactgtatcttgactatgctgtgctcccctctgtgccatcactcagggggtatcctctgcccagaacactcacccctcctcatctcacagggctcatcaaagtccccccatcccaatgaaacattttcctgactccagcccataatgatctctcctttctcttaaccagagcttttttccacgtagccttggtatgtacccttcatttggtacttaatcacttgaaatcttacttaactttttgtgattgtatgattgtcctcttcagagaatagaaagggaattaatatcatttagcacatgctaaatggtatcatttcatccttataataaccccaggaattaggtatcattttgcaaatgatgaactaataatgcccagaggagctccgttacatttccaccagtcacagcatttgaaaactggtggatttcactacataccagtgatggctttgaacccgggggtgcctgattccacacccaggctgctctccacgaagacagagtgtcattgattcattctttcgacaagctgatcatactaaaatatgaatccaaggaaataagttatatttctctaacacactttcctttttttttcctacccactaactggccccatctctccctaacatttagcacaatgctataactattgtagctattcagtatatatattttttgctttagcaaaatttgattaagaaatataaagcatcctcagtataaagagctttaacaaattggaacaaatctctgaaaaatatatgcatagcaaaattgtatgctgatgtaagagacaacagtgccactatcataacaatttcttcttaaaattgcctcctggcattaacttcacctgaaataatcctttcctgacctatttaattctacttatttggtcgagtgtattaaaattcgcagtacattatcttattcaaggagagtttttgtaaaatagggccatgttttacaattaataccagtggtgaaagccacaaataatctgtttctaacagtctcaatttctaaaactctgccaagacttttcaggcctatcatatatttcttgattcgttatttatgaacacctgttatcctgaagtacagttattctccctctacctctgaccaaagtatactatttttagcattatacagatatgtgatcaaggaaagagaagctttgacaatgtatttcaatatgtattttactcctttttatctccctatggttaaaataaatgcagtttttaaagttttaggaaattcctttaactatatgacaagaggttgagtgggaatgttagaagctatgaaacaagggattatttctttcttatttattacacttgaaagtatcattctttgactgttaccgtcgggaacatacaattcctggataataaaggttaagtgtgcataaatttgagatctgcttacaactgacctttagctgtcttttagcctttttgacagaaacttaaaataaggttattccataaaataatttgattctccattctcaaatccagatttgttactcagtaattaatatcttccagctagacagagccatcagcatttgtagtaaaacagccagccatagacatgatgattaatttgggcagaatcatcacccatctaagttttagtctacccaaccataagcaaaatcaatatatgcatttattcataaaaaattatttctgtcttccgtttatatttgtcaatcatcttttgtaattgtctccataaggtcttacatagtgattgttaattttattatcttaaagtgtttgttttacttcatctcttgctattgtgaacttttaaaaaatattttcaaagttgtttttaatcgtgtatggaaatgctattatttttagtgcattgatttttttatgcaacaatgtttttacagagcttttaattgagcatgtctatagactctcagggtgtgctgtgtagacagccatatcatcctcaaatataaacagttcttttttttcccttccaatctttgcatgtacttttcttgtgttaccacattagctagaacctccagcgtagggttgaataaaaataataactttcttcttatctcctttctaaccaaaatgggaataatcctaaagttcaccatgaagtatgggatctgctataggtttctgctaagcgtttttattttttagtgaagaaattttatcaaaagttttatctgcatctattaaaattatcttatttgtcttcctttaatctaaaaatgtaaacatgatgttgaaaaattctggcatttctgtgatatggcctatttggccatcattcaatgtgcctatttgtttggatttcagtgagattgaactctatggtttcagtgttaaggttatgtcggcctcggtgagattgaactctgtggttttcgtattaaggttatgttggcctcagacagtcagctgtgtagcttttcctcttttcgattcttaaaaagagtcagtacaaaggggaaattttctactatttggaggttaagtaatttcattaggattcaattcctaatgtgttgttctttctataatggttttctcttgatcgctgggtgattttaaagtgttcttaaatttccaaatatatgggggtgttaaaagtttggctatcttttagttaatgatttgttattttatttaactttctgcagaaaatgtgacatgtatgacatagacatagatactttggaatttctgaaggcttgctttctggcttagtgcttattcagctttccaaaatagtccttatatgcttgtaaagaatgtgttttatctaactgttgaatgcaaggttctatgtaggtccattgagtcaaacttacatgtaaaatttatgtgtaaactttatatgaaaaagtaagcaaattatggtaataataataataaacctaggaaagtaatgtaaagggaccagcctaccaaatattaaaatcatttaaacagtcgtgataatcagatcaaaatgatactgttcacaaataaggaagacaggccagtgaaacagaatagaaagtcaagaaatagaaatttataataaggttaaatctccaatcactggagaactagtcaataaatacaataggacaactggatatgacctaaaaacaatccacagttggaaacttaccttacattttataccaggaaaagttacaaatagactagtgatttaaatgtaaagaaaataaatcataaaagtatgagaataaaccattattaatgctcttttctgactgtttctattctttatgctacacaatgggggaaatattcccaatgagactcaaaaatcagcatctataaaacattaacgaattcaaaaacatttttaaattgtcatggcaaaagaaaaaattgaaactcctatcacactcaagactaatttctctaatataaaagatctcttgaaataggccaatgcctcagtagagaaaaaatggcaaaagataagaaaatacaattctcagaaaaggatatacaaatgaccttcaaaaatagctttaaaaggtaattattctcatagtaagagaaataaaacaaccctgaaataccatttttaactataatattgttaaaaatcaaactctgatagcattctctttggacagacattagaaaaacaggtagtcatttattttttatagaaatgtaatttggtaccatctctgtgaagcacgacttggcaatatgtatcaaaatgaccaatatgtatacccattgataaaacagttcctcttccaggaatttatcctacaagatactttttttttaaaacttcacctttattttccacctttcattgtcattatattttgagtgttcactttataaactaattcagaactgaaggacattttcccttttatgataatctcttttaataagagaatttaattcacaaacactttttattattgcttacatatttggatccattctacgtaagtttttctctccatattttttcctgggaccaggaggatatttacccagccttcaagataaagctggtactgtttttttcattccctcttctctattctcttgaaagttcattttatttttcagaataggtattcttaaactttaatatgcttaattatttgataagtctaaagggtatcaataactttatcctcatctctttcaaggcagagatattacctttgacccagattaccttcctctcatcttccttgctattcctttctagtatcttagccccgctttataaacccgccatattgatgatttaaaaaactcataatagtcactgcttatttagtcttaattcattcaacaatttatctactattagctctttcatctcatctctttgtcctgtgttcaactcactttttaataaattttatcctttggtaaagttgatgatccaggggttaaaaaaatacccttcagtcttagtcaaatacatttgatttgtctttatttttgaatgataattttactaagttgtattgtagatgaataacttttgttctttgagcatgttgaacattttttacccttttctctgacctctattttattaatgagacatgtaatttccatctaatttggatcttttattgtaaactgtcttttgtttctagttgcttttaatcttttccttgactttggagtttcatagtgtttctgaaaagtgtctagatctgcattttccctctgaatatttacatctttcttaattatgaaaaattcccagtcattgttgcttcaaatattgcctttccccatgatctgtcctttcctctggagctcctgtgagtgactcgagggagcatcccgggtcttgggactccctgcgatcttttccattgctttacctccctgtgctgcctctgcattcatcttccagctccgtgatccagatctctaattctcttttcatttgtggtgaatttattgttcaacctagctactgaatttttaagttaatgatactatattttttctaaaagttatattttttaagtgaaatatttttccatgttaagtatttttaaattatttatcttgagattttattcttctgtttccagttgttacctccacagctcgtgtctatgctcattggtctgttgagtcttccttttggtgactgcattgccacagtggtggataatttttcattgcgagctcatctatattaggggttgcattttctgtgagtcccatgtacgagattatgcaagtgttcatgtttttacatttgctttggcccgggccccaagggtttccttttcattatctgagactaatgctttcccttaatttctgggcttttgatttcctaggtttccatttctcagaggaggtttgtcccaccgagagctttgtcaaacaccaggctgtctttctgtttccacagacagatttgaagagatttttccagtttctttttcacaggtgaggcagcccttcaagtgtcctggttgtatgcgggagtctcggattagttcccttctctcaccaaatgctctgtttttctgaagacattaaaaccttattcctagttttgtgacctaatctgatacttcctggggtctcctggcatcacctggaactcacttctgcaactggattttgtctttatctctagcatctgaggatttcctgagctcagctttgcattgggcatattttgttttttaagtctgtagcagttgatggatgaatccgtttcagtcttgtctgccatcttgcctgaaatttgcttcatttctgcccttaagagcatttttcatgttaaaaagtcttaattttagcattaagaatctcatgtgctatattacatgattttagttgtatattcagtatcactggaaaatataaggtgagaaattatttttagttattcatcacaactgcatcacacgtatttgaaaaataatagtacatctacttgtaaaatatattatatatattttctgtagacagtgattaatgcctgtctaatttgtaagacctcttgtaataactcaatagctgcctcaagggttgagaaacactgttaagtctttattttagaaacgtcacaataagtctaaaggaggtcataatatattaatagataattatactttttcagattaatttgtgtttctgagcaagatccttggtaattataacagcagtcataagaacagatattttcaatgaaattttaattgctaatagaagcaaggatatggaaagcataagagtaagtctctgatttgagtttttttcatgaaagtcattaacctctgatgtggtttggctttgtgcccccacccaaatctcatctcgaattgtaaactccacatgtcgagggaggaacctggtgggaggtgattggatcatgggggtggttttccccatgctattcttctgatagtgagtgaattctccttggccttccaccatgattataagtttcctgaggcctccccagccatgcagaaatgtgagtcaattaaacctctttcatttataaattacccagcctcagatgtttctttatagtaatgtgaaaacggactaatacaacctcactgtgtttctgatgtttcaatatagtatcactgtcttacacatttgttatggggataaatatttgacaggctaggtcaagttagaattttattgctgctgaccaaaggtcattgtaagatttaaaggtcacatagtaggtactatgtgatctttaaaaagttataaaacatgaattttaaagatatattttatgagtaaaaacgcttcacatttctggagctaatatcaatgtaatccaggtattcacatataattttaactgatatgtctaaaacattccttgttctgtgtccctctgaaagcaattttcttttaattctggatttcttaaactttaaagaaagattcctaaatttgaaaactactattttatgttaaataaactagttatcctaagaatgaaaaatttactgaaataccttaactgaaataaggtttgttgtcacataaaccttaaaaatgactatttgtgaatctaaattaacaaaaggagccagcaattgagaagaactcttaggaatagcagtcacagtgtgacagacacacacatacatatagataagggatttcctcatttatctcttcttcaaattttggctttaatcttaaattattctcagtatctttttttaaataaggacctcttattgttatttatatggacagattttaatatgtttgcatttgatgatactgtaaaaaacagaactgttgccagagttttaaaagtaaagggaattttttaaatgtacaactattagatatcaattttaaaactaccaaaaaactcagaatagccaattaaaccctaaatgatttctagtgaaatgagggaaaacacaagcacccggaagcctatcttgtctattataatagtcataaaatttctgaaatgtaaataatcactgcaatgctaataagagaaaaatagtattttatttacagaatacataaagttgtagaatacataaatttatagaaacttacatactccttcacctacagagtcagtgttaaacagccgaccctcggtgcagctgccctccctctatcctaggcacagccactcatcatctggtcattgttccttagcaggacagccctctcaaggaagttaacacagggcagattcaaaaggtcagaattaaaattcaatgcatgcctactgaatacctacctattgtgtgcccagcactcttctaggcaatgacaagctccctaaaaaaaagaacttaagaaactgtaatgaataaatgatgaggctacaaaaaaatcaaacagggtgatagacaatagtaggacggcctcacagaactgaaattgagatgaaaggacttgccagtgagaggtctggagaggagaacggtgtgcagtggactgaatcgtgccccaccgctcccctccaattcattatgttgggcaaatcccagcgtgaccgtatttggagatggggcctgtatggaggtaataaacgtgaagtgagatcataatggtggggccttaacccagtaggcccattgtctttataagaagagaaagaccagcgatctctccgcatgcacacagaggaagggccctgtgaggacattttgagaaggtgactgtctacaagccaggaagcgatctctccctccacagaactcgaatatgctgacaccctgatctccaacttccagcctccagaactgtgggaaaatacatgtgtgtttttcaagccaccttgtccatggtattttgttaaggcagcctgggctaagacagtgcgttcgaagagtccctaaggaggaactgctgcgggacttttccttagttcggctgaagacagggttttttgtcccatggccacgaaaattcatgctcacagacaatttgaatttgaatgagtaagacagggttttgttgggtgaaaaaggaagaaaaaggggaaacagggactctcgctaagccagagtccctgctagggtgcttcccaccagccatcctcatcccattttggggcttcccaccagccattcgcatcccagtttccacacaggaagaggaggggccaggctactccctgcggcaaatggtgtgaacctgtgtggctcctcccagtgggcaggaaagatggagagggtggaccttctccaaggaccgcctcccccctggctgtctcagaaccagcgaggtcaggccaggccagggattggagggagggaattagggtgacctgccagtgttgggggtacaacttcaccaggtcaattgtgctgtgctgaggagaacagaaaggagattcaaggattagacacaaagaaagtcactggtgaccttgataaaagcaacttcagtgaaatggtgagggagtgggttaaagagggaacgggaatgaggaagcaaggacagtgatgataaagaattctcttgaaaaactttactatgaagaataatgtggaaatggagcggggaccggggacagtgtggaaatggagccgtgactggggatagtgtggaaatggagcagtggcttttcagaaaaagtacttaaagagaagtcagatatattattaagacacacacatgcacacatatccaggtgtgcacacacacatgcacacacacacgcacacacacgcacacatatacacacatgcactcacatatatacacacgtgcacacacacgcaaacaagcgcctgaggataaacgtaatataagagggattaccaaagcctaggccaaattcatccactgaaaacaaaattattataataaaaaggaaccctggaagatatgtaaaaggaatttacatacaaaaaatcatcctgtaggaagtagaactgtatctactgtgttaaaaaagtttgtgtctcaaaatataatggcaaattgttattctattattttgttgttatttgttttttattgttttattttttctttggcatttttatcattgtaaaatacacataaaacttaccatttttaccatttttaagtgtacacttcagtggcagtaagtactctcatacagtgtgaccatgaccaccatctagttccagaactttttcatcaccccacatggaaaccccatgcccaataagcagccacttcccagaatcctttcccccagctcttaagcagccactttctgtctcttggatttgtctattccgaacgtttcatagaaatggaatcgtacagtatgtggtcttttgtgactgtcctccttcgcttaggaaaatgttttcaaggttcattcatgttgtgtcatgtatcagatgctccacatcctacttgttaggaaaatgaaaatctaaaccacaggaaataccatttcacacacattagcatggccacaatgaagactacagaaaataacaagtgttgacgagaatgtggagtgactggagccctcatacatggctggtgggaatataaaatggtacagctattctggaaagcagtttggcagtttcccatacaacacagcatttgcactcctaggtatatattcaaaggaattgaaaccaggtgttcaaacaaaaacttgtccagtaatattcatagcagcattattcacaataaccaaatggcagaagcaacccaaatgtccatctgcgaattagtggagaaatgaaatgtgttaagtgcattcaatagaacattattcagccattgtttcattgtgggcaggtctgtgtcaacctacccctaagttggaggaagctgagagactaaagaaagagacatacaaatctagttgcttagaaaagaaacttttaacagggacttataaacagaagccatgtctgtgtccctggcagtgatgagatgatatggtagatcctgaaccattaccccccagaagcaggacttatgtgctgtcagggaggggtacacacacttcagaaggagtggtcatgaatttgccctcacggtgggatttatggtaagtaggtgctcttatacgaggaggaatagataaactgaaaatctcagaggcattcccggaactgaggttaatcagaagccaacatggcagattagcacccaggatggagttgctttggcttccatgctccacccctctaatgcagctcttacagtctctcacgccctcctcttccatgaccatccctgagccttagagagagcgcttgatgttgtcaaactttagcagcagtgctttggcaatggaaaatagatcaggcccagtgggattcctaatgagggaggttcacaggctgttgaagcacctctagtcttcagaatacaatgacctcggttttctcaggagtaaaacagcgtgagatatataacattaataatttgcactcaaggattacagtcaaaagagaatttgtatcccagaacaacaacaaaaaagtacctattccattaaagagccaactaaaagtatcatgaagaaaattaaaacctggttcctctttagacttgcagacagcaaataattcaggatttagcccaaattgtaggtaaataataaaaactcaaaaacaatggtgagggctagtatccaaattttttggtctctagtttccccgtttctgccaaggataaatcataataggaccaatttattttcaaaataaattttggtctcattatacttggcctggttatttgcataaaatatggcaagaatagtgatcagcctgagctgcttatttattttttttccagacagagtctcactctgtcacccaggctagagtgcagttgcgcaatcttggctcactacagcctggacctcctgagctcaagcaatcctcccatctcagcctcccaaatagctgggaccacaggtgtgtgccacaactctggctcattttttattttttgtagagacagggtctcaatatgttgtccagactggtaggctctttttaagttgtctttgctggaacttttatgagaaattgtggattctgctttttaaaagcctcaaggctaggagccaagccaaggattcaccattagactatgcttgtaatacctatacaaattcctctcttcttgaattcccaaaatatcttaaggttcccaggcctgttagtaaatgacattctttacttaccataggtcagaaaccttgtaagagaaccatttagacaaggtactaggccagtctttcctagaaagaatttataaagtcaacctccattcctcagtctggtcaattctgaaaatatgccattccagtcaatgccttggtaaaataaccaatttctccaattatgccctgttagaaaagaaaacagattcttactgaacttatgcaaataaatatattgctatcagataaaaatactcataaatggtttccaaatttagggtaactcaggtagagagaagggtaaattttgttcacaaaattatactttacccaacctctaagctataaacagttcaaaagaaaaagaattttcttgactcttcatcaatcagagtggcagccttctaagcaggattacgtacatccaccttggaactgccatccacaagccctgcagctctttgtccgtcaggtgagagctgcctattgggcaccgtagaatccagcagctccttacacagttccagaatcagtcgaacaaaagccatatctgtgtctctggtggcagtgagacgaggtgtttgatccctacctgttgttctaatagtaaggcaacatatttgcaatgacaacagatatttgcaaataatgtacaaacaggtcataaaaagaactaatgaaggctggccgtggttcctcatgcctgtaatcccatcactttgggaggccgaggtgggtggatcacctaaggccaggtgatctctaataaaaaaaaaaatctctacttaaaaaaatacgaaattaaggccaggcgctgtggctcacgcctgtaatcccagcactttgggaggccaaggcgagcggatcatgaggtcaggagatcgagaccctcctggctaacacggtgaaaccccgtctctactaaacaaaatacaaaaaatttagccaggcgtggtggcaggcacctgtggtcccagctactcgggaggctgaggtgggagaatcgcgtgaacccgggaggcagagcttgcagtgagccgagctcgcaccactgcactccagcctgggcgacagagcgagactccgtctcaaaaaacaaacaaacaaacaaaaaacaaaattaactgggtgtgttggtgcgtgcctgtaatcccagctactcaggaggctgaggcaggagaatcgcttgaacccgggaggcagaggttgcagtgagccgagatcgcaccactgccctccaggctgggcaacaagagcaaaactccatctcaaaaaaaaaaaaaaaagttaaaaaaaaagaactaaacagaagataattttttgtaggaaagaactgctgtggtcagtgatcttggaggatatgaagatgtagagataatttcttttctctttctcaatctctctcactcgctcaatctttcatttgacttttgtctttcaattgctccgtcttttttctcttttctcataacttttgtttttcaaaattttgagaataggaattatgcaggtactcagtatttattgtttgaaggcacattataaaagaaaagtgggaaaaacaaatctgtaagttacttcagagagacacttaaaatctaatgtcagaggaaggaagaaagcagcaggatagaaaagatgtgataaataaaccagttatagcaataataatattatattagaatcagacaaactgcatcaataatgataaagaggataaggacataagggtaaattcaacaatttaccaggaggttataataatgctgaacctcagtgtgccaaacaacaaagcctgagaggcagtgccgtgtcatatagccagactgcttgggcttgaaacctaattccagcactgactagctgcagaccttaggcaagttattaaatctctctctgtttcaatttcctcatattgaaaattaggatattaataatgcctacttcttccagtcgcttgaggatcaaatgaactagcacagtgttcacaacagtgtctggcatcacaaacattggtgttattattgttgctgttgttgatattagtattattgccccaaaacatataaagaaaaaatagaattccaaggaaaaatagacatgtcaacagtcttagtagaagacttttaactttatttatctctcactaagataaatttaagtttggaaatgtttaaggtagctgcaataaaatgtttgaacaggatgtcttagcttaaagtcattacaaaaaagtaaatagaacatagtgtacataacaaaactacaaaatacaaagaaaaaagtaaataaaaaacaacaaccgaagaccaaaaaataagatgacagaagttaaatgagaccataaatgtcaatgacttaatgtattaaaatacaacatcttaggccatagtaaaatacaaaatttaattttgtgcttacaagaaacacttgtaaaagtgtgacaataagctaaaagaattagcaaaacataccaaaaatgttttaaaaatatagtatagatgacatttttattatgaaattagtatacaatgtaaaattatccataaaaacattgggcctttaggacctaagaaaaaataattatttcaaattgtacaaaataatgttttaaaacatttccaaatgcacataaatctctgagaaaatatatattccataaatgtatgctgaataacataaattttataaatataaaaggaaagtaaagtaaaactgatgtctgtataaacctacattagggatttgttttctatgctccagttccaacagaggatctggacattgcctcttccctgcttacttccttgattggctggactccctctacatccccagcttctacctgaacatgcattgtaaatgggaagtctgtgagcagactgtagacaggcctgctgcttggggaactgtaggaaatttgattcaccccaacccacagtaaacactcaggaagatgatgggttcattacgagttactcacatccaggggtaggcaggcatgtggcgtgaaactccagaatgctgagagagagctggaaggtacaaaaatctcccactaagtggtattacaattttcggttacaaaatcagaatatcactttttatcccataaatatatattaatatatatataatgtatggactatatatagggaataaatatatgtataatttgtctctacatagggaatatgtatatatgtaatttatcaataaaaaatttgttaatctcctactaatgtaaaagggagtttctcaaaggtcttgatgggctcctcacttgattagaaggtggtaactagaagctgggtgcattcataaggatttgaaaaccaaggaaattatcacctcttgctgggaaggccccatcccttgctctgtgtagatgtattatacctgcagtctgagtctgtgggctcatttccatgtacactctcaccttcagctctgccgccttgctggcagtagctcaggccacaggtaccctggacagtggagggctcaagcaagaccaaatcttctacaggtagatgattcccaactcacaatctcttttctcaaccccagagttttagttcccattccctggtgctgctggatgctactgccaaggtctggacaggggacatggagggacactgagggtgatgggtggagatgtgggaaagagatttgtctccgctcccagaagaagcaggcaaagggaggttgggatgttttgactttgaggtgtcagtggtcccaggttcagcccactctttgtcctctccatttcttcttgatgccctgaatgttctacctgtcatccaggctccagtgaacaagccaggaatcatgcttgacctctcactctcctgtttgccccaaagaaggcatatgcctcccaggaacgtatgaacatgcacttctgtagctttcttcttagaaccttgggcaccaatctttttcagctgtttttatttctttcattttatttttacgtggatcttttcagcaaacattctagaggcttcttgaatcctattcaatatcatacttgagccaaatggtaacgaattaacaaaaaggtagcaaattattaatatgctgtcaatgtgcattgtatgtggatgggagatttaactgttaaggtctaaaggtccatgattttaacctcattgctcattgattcaggacatgatgacatacttcaggtcattagggggatgggttaaggaagtcttcctgaagttctaaagagcgtgcccctctggagtgggtgacagctgcatagcttgtctgccgtgctctgcccgaatgctgttttcacatggcgtctcttctttctttactttcaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaagtaagtgaaccggtgaaaaagcatcactcagtttatacggtgttgctttttgacaacttgctaattaagcaataaaccatgacagactgaggtgatccccagttttgcaggaattttcataaattgacttaggaggccagacaacccaaatctccaaaaatatatcccatcatcaatatttcactatggcttagccacataaataaaccaaattccatggggtttgtgctaatttaaaatgcctcacagtaatgacataagcattaacattaacttacgcatccagaggtctttacctgctgctgctaacttccaagtcttttttttgtaaatggcatctctaatttttaaattataaacaccgttatgttgagtatatttgaggtagtaccattcataattttaaggaagggaagcccagctgcataggtgaaaagaagaatgtttttaaatacctgaaacttttaatctacaataggtaagctgggtgactctggggtagccctgtgattggctttgtctgtgaaatgagattgtccttcctttctgcatgcaccttgctcacaacattgcacggccccttggactggttgtctaagaacctgaggttgtcccacgtgacagccttctggggttccagaacactctctggccattcttaccttgctgccagtagagccaccctgatgggcatgcctggcatccactggtacaggctcaggaagaggatggcctctcctcaagtcaaggtggcagggctggcccctctcaccctcaccagcacatcccctccccagccccagaattgcccacctgtcctgcattgctactgctgctactgctactactaattaaaagcagaggatcagtgcctcctctgaacactcattctgcagatgagggagaccctacctttttctcagccagagctgctccaggcactttcaccccctggatccaggcccaactgcccatggcttcgaggggtgaggaggcccctgctccccccgccccaagttctacctcatcttccactccaggatgggcagcttcccaaaatgattgacaggacgcttagctagtcttctaggttggggaaccccaccctcactggctcaggtgagctcttgccgtgtgctttcatcagaacaagaacaaactagctcaacatagggtcatctcccagagtctggattatttaatcgtatccaaggtcaccatttttattcattcattcgaatttatccattcattcaaatgtatcatgatcaaaatgctagatttccacagttctgctcttactgcttgcatcaaatcaactctgaaactctccctcagatctttgaggtctccgtagagatctgtaagtgaccacaccacatttccaccatgacagacagtgaaaccaaaccaaaggacggtgctacctgatgtgcgagtaacacagagagaaaagagactctgaaaaggggcttattaaatagcagcttgcttgcctcatccacagctgcaggaaggcaggctccttaaaggctgtcagggagggtgtagcgtcccgagccacgttaaaaccttttccaaaagtaatttcttctctcagatgggtcacatttttgaatacattaaattctacttgaactgctacatttctaaaggatgatatgtagctttctctgataaacaagaaaggcccagaatattctccgcaggaactatttgttcttttcctctggcagaatagcagcaatattcggacatatatcctttttttttttttaaatcaatgcttcatgttgggatcactgccttctcaggggtctctccctcagagtccactggaagacactgataggcagaaaaggaattgctaagtaatattttgattatgttgtctgcaattaaagcataccacactggagttttgcaggccaaggtaaagtgattttcaattttgtttgatctgtattttgaagatacataaatgagtaaagcgaggagtcatgtgactaaatttacagtacacacatgctagaggtcatctgccgatgagcgaaaacgttatcaagaactcagtaaacatgatttgtcagggaaaattaactagatatgaatttgatgatttagggttccggaagcaatgacaatttatcttggttgatgccattgcgtggctttcagcgcttctgctattcgatactgatcctgagtgtaactgctccttccttctcaatctgtttatgtcactaaaagcagacttttctcaagaagaaatgctgattacttatgtaaggtcatgcacagttccagcacagtgtgaaaaatattatgtgcataaagaaaatctttgaggaggaattctgaaaggaggctaacaggatctagaaaagggctgatgtacataattgacataacgtataacatctctgtgtattttattttcacaccatacccagtataattttgactctatccaggggcaaaaattaacctcaccattaccagcaagcagactagaagtttttttttttttaattctaactaatatctatgaaaacaaagcaaaatgtataaactcactgtgaggcagtgagctgggattagctgcccttgtatttctggaaactgggttgatttcaacaaattagaaggctgataatactggaatgagaaattgacacatttagtggctctggggtttctaatatgataacaaacaagaatccaccgttctttctcctactgctgcttggttcaagcccccaagttctggaataacccacaccgtgggtctcggacacctatttcactgacgttgttttctggcacaactactgctgctcccttttccctcccacctttctgatttccatcttgagttattttgggtcagaaactccaaaatcatgctgacataaagtgctcagggttggtgatggagcattgattgctgggagcagcagcaaaacctcataggggaggctgagaaaagagcagccctcttacttgtctggatcggggattacagattcacatttactccatccagtaggaaaagacaaatccttctcaatccatcagagtgaaaccaggaggcagtgtctggaatctccgcatacgaaattcagaaggggattcttccaaaacagcggtcaagagggcagagaggggccaagagcaaccagcaaactctaacaatctctctcctcaataaaagtgagaacagtagcaacactgcagccacagggggccatgggaaaaatctctacacacagggaaggaagtattgtgcacaatcggaggaaaagaatacctcaacaacatctggcatatgaaccagaagaaacttgtagaaacttgtttgacatcctcaggattcaggaagacgtggcctctgagaaacagaagcagaaatccagaagaggagattagactcaaataaaaagaagtccattttgaacaggacaaggcaaactgaaaatgccgtagtagaactaaaatctccatagaagtatagagaataatcaactgcacaagatcaattataaatgcaacgttaaggcgctctctcagaaaagacaagtgtataaaaataaggccagaaaagatattaaattggaggacatagaacacaaaagagttaaaagttagtgttcccaagaggaactatcagagcgacaggaatagcaatcataatggcagaggtgattcgaagagatgttctaggaggaaaaattatctcttattacgcaggtagaaaatacttgcagcaatctaaagaaaatcagtgaaaacagactcaggtggaggcacaatttgccaaaaactttaaattataacataaagaaaaatccttcaaacgtctggacaggggaaaaagcaatacaacaacaaataatactgaggctaagattttttgcaagagtaaattccagacaacagagcaccttttagagaaatggggagaaacatcttgggcgtgattttaccccggtcatgtgaagaaaaacactgtggacgcagtgactgcagtatccctctgtccttcatccagaaggtgaatggggctgtgctccagctcacagcaagtaaagcacagtgagagtccccaagtgaggaggacagtgtagtgtgaaaagcagtcagcactaaacctagggttatgtctaaatagtggagggaaaagagtttcaaagccacatgaagtgttgaatcataattttgcagtaatgactcttaaaaatcccaggaaaactggggtctacaccctcaaagtcaatgcagaagataaaggtagttaaacagagtctgtctattaaaaggacaaaagctgagtagacagcaaggaagggctaagaaccaaaagcacaaaataggatgaagaatgtaacatccaatagatcagctacgaaaattaactttacaactgaaaaaacaaaatctgtatgtaaactctctaaaaaacaaaataatacttaaatatgttcaaagatatattggaataaataaaaaagcagaagtcgtgattttaattttagaaaagtaaaatttaattgtaaagagttttcaagtgtataaagaggatcaatttataatgattaaaatattcacaacaaaaatttaatagtcatggcccactgtgtactgcaaactatgacatcatatttgagaaagaatcagctgctactcatcgttttcaccccggaaggaaggtagacttcttgactgagagctaaaaagatccctgtccttcctccacttcctgacctttgactttaagatctaggatcttcaccaacccaagtgaacagccttcctgctgtagcaccgcttcccaagcttcagtatgcatccgcggaccttggtaaaatgcaggctccagatcagcagatgcgaacggacctgagatgctgcatctctgacaagcccgtggtcgatgctgttgctgccgggctgaggcaaggcctgctagggcacagtgagtgcttggacgccccaggccccaccaaagagtcctggacacgagagccaggcgtgggacatgggtgggaggggaagagatgaatgctaattttctcccttgtatgtgggatcaggagatactgcattgttcataatgtgcatgattagagaaacacaactttaagattttaggccttaaatgtaaccattcatggattaaaatagatagtatgcatatgaggtacaagtgaaagaaaaaacactttcagtaaggcaatctttttttaaagaaagccaaggtaacttgtaaaaaaatagaaatacaacaagaggacaaaaggaaaaccaaataatctgttgtttccacgaaggattgggagaaataattcactagtcacaaggaaaaagtcttgatttggaaactcctttgaaagactggttttagcagggactgccagtcacctcatgttgattagaatttaactcccctccacaaacataccttcttccccactaattaatgatcacataaatactgttcactgcaagtcccacatctgctatgattacttttctaatacaacttgtttttctcagcattgataattgcctctcattttgcatacttgatttttatatacttcctaattttcttcaagtattacaagatctgtcaaaagaatattattttcaaaatgttcagaacattaaataacccagatttatctgacttcatctgaaattaattttatttccctttctggagacattcactcttccatcctccatccatccatttgctccaatctggaccacatattgtcttggcctgacacttcctgttactccttttttatgttcaacctctttccttagctctttgtcttgttttcctcatcactgttagagtttgcatcttctagtaatttccgggaagcatatgaaaggtatattttttagttcttgcatatctgaaaattctatcatcaagcttgattatgagtttgctttgttgaaaacccttttcattcagaacagggaggtcatgtctctatcgcctccagagtcttatgttgctttgaaaatcttgatgcatctgaatttctagtcatttgcctgtgacctattggcctccaatctctgaacatttttgaatctttatctctggtgatatgaaattttatgtggatatactttaatgctttttttttttttatcaattttcccaggaaatttcaatttagagacctatgtctttctgcactaaaaactttttatgtgttacttctttaacagtatcttctctctgttttctcttggttttctgatgtaattccagccagtcatctataatgcctcccagtggattctcttagttctttatctttttgttcattttttcctactctgtcgcttagttctatttcctgagaaatgtccttgactctatcttccgaaattgtgaatatttcactttagttattgtaactttcctttcctctgactgttcctttttttatactatttggttcttttatgtttattctcttatctctctgtgaatatttattatagatttgtagcgcttttctttgtttggggtggggggtatttagcagtttctttttggcttcctgacttattatttttttgacttattcagtaaaaataaattttccctttgctaccatttcagactttctttatcctgcttatagatcaacaggtaatatactggctaagagcatagcctggaatcagactcaccaattgaccaacaaggcagtacctctatgactctgcaagaatctcagcattactgggcttgcagtgctcccagtgcagatacagcttagacaacaatacccaagtcctttcgaatatctgaaaagccttccaaaacaggatagctataaataagcccagactgtgaagaccgcaatacctaacttttcaatgcccagacgtcaagcatcaagaccatccaggaaaacatgaactcaccaaaaaaaaaaaaaaaaaagtaagttagttaccaggtaccaatcctggagaaatagagatatgtgacttttcagacaaggaattcaaaatagctgtgttgaggaaattcaaagatattcaagatgacacagagaagaaatttaggattctgttagataaatttaacaaacagatccaaacaaaaagaaccaagcagaaattttggagttgaaaaaatgcaatgacatactgaagaatgcatcagagtcttttaatagcagaattgatcatgccgaaggaagaattactgagcttgaagacaagctattggaaaacacacactcaggagagacaaaagaaaaaagaatataaaataatgaagcgcacacttacaggatctagaaaatagccccaaagcggaaaatctaagagttattggccttaaaaagaaggcagagaaagagatggggtagaaagtttatgcaaaaggataataacagagaactccccaaatctagagaaaaatattaatatctaagtacaagatggttataaaacaccaaccagatttaagccaaagaagactacctcaagacatttaataattaaactcccaaaggttaaggataaagaaagaatcctaaaagcagcaagagaaaataaacaaataacattcaatggagccctaatacatctggcagtagactattcagtagaaaccttacaggccaggagagggtgtcatgacatatttacagtgctgaaggaaaaaacttttaacctgtaatatatccagcaaaaatatccttcaaatatgagggagaagtgaagactttcccagaaaaacagaagctgagggatttcatcaacacaagacctgtcctacaagaaatgctaaagggagtacttcaatcagaaagaagaggatattaatgagcaataagaagtcatctgaaggaacagaactcactggtaatagtaagtacacagaaaaatagaatattatagcactgttattgtggtgtacaaactacacttaagtagaaacactaaatgatgaaccaataaaaataactacaacaacttttcaagacatagacagtataataaaatacaaatagaaaaaaaagttaaaaagcagggggacaaagttaagatgggggttttgattagtttttgttttgcccattcatttatgcaaacagtattatcagcttaaaataatgagttatgagatagtatttgcaatctcatggtaactcaaatcaaaaaacatacaatggatatacataaaataaaaagcaagaaatcaaatcatatcaccagagaaaattaccttccttcactaagaggaagacaggaaggaaggaaagaaggaatagaagatcacaaaacaaccacaaaaccaaaatatcaaaatgaccatagtgagtctttatcaataataacattgaatgtaaatgcacaaaaatctccaatcaaaaggcacagagtagctgaattgatttaaaaaaaaaaaagacctaatgatctgttacaaaaaacacacttcacttaggaagacacacgtagactgaaaataaagagatggaaaaagatattccatgccaatggaaaccaaaaaagagcagaagttgctatacttatatcagacaaaatagatttcaagtcataaactataagaagaaacaaagatataatgataaaggggtcaattcagcaagaggatataacagttgtaaatatgtaagcacccaatactggagcacccagataggtaaagcaaatattattagagctaaagagagagacagaccacaatacgataatacctggagacttcaacaccccactttctgcattggacagatcttccagacagaaaatcaacaaagaaacattgacttaatctgtactatagaccaaatgaatctagtggatatttacagaacatttcatccaatggctgcagaatacacattcttttcctcaacatgtggatcatctcaaggatagaccatatgttaggtcacaaaacaactcttaaaacattcaaaaaaattcaaataatatcaagcatcttcttgaactacaatggactaaaactagaaatcaataagagaaactttggaaactatacaaatgcatggaattaaacaatatgctcctgaatgacctgtggatcactgaagaaattaagaaggaaattgaaaattttcttgaaacaagtggtaatggatacacaacatgcagcagaaacatgagatacagcaaaaacatgactaagagggaaatgtatagctgtaaggctacatcaaaaaagaaaaacttgaaataaataacctaacaatgcatcttaaagaactagaaaagtaagagtaaaccaaacccaaaattagtaggagaaaagaaataataaagaccagatctaagttagaaaaaaaaaaagacccaaataaataaaatcagagataaaaaaggaaacattacaactgatatcactgaaattcaaaggatcattggtgggtacaataagcaactatatgccaataaattggaaaatctagaggaaactgacaaattcctaaacacataaaaacctacctaggttgaatcataaagaaatccaaaacccaaatagaccaataacaagtaatgtagacaaagcataataaaaagtctcccagcaaagaaaatcccaggactcaatggcttcactcttgaattctaccagacatttcaagaagaactaataccaatcctactcaaactattcccaaaaaaaaaataaaggagaagagaatacttccaagttcattctataaggccagtattatcctgataccaaaaccagacaaagacacattaaaacaaaaagaaagaaagaaaacccaagctaatgtcactaataaatattgatggaaaatcctcaacaaaatactagcaaactgaattcaacaacacattaaaaagatcattcatcatgaccaagtgagatttatcccagggatgcaaggatgttacgatatatgcaaagcaatcaatgttatacagcatgtcaacatcatcaacatatgaatgaaggacaaaaagcctatgatcctttcaatttgtcctgaaaaataaaaacaaatgtttaacatcccttcatgatgaaaacccctcaaaaaactgactatcaaaggaatatacctcaacataataaaagccacgtacgacagactcacagctagtatcacactgaatggagaaaaactgaaagcctttcctcctaaaatcaggaacacgacagagcgcccactttcaccactgttattcaacgtagtactggaagtcttagctagggcaatcagacaagagaaagagataaaggggatccaaatgggaaaagaagaagtcaaattatccttgtttgcagatgatatcatcttatattttgaaaaacctaaagactccaccaaaaaactattagacctaataaacaaattcgtaaagtagcaggatacgaaatcaacaaacaaaaatcattagcatttccatataccaagagtgaacaaactgaaaaagaaattttacaatgtagtcccatttacaatagccacagataaaactaagtacctaagaattaaccaaagaagtgaaagatctccacaataaaaacttaaaacattgatgcaagaaattgaagaggacaccaaaaaatggaaagatattttatgttcacgaattggaagaatcgattttattaaaatgtccatactacccaaagcaatctacagattcaatgcaatctctataaaaatacctatgacattcttcacagaaacagaaaaaaacaattttaaattttatatgaaaccgcaaaagacccagaattgtcaaaactatccgaagcaaaaagaataaagctggaggaatcacatcatctgacttcaaattatactacattatggcataaaaaacagaagcacagaccagtggaacagcatagataagagagaagtcagaaataagtccatacatctacagtgaactcatttttgacaaaggtgccaagaacatacactgggaaaagaaaatctcttcaataaatgctgggaaacctgaatatccatatgcacaagaatgaaactagacccccatctctcaccatatacaaaaatcaaatcaaagtggattaaagacttaaatctaagacctcaaactatgaaactactacaagaaaacattggggaaaatctccaggacattggtctgggcaaaaatttcttgaacaatacctgacaagcacaggcaaccaaagcaaaaatggacaaatgggatcgcatcaagttataaaccttttgcatagcaaaggaaacaatcaacaaagtgaagagacatctcacagaatgggagaaaataattgcacactatccatctgacaagggattaacagctagaatgtattaggagctcaaacaactatacgaataaaatctaataatccaattttaaaataagcaaaatatctgaatagacatttctcaaaggaagacatgcaaatagcaaataggcatatgaaaaggttctcgacataattgatcatcagagaaatgcaaatcaaaactataatgagatatcttatcccagttgaaatggcttttatccaaaagacaggcaatagcaaatgttggtgaggaaaagggaaccctcatatgctgttggtgagaatgtacattaatacaaccactatggaggacaatttggaggttcctcaaaaaactaaaagagagctgccatgcaatccagcaagcccactcctaggtatatactcaaaagaaaggaaatcagtatatcaaagaaatatctgcattcgcgtatttattgcagcactattcacaataaccaagatttggaagcaacctaagtgtccatcaacagatgaatggataaaaaaaatatggtacataaacacaatggagtgctatttagtcataaaaaagaatgagatcctgtcatttgcaacaacatggatggaactggaggtcattatgttaagtgaaataagccaggtgcaaaaaagacgaacttcacatgttcttacttattttggggtgctcaaaattaaaacaatttaactcatggagatagagagtagaaggatggttaccagatgcgaggggagtaagcggggatggttagaaggtacaaaaaatagttagaaatagtacgacctagtatttgctagcaaaacagggtgactatagttgaaaacgacttaatcattcatttttaaataactaaaagagcataattggattattagtaacataaagaataaatgctggaagtgatgaatacctcatttaccctgatgcgattattacacattgcatgcctgtaacaaaatacatattgtaacctataaatatatatacctactatgtacctacaaaaaataaagcaaaaataaattaaaatacatacagaaaaccaccatacaattaagagaaccaaaaaccaaatgttggttggttcctttaaattacgaataacattgataaatatttggtaaacttagaattaaaaaaattaattagccagatgtggtgatgccgcctgtagtcccagctactggagtgggaggctgaggtgggaggatcgcatgagcccaggagctcagtgttacagtgggctgtgattgggcactgcactcccgcctgggtcacagagtgagactctgtctcaaaaagtatatatatataactaaatttaaaatgagagaagacagaaataaccaatatcagaaataaaaaaggaagtgtcacacaaatcctacagacattgaaaatatcatgatagggtattaagaacaacttatccctaaaactttgaattgttcatgaaatgatcaaggtggaaaatataacttaccaaaactgacacctgaaaaatagaaaataagttaaaatacaaacactaatacaacaaatgaagaaattaagtcagtaattaaaatcccccacacaacaatagctcaaggctcacatagcttcactggttagttgtaccaaacagctgaagaaaaaaataattgtcattttgtacaaatttttccagacaataaaactggagaatacacacttcaactcatttcataaagctagcataaccttgataccaatattcatggatattataagaaaggaaacttccaggacaatctcactcataaacatcaaggaaaatttattaaacaatataactaacaaatagaatccatcaatatataaaaaatgataatacctcatgacaaagttggttttatttcaggagtataagactggcttaacactagaaaaatcaatcaagccaatttacaacattaatgaattaaaaaatgattatttaataaatggtgaaaaagcatttgataacatttaacattcattcatgtatttaaaacaaactgagaatagaaaggaattcccttaatctgatacagggaattttatcaatcagaataaactagtttacatttcaataacaaccaatcccaaaaatcttaggggcttaaaacaatacattacttaaaacatgaacaatatagatttctgactgtgcaacctgtctgttgcaggttagcagcaaggttctgttcattgtcattgcttagggacccagcctgatagttgttgctggttcagtaccacaggaaacaagagctcagaaggtccaccctggaaggggcacatttcacttctattcactattcattggccagacatagtctagggcccatccaaccttaacagggccacaacgtgcaatcctacaagggcattatgaatacattttacagcccctggattctgttgtcttcctgtgaagagtgttgattctaattctggcagacaattaattggacacagaccccaaaccttgtcttctctgtggtggacaacagctgaagttatttcattttcagttttttcatcttgcagcttttgctcgccatctgggactactgggaatctccccatgtgtgtaattctaagaggtcagctaaggcagagcttacatgcaaatttcagtttacaccctctgcgaggccctcgcttccaagatcccctcttccaattttctacctgctcttccagcccagaactctctctccaagtcagtttacctgctttctgctgccccaggccacacaacttagctcgtagggaaaaagctttcaactcaccttatcaggtgcatttccagattttaagggcagactcctctccaaagtcggcctactttaaattctttggcatggctttcaaggattcccactatctggctgaaaattttgtttttgactttatttcttactatttcccttcattcaccctgtgctctagccaaaccgattgtgccgtagaacttgccttgcacttttctaattctttgtcttcgctcatttttcggaatgcccattctcacatccccagatgcctaaacattaagtgaccttcaaagcccagctccaatatgaattgatctataaagcctcttctgattcacctctccactccctaccctcaactccagtcctatccccactctgccttccctccccgacataactttatagctcctctctcatgtcacttagaacataatgttagaaagtaatacatccccacagcatctaatgtcctggctagtacacaagagatgcatcaaaatatttgcaagattaatttaataaggtacataactgctgtctgtactgaaatctgtataggtgccgtaatcaaaagcatgaagtggccatttgggcctgccactgtactatatattctataaaaactgtcgcataagactctctcatatgaaacaacagatgaagggtataatgatatagtgctttctatttattgggagaattatttaagtggtgagagtacatttctgttgattcatctacattctctcacgtgattctatcataagcagcaacatacttttgtgagatggcctagtaggaggagaggtgaccctggttgccaaagaattatggaaatatcactgctttacaaatagacgggccataacacggtggcttcattaggagagctctaacgaggtgaggtcatccggcagtaaagggcaggcgtgcacagacacagcggaagaaacctgagcaagaacattttaccaagcaaaatattctgttaaggaaaacctagtggggaaaaacaccaccgagtaagaatgaaatatgagaatccatatcacaatacaaaaattactttgggaattctatttactaagaaagaagcaagtacaattgaaatgcattaccctttactcatgatctaataattttacttatcttgacattttccaagtaaattattctgaacgtgatcataattattttaaaagtaatgatttttaattttggaaaaacaagtctaatctgtttaaaaaacattaaaaagaggtgtctgacttaggattattttggttaccagatacagaaagaaagtggtttcaaattgtcttagacagtaaagtttgcctggtcactcgccagaggaaggaatcaacatcaggcctcgccctgtatgaacaggggaatgaggaagggtgatccagcacccacgatggaggcggcagagatggagagaatggacagcttagctgtccctgccagcaaggcacagcatgtttaaagagagaaccagctagatgcattttcaagccgaatccgccgtgcattaactgtccctttcccactctcaaataaataaataaacaaaccaattctatcactcttctagtgtaatgtgatgttgaggggcaaaagctctgaagtcagactacctcatcaaaattccaactctaccgcataactgctatcgtccaagttaactacctggagactcaggagcctaacttataaaattggggcaataggaccgggcgcagtggctcacacctgtaatcccagcactctgggaggccgaggtgggtgggtcacctgaggtcagaagttcaaaaccagcctggtcaacatggtgaaaccctttctctactaaaaggatacaaaaattagccaggcatggtggcgggtgcctgtaatcccagctacttgggaggctgaggcaggagaatcacttgaacccgggagacggaggttgcagtgagctgcactgcgctccagcctgggcaacaagagcaaaatttagtctcaaaaaaaaagggggggaggggggcaatgatgataatgacatccaatttattgggctatttcagtgattaaatgagctaatatgtaaggttataagtgttatcattgtcatcattatcatcgtcatcattatcatcatcatcatcattctctgcctaaattacggcaacattttttagtcacccgggctagagcctcagactgagaatcttcactcctgctcccatgtggaggctgagctgtagtcaggactagcactaccgcagtgcctccccttgctcttcaaaagttgccgtgaaaccccacttcatcactattactagtggcttattccttaagccaccaaagcacaggacacagcaggtgtctcgaatgcctgctcaaagtccaccctagattctatgtttgctgtgccgctttgaacatttctcatgagcacacgccaggttggctgtacaccagtatcccatgcctgtgggtacgctgggagggtgaggggcctgagcatgctgagtgcagaccggatcccagcttgctactaactagctgtgtgatctcaggccacctgactcttttaactgtcccagagcattagaaaactgattgcccagagacactgtaaggagtaatgagattatacaaatagaacatttagcatggtgcccgatcaagaataaattatttttatatccttggttttccttcatggtcatgtctctgcagacttctaaattggggtcatcaaaaaaaattgatagatttggattctataacattcatccaagttacagtaaaaactttagatggaaactggactcgatcaaatatagatacatgaggtatcccactcagggctgtacaggctggtaccaaatcattagtgcgtattacttggatacaattgttcacagagttaaaaaaaaaaaaaagaaagaaagaaaaagcctactttttcaaccattcctgtatcctccctataaggaaaaccatagaggccttgccagatgctttgctgatacagtttatttattatctcctttatgaggaaacatattagaatacatgaggttagcttggctggccttattccagagagctcactctgactcctggtaacaactactattttcctaggagctcccgaatcacctgcttaaataatcagtcctagaatcacagcagttattgatgtcaggcttagcagtgtgtagttttcaaactccttcttggaaattggtctctttacccgtcttctattttgtgcacatctcttgtcttgttttgtgaagagcctgtgcacattgtatctttctttacactccactgcttctactgtctaaaccctgtggaaatgtagacaccttttctcaaccagaagaagaaatgtagcagtcattctttttttttttttttttttttttttgagatggagtctcactctgtcgcccaggctggagtgcagtggcgcggtctcggctcactgcaacctctgcctcccgggtgcattccattctcctgcctcagcctcccttagtagctgaaactacaggtgcccgccaccacgcctggctaattttttgtatttttagtagagacggggtttcaccgtgttagccaggatggtctcgatctggtgacctcatgatctgcccgcctcggcctcccaaagtgctgggattacaggcttgagccactgtgcccggccctagtcattcttagaagtagtggtgcatgatgcagcattctcttggtttttactctgaaaatggtgctaactccttcctttggtcaccttttcagttttcaccccaatctttgcagatgaactgagacacaatttaggtacagaggagcaaggagctccaaagacacgaacctgccccgcctctgacagtgccacagtgctgatgggtttactctcagtttctgtgagacgtgctcatacgtgtgtaagcaagtgcaggcccaacctgggcaacaagactgaaaaggagtatgttggatgacatgacgcttcaggtttcattctctgtgtctggaatatggggagtgtcaaatagatcatgctagggactgcatcatggagaccattttggtaactgaatactttcatttactcaaacagcatgaattatgtatctacatttaaaacaaagtatgtcatggagagaatggccaaacactttcaacaaatactaaattatattctacagccatgaaagaatatattttgatctattgaaaaattgaaaaagagtcagccacttgtaatggcaaaactttgatggaaaatctgagttttgcataaagatagttgcatggcatgctatggtatttatatattttacatattatatatgtgttgagagaaaaatcaatattttttgtatgacatttacttcaagtaggagaaacttgaaaacaatgaattaaagaaaaaaatgtaatccttattataggcttacctcatgtccataatagctgatctaaatcgatcatactttaattgcctaggaatatgataaatcaggctgtgtcatatttacttatatagcaattgagctctgttatggaaggagaaaaatttctacaattttgaaatctaaatttggtttgaaaatatattttgaattcattctaccctataaaatagaaaattatatggttggcactcctgaactagcaaaatttatatccattgtaatctaattcaactaacgctataatgggcccaaaacataaaatatttattaaacattttaacttcagaaaaaataataaaattctatgagacactataatagacaaattcataaagacaaaaagtagattatcagggactacagcaggggcatggggagtctttgcttaatggctacagagttgtgggtgatgaagaatttttagaaaaagataatggtgagacttgcacaacattgtaaatctaattaatgccactaaattgtatactttaaaaaggtgaaaaggcatggtggctcacgcctgttaatcccaacactttggaaggccaaggagggcagatcacttgaacccagaagtttgagactagcttcggcaacatagtgagaccccatctctacaaatataaaaaaattagccagccatggtggtgtgtgcctgtagttccagctactcaggaggctgaggtgacaggatcacttaagcccaggtggattaagctatagtgggctatgatcacaccactgcactccagctagggtgacagagtaaaaccctgtctcagaaaaaaaagtgggggggagtaaatgccatattttatgttacatatattttacccactaaacaaaataaggtattaaaatacataagaatgataaaaaaactaacatgcctgctctcagcactataatgctatattttcttttagaaattctagcctctgtcacctgaccaaaaaaggagagataaatattagaaagcaaacacaaatttaacaatatttttggtaatatcattacatataaaatccaacttaattcactcaaaaacaattagatccagtaagggaattaaataagttagcccgttaacaaagtaagtatataaaagtcatatacttttgtgtgtatattatcaataacctttaggaagaatattgggattaaataattttacacaaataacaacaaaatatagaatttctgtgagtatatctaacaaaatttgcaggatctatgtgaaaaaatactataaaacttttccaaggaacttaaagacaagaaaattgaagacatatcatgttcctaatggaaggattcagtagtaaagatggcaattgtctgccaaattattctctaattttaccaaagggccaagcacatttgcaatttcaactaattatcttaaagtttgtctcaaaaaataaagggttaaaaataattgagagaatattgagaaagaacaatgagaaatagattgaattctgatctattaaaacacaaagttacaatcatgaataataatatgtaataacaaaagaaaaatatgcactgtatattgataattttttagaaagcagtttttaaaagcgcttatcttttagtggaacatatgtctatggaaaagatagtcccttctgttagcgtctcagtacacaagtttctagtatttatgcagtttacattctattttataaaatgaggtccgagtgcaaatatgctttatagtttacttctttagtcacttgtgtcttaaacattttcctattttaaactattttttctattagatgactaataattttatagtttttcattgtgtggatatactatagtttacttaaacaatttgttgttcttggaacatttagattgtttctaattatcaataatactgggcttagcattctttcctacaatgctttgtgcacatttgcctaaatccttggactaactacccagaaatgaaactgctaggttagctgttttatgcatttttatggcttttaggtttattgccaaactgctctgtagaaaggttggaatagtttataacatggtgtctatcagggcgtctcctcttttctcttttctcaaacctgtttccacactgacagtgttaaattgtcaacaactttgtgttaacatgatattaaaaattaccaatgaagtttgtgaaaggaaaatatcttgggcccccaaaatcactcaggaaaagtcaagctggaaactgcttagggcaaacctgcctcccattctatcaaagtcactcctctgctcactgagatagatgcaaatctgatttgcctcctttggagaggctcatctgaaactcaaaagaatgttaactgtttgtgtatcacctctctgtgacctggaagctccctccccgcttccagtcttcctgcttttgctttaagttgtcctgcctttccagaccaaaccaatgtacatcttacatatattgactgatgtctcatgtctccataaaatgtataaaaccaagctgtgtgccaaccaccttgggtacatgtcaggacgtcctgaggctgtgtcaggggcgtgtcctcaaccttggcaaaataaacttcctaaattaactgagacctgtctcagattttctgggtttcacaagttgaacattccagaatagtaaatgttcatttttatgtattaatttgtgcgttgtctgtttatgtgccgtgcccatttttttaattggaagattcagtcctttattgggttgtgatagctatttgtatgttaaagctattaacatttaaagcatatgtcaaaaatattttttagaattttgtttgcttttgccttttgtttggtgtttcttgttttaaaagaagaagcagaaatgtttccttttttcctgataccacaatagtgaatgacatctaatagtagaaaaagttctcactttgcaaaaaaaaaatcataaaatagtggattttatgcctgagaaaattatacatgtagcatataaccatttaagataaataacttttaccacccttgacttcaaattattttttccttattcttcagcaatttctctatatctgaagcctctatcttgtttattatacctaaagccagtaagcagtacaatagaaatccaattttctgaatagaaaggttccatttgttgatctataatgtcagtagactcctcatgttagaaccttttcaaaaccttaaatcttgagttcaaagtcctcacttatgtcttgacaatagctttcaggcccatcaacaaaagaataaacacatttcttctctttcaagctacaaaatcatattctctttatacctgttagcatactttttcaaaggaaaagaactgtttcaaaaaaaaaatctttttgctttaattccgctgtgacagtaagaacaaaaagacttccgacttcatggtgtatcttaattctctgagaatgaagaagagaaatagaggaactgaagagaaaatgggcagtgtaagaaatccctgttggacgaagttaagaggcttttaaatagtgcatatcctgcctttgtttcacagctactgcagaagttttagagccattacctgtccattgaggaggacttagagctccattttagatgccattacgcgttacagttcaggcattttacttcttggtcactgtcaatccaataacgttgatcacaaccatgttaattcaggcaaggtttcctgatagctaatatctaatctatgtcctaatagttaatatcattatccattgtgagagagattattaatgcatgcccaaatgatcaattaggtatagacatggacataaacctaataaaaatttaatgttagtgttactcatatatctcatatatacatatgtgtgcatatatataatatatatattatattatatatataaatttactccttgataccagtatattctacagggcaaacttcttctctcacattggcagtagatcagcatacccaggctgttttattgcaaccttcggcgggcacacactaaaagaacaacactgggatacgccagcatccagtgaccacaacggtcaccaaaaccttttctgcaattaccacattcaggtagtaatcactttgttaccttccataggctctcctacttatgacttcatagtgtcaacagaacagctttttttaaaacacaaaaacaaaacctatgaaatggagtgaggactgtatgtgctcagtcatacatttcttttaatatatacagaaatgcaaacaacacacccatgtgattctgttctgtgtctaatccttcctcactaagcagtttataagatatttagctagctgtggctctgagtccttcttaaggagtgggatgggaaggagagatgaataaagagaaaagaaagaaacccaggatctcaaacatctgattctgtttggttgataaggcaaggtgggacccagggattcttgagcttgggaaaaatcactacagcctcaccctccttttgtatgcacctccatactcctctccagcacttccaaacgatcccaagaaagacacactcccagtgacacatccagtcagggtatctttctactatctcttgaatcccccaggggaatctcatgcatccaagctggagcagcccctgcagtgaaagaactccttactgggaagctagtccctagcgcgctgcttcctctcctggaaactcttcatgtaaatgacatctactcagccctggggtttgttcccacatctgggagccttcccttaaccctagactaggcgtgggacttgattgtctgcttaaacgccctgtccttcttatgtgtaattgtcacatttgtcatacttgtttaatatctttttccatactattttacaaaccccaagaggttggtaccatacttgcctgattcatttctgtccttccaattcctaaaacagtgatgggcatgtaatgcatgcactctcaatagacatttggtgagggaagtctaagtaagttaatacaggtgaagtgctcggtttaattcctggcacatggcggtgctcactacatgttagctacaggtgctgtgaatcacgcacatatctgtgcagtcctgaagcctaaacccgttgagcatagttggtagactttgaaagaatatcaactgcccccaatccttagaacatttctggcctgccagttctcctggtaacctgagcttgtcagtacataaggctcactaacccctgacattctaaaaaggcaaaacagcttttagatcagataagaccagatagagagtctctactgctgactgcaacacgctgcgtgccttcttcctcctcaccttctcatggtgatctgaaaccttgttcttgaatatctcatgactccagctcttaagctaaatgatagcattctaattttagttgtttttcagcagatagattttgtcctgcagtgtgtctaactgctgctgtaatgagccatcatgctgctgagttctatggttatatttaggttggttccctgagtgaaggctgagccgtctcttttcattacatttgtatttactttcaaactaaacaagaacagagtctggactggaccagaagttgtagggggctctgaagtgttttcatgcaacaaaccctagttcgttgctaggggggatgaatctgaccacatttttttaaaaaacttcctagtgattccagaggaaatggctgtgaaaccactaaatgatatcttatattctaggacttttaacagaggattcggtttagttcaaactagccaggcataaaggaagcacttaggataagtttgaactaaaccaaatcctcagttataagtcttggaaaataaggtatcatttagtggttttgcagctatttcctctggaatcactagaaaatttttaaaaataaagtggggtatgattcatccctttcagcaacaaactaggggctgtggtataaaaacacttctgagcaccccacaaattctgaggccaatggaagcgggtagggggccctgagcaattttagcaggtggtgagatgatcagataagcttgagggagggtaaccccgcggtaccttgaaagacaggttggggaagtggagaaagacagaaagaaaagagatccatacaagagcaggctggtgctccagtgaatgggtcccaaggatcagaaccagaggagtagcaataagaatggatacctagaggagagaaggtgaggatggagagtgagaccagagagagaagatgaggatggagactgggaccagagaagaggaggtgaggctggagaccaggaccagaggagaggaggtgaggatgaagaccaggaccagagaagaggaggtgaggatggaaacagggaccagaagagagatggtgaaaatggagactgggactggaagagagaagatgaaaataaagaccaggatgaaaagagagaaggtgaagatggaaaccaggaccagaggagaggaggtgaggatggagaccaggaccagaggagaggaggtgaggatggaaaccaggaccagaggagaggaggtaaggatggagaccaggaccaggggagaggaggtgaggatggagaccaggaccaggggagagaaggtgaggatggagaccaggaacagaggagaagaggtgaggatggagagtgagaccagaggagaggaggtgaggatggaggccaggaccagaagagaggaggtgaggatggaaaccaggactggagcagagagggtgaggatagagactgacactggaggagaggaggtgaggttggagagtgagaccagaggagaggaggtgaagatggagagtgaggccagaggagaggcagtgaggatggagactgggaccggagcagaggaggtgaggatggagaccaggaccagaggagtgttggtgaggatggagagggagacacaaattcaagagatactgcaaaaggaaaaccagatgatttggtaacatgaggaatgcgaaggaggagaaacaggctttgacctggagtgactgggaacaaggtttatctttactaaatatgaggaacatagggaagaaaaagaagttcagggaggaaatttagtctttggaacaaactgaatttgaggttctggcaagatccaggctgatggaaatgtgagctggagttcaagaacagtgtcaggactgcctcagagatgtattgaccaaagcatcatttctttttatagcctgggtccttttgtcccttcacagtggcatctgctttaaggtcatagtcaatctttttcattagaaggtagaacatcttacaaataagagcctttgacttcttcttggagtcatctgaggcatcacattttattaattgcacttttgaccttctataatagatgttttatctggctcttctacttaaaccatggtacttttagccatcttagaaagtgcataacaggctcccatgattgaagaaactggggccaagaaagtgccagtaagttggccaacctcgcacagccagttatcagcatcctgattcccgaccccctgcacttcccactggggcaagtggtgcctttcagaccctccctggtggcatcttgctctgtctctgcagtacagcttgttactttgcactcagaactgtttctttagaactgtcatattcctgtggtctcttatagcttatgtgttgtttccttctaactgaactttaaaaaattttgcttttctttcctactttgtgagggcctaaacgtagtcactttatgttcacttctaccaagaatattctcggtgtttgtaaccagcctatagatttgaacaccatgcctcaccctccttcccaaatgttcgttccatgttaatggttttaagaattgtatggattgttgcatgaaagagattgttgcatgaaaatgtatctgttgtcaacccacatgggttcctttaactccagcaacattaagtgatcttttgtctttcatactgcttatccaactcagagccccggcctcttctacgaggggaaaatgagctgcattcctagggctggtgagaaatcagtgccaatggggagaataaacagtaatcagacaagattccatttaaaacattagggttgcaatgtgtcatccaaagctataataataaaggcccattggtccccagtagagcacagtttaattaaatgcaaccacaagacaactttaccttaaccttgtagacctgatgctttctattaaaatattttctgcttggtccttcttttaccatatagatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggtgagtgagcccacgagtcaaaatgtcttttaagccaaagaaaaagggagtggtttgaagtagagttaattagcaacacgtttaggatttattattgcatataaaccatgatccatttggagatctaaatagcatattcccacgccttctccagctactccctagggaaacagtaaagttaacaatttcatttattactcctcaggtacagcttacttactcagtacagaagtgctgaagcagttctataaacttccaataattaaatttgaagtttttttaatggtcttttgaatacattagtaggttttgagtttgttctttttcttcatagtgattctacctttagatacttcctgttacaatttcagtcagcttttttccattggtttaagatgaatttttaagcactattattaaaatctggtaaatggttttgatgattcatttattttttgtagtattattctataagctttggaaaacacagatgaattcatatggctctattttaccctaacaaagatattagcaagtttttggtgacctttggcaggcagtggatgtaaatctattcattaagcgtgtgatttcattgaaatgatgagtctaattttcttttttgttgttaattttgaagttccgtacttctcacatgcatgttataagtcaacatgaagttatttcctgatagtggtatcaataagttagtaatttaatggagcactgaatgaaacttttacaacatgatctgctcatcatacattcaagaaaaaaaatcaaacaagaagctgagtttacagcagctcctgccacaaacagacttttgtttggaatcactattttttatattattactcaattgctattatgtctgctccaggcatagactattcaggaaatcatggaattctcaaaaagcttttagctctctttcagtagtagaaccggcttatatgttaaatactatacatatttagaaaaaggacttcaaactggagttataggagcttacaaatgcctgtaatggagtgcttgcaatggtattctgttcaaattatctgaagagctgtgggtaaggtggacattcaggcaagatggttagtctttacgcaaagtaataactgggttttaataattgagtctcttattgttaaaatgtaatgttttagtaacaatattactacatttggaaaatacttatttaaacagtcttcattcatagttcatatttttaccatatagtagcagcaaatatccatgaagttatgggagactcccgatgtgcacctttttcaactaaggtcgataaaagaaactctaactgcatacctcatatttagattctagtaacttgagggagatagagataaagatgttctgctagagatgagagcattattaaagagatggaagcatcagggaacagccacccccaaatgtcttagttaacatttttgaagtgtgcgattcactaatatttcctcagtaatcctcatgcaaacctatgatgcatgtactattactatttccatttaattgttgcagaagttgcctcttgtagctttcctcccatgtgaacagttattctgtacttgatgatcctggaagatgagcctgaacacatttctcctttcttgcctgagtatctgggaataggtagctactgcaacactgctttaatgcttttgttggtcacacaataaaggctagaacttatatctaagcatcattctgtatccctgtataaaagtagaaaatcagtgatgttcaaaggacaattagaatctttctttatcctcaaggaaatctataaagatggataaatattgctgccgcaaagacagataaatcttgttgggagctctagactactaaacaaaacaattggtttctactgctttctcattatagtttttctttaaacctttaactcacaggtgttcatacacttaacaaagaaaattattgactttaagaataaatccctagtaagattttatcaatgtgggacatttaaagttcatacgagagtccttaattggttccaaactcagctaattcttttggagtctttctaaatgcatgcatcaggaattctacatttaaattatttttctgcttaacatttttctgacatttgtagggaaaaatattatcttccgcttcattttctacttatcttagaaacctgtcacaacaatgccagcctgcagtttgctgtattttcagagggtcctattacaaaattggagcattctagctataaaaacttaaaactgttccttaaagtagctatgttaccctagatccaattctttcagaaaaaaaagcttatcgcaggattttcaattacattagaattttcactaggaaaatgatttagctttaataacattttaagaaagcctgctttatgatatacatcacaaaattatatatacttattttatttaagcagatgtccttagtaacagatataattatttacaattaaaattacattagaaattgacagtatgtagcagtagaaaaaactcatcctaaatttcaatgtatttgagaacaattgcacatttccgtattcctctttttttgtatttctcttttatgtaaatcaatgtcttgttaaactcagattcaaaaatatttctttcaagtcccactacaaaattctttttagaatgagaccagatacaaatgacaaaaaagaatgagagaaaatattctttcaaataaaatgacctgtctgtcagcatcccctcaaagcgcaaacattagattagttctactgcctgaagtttttacaatgtctcctgttttaatgtcacatgaacttcctctgaaataagcagtgggggttgcagagccagggagctagacattgggacagtggcccatgtgaggagcccaggcttccagtcttttcaaggaccagttggaaatcaagtaggggagggaggaacagtccatgctcacagcaccaattcaggccccatctacacgatcagagcaatgaaaacttagagccagccccactagatcattcttgttctagcagagaaagtggctgtatcctcttgtgtgttcataatatttttcacagagtttaattaggctatagttaaaacaagaacagataaatctgagatgtgaatggtagtgtagactaaacagtaacattttggagccagaaaagctgtgacctcaggcaaatcccttaaagtctgtaatcatcaatttttctgtctacacaagatatgcatcgtaacaacttttcattagggtgggcataattagagacaaggtgttcagggcaccttcacatggagcctgtccatgaccgggtattaatgagagagccattatgattacacaacattatatacatatccaatattatatacatacaatagtatatattatagaagaatatcatgctctatgaattattatgtaacaacacaaccaggcaactgaaagtgttgtgtgtgacccatagcgctctctcgttgggtgacctgtcgcttggccctctgtgagcctgtgagtggcatgtggcctcccggtctcaccagctgcatcagtgcctttgcttcaaatggttcattttggctctaattgccaaatgcagggcgagtggccaaataagtgaaagactcagattcattcactggtaacaggttttcaaatccatcctttcctggcataatctctcagcttgaatatgtgactggagtttagggagcatcgtatttacaaaggagaaacctctttccagcacagacaaggaaagcctgggccacggtcctctttgaaaaaaccaaactgctgtctaagcttttgagcttatttgcctgcattctaaacagtgaattttggacgtaaaacatgctgtctttccagtgactgctttgaggggaaagaaaggggagttcctacaaaatattccttggatgcatttgtcatacagccaatagcaatttattctttcctatgttctttcacaaatgttattaaaggttacagaaaattaaaacaataggaatcttcaatttatagctttcagagatgaaactaccaaattaatgatgcagagtattacatttgaggagcatgagccaataaatggcattaaagcttttacagctggaatatgggctccgccagcagattagggctctccgacaggcctgtttaccatattttggttcatttctaacagtaccaatagttctgaaacaatccctacctaaaagatttcagactccagatatcagagactctgataatgttgtaaatttatgtcatgaaatatgcaaaagtaaacataataatgaaatatcctgtccccacgtttgtaggaatcaaattgcttggctttatctaagatgtttaccattatagactaataaaaagttcattaaagagacttaaaattttaattcagatgcaggcacattaaaacatatggggaatgaggatgcctgaagtttgcaaaattttaggatgtttgtaccaggtctttgacctgtaatttaaacggcttctaagaaatagaagtaattattttatgttgatcatcttttaaaacaacttctaaggagaacctaggccttgtaagtcaacctgattcaaaccctccttgataaccctccttgatattcgtgtgaattctctgggaccaattctcatgctcttttcaaacgttgatgaacttctgggaatggattaccaaacaacaacagcagcaacaaaaccttcagtttttctgtcccaaagttgatgtatgtaaatgttatttctcctcacagagatttacatttaattttggaattcaggttcatcccccatggaattctgaacaattctgcgttcatgatttacattttagaaatttacttcgaagtccctttgaaatggttaaatgtgttaaatttgaaccatgagattatcctaaattccttgaggaaattattagaactactgccccccacatttctgaaagttagatttggaattgtcatgcatatatctagtctctctgagcacttcctccatgcacacttaactcatttgtctgcagagaatcctgggattataaagttggaagatccgtgtaggggtcctttggtctaagagtatctccaatttaccaaactaatcaaccattacttccacgaaggcaaaatgtttgtgttggtctttccttttcttatatagagcttggcacacctagtagaatcaggtgcctaatatgtgcttgtgtgaaattagttcactaactcagcctacgcaaccagtacttatttattccgtcttgtccaagcagcctcactacttcatggggtagctgttctacttccaaagagaaaggcagctcctgttttgaaaggaaatttacacctaacatttccatctggttcacctctctcatctaaactacacagcacaatggttaatccttttccacatatagcaagccctcgggaaattatagaaaactttccttccccctcggtattcacttctccaagtgcaatatccctacttcttccaagcattctctataagcagagctcccaaagcctggaaaatctttgaggatggggagggaggactcatttctacagaaacagatggttgtgcagcgatctaagtgagagggcagcccaggacagcagatggtcctgggaagggctcaggcctccctccctcacctgatgcccccacgcgtggtcagcccataaagacctctttaccatggtgaaacctacacatgcttatgaggttaaatgcctttcctcttcactgagactgctacatttgagtctattttcaacccaaatccacttataaaaagcatcaggggagtggggtcagtcacaaactgtaaattacgtctctatgtgctcttctctgtagacctccctggttgcgcctgcccggagggaaggattattctgagttgtctgtaacctggtagggcgatgtctaaagaaatcagaatccagctctgaaggctgtgtcttagcttcctggagccacgtaacaaattaccatacacagaatggcttaaacaacagaaatgtatcgtctcccagttctggaggctacgagttaaagatcaaggtgtggacagggccagctctcactgcaggctccggggaagcctccttcctgctgcttctagcttccggaggtgccagccgtccttgagctccttggcttgtggatgacgcatcactccagtcccgccccatcttcatgtggccttttttcctgtgcgtctgtctgtgtctcttctcttcctatgagaataccagccctcataaggattggattaagggcccaccctactccaatactccaatattactttatcttaactactttcattggcaatgaccctatttccaagtaaggccacatcctaaagttctggaaaagacaggaatttgggggagacactattcaatccagtccagatgatatacctctttcctacagcctgtggggagaaaatctcatctttgataaataaaggtagaggttttgtgttcgtttcactccttcacattgctgtaactagtgttactgagcctgctctgcacggactaatgaaaactccctctttcaacaacaaaaatgtcatgccttttcctttcagcaggaagggtttgtttagttaagaaagaaactgggcctggataagttttgagtaggggagatgcagggaattgatgtttctcttcttcttcggtaatgctgcaaactaaccagagatggaagctcacacttccaacagctctggatgctgccctggggatcccatagcagcaccccagggtgctgccgcaccagcccagtctcgagggacctggccacggtgaggctggttcacctgggcctgtcccggcccaaaccagctgggcaggaggctcaggccactctgcctaaaggggtttgtaccaataaatgtgggtcacctggtggacaagcaggggaagatgcttgggcagatgggataatttgtggagaaacaagaaatgggacaaagcatgcagctgccgagcacagcactgaggcgcaaaggctccggctgcagttcttctgggttcaaactgtttgccggctgtggcttttgacgggtcatgtaacaactccgtgccttagtctccataatttaaaaaccaagttactgggaggattaaagcagctcattgacttgcagagaactataagaaggtcatttttcaggagttctacttggagagaaggaggggaatgaattgtggaatcgagggtaagtgctttgaaactagcgtgttaggtaaatgtctcctacctgcagcacagggtttatggagagaaccaaatacatgtggctttatatggtccttccaagaaaattaagtgaaatctttttaagttaatatcataattaacatctaagatgattacatatgaaataaatattcaagaatcaatacctttcccatatgtcagcagtcagaaatgcaatgcaaagttcattttctagatgctactaattcctaattgcaaatattccaacccagacaaactttcactgctcagctctcccttcccccgaagacagtttagttccttccttggccctctcacatcattgcaaagaagggctgagtagtgacctacgcatagggctgcatcagcaggttcactggcctgccccagtgaactagtgaaatcccaacctctttccactgtgttctgttttcgattggcccttatatttgtggtttctctgtataaatctttccaagttgttgtggccaagtttcctctggacatccccatttcaccagcatctggctttaccactgtccccacttatccaactttacctgaagggatcagactgccaggaggatacagagttgcagataggttcatgacccaggcacatccccattgtttctggaccagtggcaaatgtggtatatcaagaatggcttgtgtaagagaatcccattcattgcttctgaaacggtgatgaaaggtgtcgacaaaaagagtcacactctgtaaaatatttaaagaggcttattctgagccaaatatgggtgaccatgacccagggcacagtctcaggaggtcctgagaacatgtgcctaaggtggttgagttacagcttggtttttatatcttttagggagacataagacatcaatcgatatgtgtggggtatacattggtttggttcagaagggcggtggtttacaggtcatagtgggttcaaagagttcctgattggcaattggttgaaagagttaagttattgtctaaacacctggaatcaacagaaaagagtgtcagggtcaagataaggggctgtggaaaccaggtttcttattatgtagatgaagtctcataggtggtacccttagagaaaataagttggcagatgtagactctccgtaaatctcttcaggactgggagggtatggaatggggaaagatctattatgttaatagagattctttatagacacaactttctccccactaaaatgacttttcagtccatttcaaaatatggcaaagaaagatatttggggtgaaatattttgattttctactttgtctgtcatgtgaggttatgctagagtcaggctggaaagtaagccacgttatatagggttaaatgaaacctctctgatgagattttatggtttgtggggtgtgactccccaggtcccttagataggaatttgggcaagagaagtaaaaggtcagagttcagtcctcaaaaggaactgcagtatggaaacagcagctcaggatggagctggaactggcactcatgccccctgcctgtgtgtggaacaggccatgtgatctgaagcctgcttctcagcctacgagacaccctactgccattccagggactctgggagttatctctgctcttccctccatatccacactcagacatcccatcctttcagtaacctcccctgactccgcccccactagcagaacagagggctcgtccctccgattattcccaatctgccttgctgggtagaggtcctatttcttgtgtccctcctcaccaggcgggagagcccagatgccgggtgacagttgggacaactggcttttggctggacctgttttcaaagccatgtttggaatgtgtgcttttgttacaggaaaggggtcctgatccagatccaaagagagcattcttggatctcacgcaagacagaattcagggcaagtccataaagtaaagtgaaagcaagtttattaagaaagtaaaggaataaaagaatggctactccatagacagagcagccccaagggctgctggttgcccatttttatggttatttcttgaagatatgctaaacaacgggcggattattcatatctcccctttttagaccatatagggtaacttcctgatgttgctgtggcatctgtaaactgtcatggccctggtgggagtgtagcagtgaggacaaccagaggtcactctcatcgccatcttggttttgatgggtttgggccggcttctttactgcgacctatttcatcagcaaggtctttctgacctgtgtcttgtgccaacctcctatttcatcctgtgactcagaatcccttcactgtctggggatgcagcccagtgggtcccagcttcattttacccagcttctatttaagatggatttgctctggtttaaacgcctctgataccttgtcacccctccacccctctgaggtaccccaacagggatccacagacaaaatgactgggttgtggctggtttccagtgcttggccagtgacatccctcctgctagctgggaactggcacatttcccaatcagagattgcgaccaattcagctaaggccttacagatctgcctagagaaatctgtataatatgctttaatgtatttaaacgctcaaaatgggccccaagtgagcaggcatgcacatattcgcccaagagaaaatagcgttcttttctatttatgcaacagaaagttttacttaatctgagcaagaaagcaaatagcaatttctaaagctttaatttaaggaggcttctctattcagtcagctcataatttgtagtttttaagtcccctaaaatatcacctattctggatttgctgataattgagagttcattctgattttcctttatatgcaaatcttccatgagcaccaactaatgactttttaaaggtctctttgtggacattgcagagaaagtaagaatgtcaccaagtgtaattgttatgctgaataccactattcatgccatcgttaaaaggtccgtttaaagggggtgagagacaaaagctaagcttgactggatggaggagcctttccgtgccactgcggaacccctcgcaggggtgggtagtgagggtgagtaaattgttctgccctcccctgagttcccaggctccttgagtcgcacgtgctcttctagagactgatgggaacgctcagcttgcttcactctcagaccttctctccccgcccagcgcggacgggctccgggctaggagctcgcagagggacgggctgtgtcgcctcgcctctccctgcctctgtgtaggaattccccgccgctgaggtcaggagggcgggagtgacacaggagccgtggctgcctggactcctgggctgccccaggagccgaggacagccaggtggaggcggctacggctcggcccgaacccaccacggcctcccctgcagggacctgtgtccagcctccacggccctgcagctgcattcgcctcagcctctcgtgctgggatccctgggcccttctagattcccatcacgcagggtcaaaaatgcccccacccgtgcacgctcaccgtgagaaacccactcccatgccgtgcactgatcgcccggcgtgctgcccggactccagccctgctgcctcggcctttccattctgcaccgcagggaaggcccaggcgtcgcgcggccagcccctggggacaccttcaggctgctcgagagggttccagctgccaggtcaggagcagagcacagccaccgcgccctccaaggacaccaaggcacgtcccgctgtccccccagcgcgtggccagttccccgcgactctttaagcagttctgctggcggtggcccccacacctgcctgggcccacagctcacccaggtcgagggaccctcgtgtcagctccctgccacacctgtggtttgctttctccaaataggaaactgttggagaaatgttcctcttagtatgaaatcagctttccattttattgcctttcttaaaaatctgtaatttttactttgacagaatggaatataaatggctcagaagaagcttaaccatcaataaatgtggagttgaaaaatgcaatggacatattctctagaaaaactgcaaatattattgatattttcttgcttgcctgctttctgtattatattctcatgtacatcttgaattaatgttccaagtaataaagaagaaaggtaaagatggcaacgtaattatgaccaagttctgttcagagccctcgaagatcaatttactttttttgctcttaagtacagtactttaatatgagctttagtgagcatatttatattcattttgaggcggtcatacaatgaaattaaaaatcattctccattcagtgacttttaatttagattttgcataccaattacaactctgcctctgcccccgccccccaaaaaaccctacatttcatcttaagttcatttcttgaaagtatctttgtcacaaactaaaaaactaatgatacaatactggaatttaaaaaacaagatgtaattgggccataatgacaggattattgcctggtaattttcccactattttaagctttgtgtttgacctgcatgctagttggatatttatttgtgtacatcgggttttgaggagttcatagtttttctaacagaaatcactgaatgttacatatgtttgtatgagtctttatttattataaatatgataaacaatcacctaaccaaatgtcttagatgttgttctttctggaagcatattttgtccttccaaagtttcttacaagctgtgagtgtaggataatgatattcaaagagaatcagtaccttttctatttttttgatgaccaactaaaatttctagaagaatttctgttaggaccatagacaaccatggagtgaggagaaggagtgtgatgtcgggcctgtaaaaacctgcttaaaaaacaacccacacattcacctttcttcgtgtacctgctgagctagccactggcggtgtggaacatgaggccttcctgctctcaccgtaagcctggttgcgctgcctacacaaagactaatgcaccaggctacctccaaaagcattagagagcaatgtggtttttatgaaagtcttttttcggggggaatgccaaagagagaaccacataatacatccttcactgattcatttaaacaaaacaaaacaaaaaaagttgagtgcttactatgtgccagcgcagcaaagcttcctaaaaaatcctttaaaaacagacactatgcggccacacagtcattttcaatttaccaaatccctcaaagacttccccagagcctcgcccggtgaacctgaatcaatgtgtacagccacggaaggcctgaggggtgaaggaggttttcactaccgtcgggaaacaagcaggtctagaaaaggatgggaaccttgccacacatggacaccatcctgcaaactttatgttccttctaaccatatatccttaccttctactcctctctttaataacctgactctgaggtcagggtacagtttggaacagtaaaatccagcactgatggcagacttattgaggttgctaaatggcaaaaagagtgctgtttaggcttaatgctctctcttagctaatgaaacagtgaagaactgcaatccaatctcagattttccaccatcaacataaccctcctgcagaagagtaggaatgtcagcttcatcagtgctactaacatgctttgcatcctgggaagatcccaaggagagtctccctctctgggctacctccaaatactgtccatcaggtctctcctgaaatttctaagagtattttttttccaaatctttgctaggagctgcaatgtatatgatttttgctaaatctttgctaaggaccacgtgatgatatgtatatcttgcttataaacccaaccaaagcgcattagagaccatttgtcctgaagctacctaccaactagatttgcgagtccacccaaatgtgtatgacatatggtcagggaggatgatacatcacctgttgcatttcccatcatgaggactgcctaataggtctagtcttgttctaatcttaatagtcctgtgagatccaacagcaatgagctgaaagctagggtttgtttgtttgtttgttgtttgttttaatgtaggtattgttactaaatgtaaattccatgaaggcagggacttttgtcttttttttcactgctttatcaacagctcagcaattgttcttagcacttcctgagattaataaatatttgctgaatgggtggatggagggagagtgtattggttttctattgtcacaaatttagccgcttaggacaacacccacatattatctcacagttctgcagatcagaaatccagcagactcagctatgtaatatgattagaatctaataaggggatcaaagtgtcagttgccctgtgttccctgtagagcttctgaggaagaatccacttctaggctcatcccaggtgttgatagaaatcagttctaatggttgcaggactgaggtctccatttcctggctggttggcagcagtggggagctctcaactgctagaggcggcccacattccctggcccatgaccatctcatcttcaaagccagcaatggagggtttcctatcactcggcctccccttctgccgcatctcatctgccttccttttctgctttcaagggctcgtgtgattcccacccagataaagaagagtattgctcaagtagagtgttaactaatctaactttgttccactttttttttgttacaaggcatggaactatgtggaataatcccttgttttaaggtcagcagattagtaaccttaattctgtttgcaaagtcctttcacaacaataccttgattcatgtttgactgaataacaaggggacggaaatattggaggaacatctgtagaattgaggttttggaatgaagtcatcaaaaaattgatgcctggatgaccatgactgggagcttgaagtacatgttcaagaggatacaaaattaactgccaacatttagtgaaggtagcgcagctcgacactgtattatttttggaattgttattcttactttacagatgaaaaagctgagcattggatcaaatgacttgcccaaggtcacagggcaggaatgaaccaaagccagcacccaagaaataagcaggtcctccttccaaacctgagtggcaggtactctggaagtgtaaattggattgccagaaatagcatttctaaggtaattctgatcaaaagatttcttttatttaaggtactgaagtaaatggaagtttcattgatccgatttaacaactattatatgctggtagatcaaagtagctgttgctgatcttcacaaattcttatgcattatgaagcaaaaatgttttcatatcatcaatttctattgtggagtagtgttcaataatatcttgagaaaaactctaaacacagaaaactatcagcaagttcacctaattaaaaacatcaaacagaatcttctaactttgttccactttttgtgttagaaggcatgtaaccacatggtgtgcattcaatttttttttaatcccagccaaattccttctcagagttatggataaaatctgtgtatgtagctgtcttcgtccatttttgtgttgctataacagaatagctcagactgggtaatttatttttaaaaagaagtttatttggctcatgattctggaggcagggaagtccaagattgcacagaccatttgatgagggtcttgtgctgcttcaacttcaagttgaaaaggatgtaggcaggtgcaaagagaccagagtctctgtgggtctcatggggaaaaatagtaactcgcatgtgattcatttgtacaaattttagtaagatatagagcaagcttacaccttactcttttaggcaatttaatttacacaatgttttcatttctaaatgtaatcctttggtaaaagaccatttgttttaggtgcaattgttcacaatctcttttgctaacaaatcacatagttctcccaacaattctcccaaatataataggtaaacacattaaaaattgctcttgccatgtatacttcaattaccttgccaaattgatatttcaagttaaacacggttgtatattatacagagaagagtgttctcctagtcttaacaataactcattgaacaagtactcttatactatttatgaagtaattcaaaataaggcactaatctacatttactagtacattatggagaagtacttctatgaccctattcctgaaaatcagcctacattttcttagaaatttctacctacttttactagaaatttattgcactagtaagtttttcttgatttcccatattaaaaaaaaataattcattgcaaataaaacctttcctgagtaataatcacttggcatgtaaatgattttagtattaatataattctctctaaataaataacttccaggcccaatgcataatgtaccaagcacacctattaaaatgatagttttgtaatgtgagaatttccattataaaaacctgcgagacacaatctagcacatttaaagaatgatcacttttagattgtaactggaagataaattctaattactatttaatttcttggttgaacatctttggcatgtacaacataaaattgactctgaaattatgcagttaatattatcagcacttagctattccatttgaagctgcaaaggtttaatttgcttggctcaaagaaatattcaaccagaaaaaaaactgcttaaagtttgggaaatttaaaaagtggctatcgatatagttaactaatctataataagctatgttcagtgaaatggctcaacattgggtcattgaaaaaaatggtacattctttagaaagtatgctatttgaggtgttctagaccaggaagataaacatgtttttagaattctattatcaaagctatgggttaatatccaacattgtgacgtgatcctgtgactttagtcaaatcagtcatggaaagttagaaatctcctcccttaaacattgatgcattcttagaattgcttcttgcctaaactatgtttttcaaaaatgtaaatctcagagagttgttcttccagtcacattgctggagtagagatttataatttttaaaatttttaatgagattattgacttgttaatttgtagattattgacttattaatttgtttcaagttcttttgtgttaactgtcttaaaaatggctaacagttatttagtgctttttataggctagattctggattaagctgttttcatgaatcatctcatttaatcctcacaaacccaggaggaagaaagtatccttcctctaatttaacagatgagaaaatgaatgcagagagataaagtaattttcaaactgtcaatcagttagtaaaagggaacttataggattattcaaatggaaagagagataaaaagtgataacttgtacagttttctccatccataaatactgagtgcttcaactgcacctaatggggtatttaattacactgttatagacaaatcattcagctatattggtttaatcttccagtgtttaaactagcagtaataaactaataacattcctaaacttccagtttcttccaaagttatttttattcatgttactaaattaaaaaaagtagtgttcaatactaattatttactgtgatctgttttttaaaacatctgagtggcattattcttggatgaaaagtaaatccaaattcagcctttatgtaatagtatgacatttttacttttggagtttataacagagtttaataaatgtataacatgagcaataatcaagatttttattgcatatgtttattaaagctcacttatagctagttaatagagtatgcgtagattttgctgagttaataaatccaatgcaaagtaccacttgtacatgatgatgtagatagcttcactataggtatcctgaagcatggagttcttcatgcacaatagtttgtcctttgtgtgaaaagataatttgctgaccatttgtgcacggaagtcctcatcatcagcaggacttaacttgagatgattcaagccaattgcaagaaatgctctttagaaagaagaatttacaagacttgctcattaaactatgtaaattaattgtaacttgaaaagaggaaaaaaggctctagtttcacttttttaagtttggggaagatgagttgcaaataatgatcaagaagaaagtcattctgtctaaattagggcatggtggatcttcagcttgaatgtttatcttgagagaatgagaaagagaaacagagagagggagagaaatagataaaggaaaaagaaggtcagtgaatatgatgaaaagcacaagggcattttagtaggtagagagattaaaacctaaaaccatgagggttctttcatattttttaaaatctaatagaaatatgatgagaaagagaaagatgttgaagatatacagaaagaatatcaagtagagccattgatcttaactataaatataaggcagagatgcattgaaaataaaggccacaaactgcaaatgaatgaaaacacttagtatgtcacaaacatgacaaacaaaaagctcctggaatttttcagactgagatggccttatttcattggtggtggatcccagttgagtgtcaaccctcaacgagtgggcagagacccctgcctgaatctcctgagtcacacggcgcacactgcatcccattaggactgatactgttttgcaacagcttaactaatacaatttcaatatttaaccaaaatctgctttcctgtaacgttcccactgggggcttcatttggctgtctggaccgggcctctctgcttcatgagtttccatagatttcttggtgaatattcttctcgtgcatcctgttctttgatgtattgattttcaacaatacatcaaaatcaggtacaaggcagaccttttctttgttggattccaaatgtacaaggactcaatcttgattacatcctaatgctgacgtttctagacaatatttatttgctgttctttgtttccctttgtttctcttgctctataaatttctccaaaatcctaacatgttgtttgaaatttggttgtttcttcttatgcaagtttgcatttcaagttattttatagcctagatatataggaatcctgctttcctccgaatgtgtaaaaattaataactgttaatagtcctctgctatctaagttttaggtttgacataagggaggtggtttgaggctgaagccgtctgatgtggtttggctttgtgtccctacccaaatctcatgtcaaattgtaatcacccatgttggaggaggggccaggtgggaggtgattggatcactggggtagatttccttctttctgttctcatgatgatgagtgagctctcacgagttctggttgtttaaaaatctgtagaaccacccactttgctctcttcctcctgctccaaccgtgtagaaagtgtctgcttgcccttcgccttctaccattgtaagtttcctgaggcctccccagccatgcttcctgcacagcctgcagaaccgtgagccaattatacctcttctctttcccttttttttttttttttttttttttgacggtgttgctctgttgcccaggctggaacgcagtggtgcagtctcctcacactgcagcctctgcctcccaggttcaagcaatctcaggcctcagtccctgagtagctgggaccacaggcatgtgccaccacacccagctaattttttttttgtctttttagtagacacagggttttgccatgttggtctcgaactcctggcctcaagtgatccacccacctcaacctctcaaagtgctgggattataggcgtgagccactgtgcctggctgaacctcttttccttacaaattacgcagtcttgggtagttcttcatattaagttgttgcgccaacctatagcaatgtgagaacagactaataacactgtccatacaaatacaggaaatgtagatctcttgtacatttggaatccaacaaagaaaaggtctgccttgtacctgatctttatgtattcatcaaaatcaatacatcaaagaacaggatgcacaagaataatattcaccaagaaacctacaaaagcccataaagtcgcttgtttcttcaggataaaactttagatcactgttttggcatgaaagcaaagtatcaccttggcagaagactgtgtcaaccctccagtaggcatgctgacatcttgattgttttctgctcttttgcttctcatcattttattggacagggtatagcccagctagctggattcagtgtcatatttcatattggcaaagaaaacttgtgattgaaagtaaggtttctctaccagacaacttttacaaagaatccaatggtgtactctttcaataatttatttcccttgctccccaaaagtcaatcatttaccaatcttattacttgttcatttgcaactgtgtacccaccccactgttgccagctgcccctactatgctgtaacagtgagttcagagcatcactatcacacgttgtctatgatagcaaattcttctttgttctccatgcagcaaaaattacatctgttgtctcatctcgatttgaaaaacctctcagcaattctaggaacaggtagccaccagtccaaaagaatgctggacaaaattgtagtagtagtttgtggttttcctttcttccttttgaaatatttctatctttataatctcttaacattatctgagtcctatctaaggcattttagtaagtagagcattttagtaggaaagagaaaaatcaacttcctaagcacctcctcccctcaatgctttgaagtctcagcacatatgctcatgggacaaatgacacttttgtaaaagaagaaacagaaaacctgccaattgactgaatattgggaataaacaagcagggatttccactttttaaagaattcttcactttgttaagaatttacatgatgactctttctgtggtactatagagcctcctccacagtgaaattgagaaggagattgggacttgatatgcaaactcaagtatataactggttcattagagagaaatgaatgataaatatcagtttcatggagatggcaggaaaatcacaagatagagcttgaccactgagatttctagagcttgaccactgagatttctagagcttggccactgagatttctagtgtggagatactatatgctggtagcaattgtacaaagatacatttatggatagaaatccaggggaaagaagaggtagttcatcttcacagattccaactgagaaagggcagaggaaaacatggcaatgtctcctgaaggctgctaggccactgtttcactttgtgcagattcatgacgccagtctgggaagagttcgcttcctggtacctggtacagatggggttatcccacctcttctgacacacatgccatagaaaaaaccattcattcatctatttcattatttttactgaatattttatatgtgccaaccactgtgctaagcagcaaatatagaatagtgcatgtaaattaataaaagcacaaatatatataattacactcactggagttcaaagtgccagtgacaataatgatggtgatagcagccaacagtcactctgcatcccctccacatgagacactgtgctaagtgcctttatctgcagtatctgaacaaacttcaggccaggcaggagagcacagctcaatttgcttcgttcttgtctgagactcccagtggtcacattgctgtcttcaccacagagccccttgtagagccaaaataccatggtgagggagggtggatacaaaacattcacattgcacaccttcaccttcctctagcagcccctgggctgtcaccgtggcagcactttgatgctcagcccctcagacctgttgtgttggcaggaaaccagctaactgaagcagagtaaatgaagcaaacaccgcctcttgaaagggccatggtatggctgatgaggagacccaggatcagttactgctgtcttcatagcttgcatgaccacaggccagtcattcagtccgtctgtgtgtttcttcatctagcaagtaggaaggagaaacactcacatgtcttcaaatccacatgtgtcaaatccaaatatgctcttccctcttcctgctggacattctgtgatgcagattctccttccgcttcttacatctgtttttctttccttcaacctcagtgcatgttgtcatttatagtcaagcaattcattcctatttcttctcaccacccactttgtgcagagccttttacgctagaacctgcccaagaacaggaagacctgggttccattgcagataaccccagggttccttccctcccacactgtagttaatcccaattgcctggcaccaactcatacctgagctgtggaatcaataatttctggattttatgatccccttgtaaacgctggcaaaatcaatgagatttccataccagagggtggggaacaatgaagtagatgctattgataattagttcttttacagaaatgcaaggtaagtacagggtgtttatgccacttttatgcataatgaggcatttatacaaacaacatccacacagctagttgaactgcctggagcaaaataatattcaaccttcaaatttaataactgcataaacttagaactgataggatgctttctgctctggttttgaagtgcctaattaagtacattcaaggaggttattttgttttgttttgcttttagccccctccctttgaaacccacttgtggtcagtgttagagagctgatggttttcttaatgtgtcattgttatagaacatgcctgtgattctgtattcttcagtgtaatacctgtgtttctgtgaaataatctgtgagatttcatgctaagcattgctcttgtcttttctatttttattctaagtatattaactgatttccttggagggacgtgcttgcaagcttgggtgtatcttggtttatctaataaacatgctcctggcacatattgtgtaaatctaattttaacaaattgaatcatatatttaaatgcctgaggggcactcattttaagaaattaatcatattctgaattttcagggaatttttacacccaaattttattttctgataatctaggttttcacttgatttgctttatttaggtgacactgtaccaaattattaaattcattgaggaatttttaaaagcaaggcattgagggaaaggattctgggaagatggtagagtaaaaagcaccaggcatctgcctccctacctagacaacaattgcattgacagaatctgtctgatggaactttttttgaagtctggcatctattctaaggattgaaacattcacagaaaggcttagaaggtaaattgtggttaatttcagtcatataagctggtagcaaagtggcagctacccatcccccagtcctatggcagggagctgtgcacctgttcctagagtagcttgcacacagcttgtgggagccagtgcaggtgaaaaggaccctttcctccaaaacttggggacctgtgttctgattgctgcttctgaatgtggagctgcaaacacagagggggcaactattgctgtatccctccctcatttgttgcaagcccctccccctctggttgaagcaatttccagggaacttatatggccagtaaccccctttttctttttttctccttccccctcatttttctcctttgcttcttttggaaaccaggcatttaaaagcaatcacatgtgcaaaggcaactagaaagtcactatgcatgcccaaggaaaggcacaggcctaaagaagacctgagaagaccttaggtttacacctcaggctggtcaacagcacagatacaacagagaacaatttttttaaaagaaaaacctggggaagggggtagtctgatttccagagttactatgtcattagatcaaatatccagttttcaacaaaaatcacaaggcatacaaagaaacaggaaagtattgtccattcaaagtaaaaaataaatcaatggaaactgtccctaagaaacaacagatagtagacattgctagacaaaggctttaaaaacaactatcttaaagatactcaaagaactaaaagaacatggggaggaagtcaagaaaacaatgtatgaacaaaatgaagataccaataaaaaaatttaaaaagtctaaaaagaaaccagcttcacaactggaactaaaaaggacggtaactgagagaaaaaatttatcaggatacaaaagcatgttagagtggacagaaacatcatctgtgaatttaaagataacacaataaattacagaatctgaggaatagaaagaaaaagcatttctcttttgaaaaagtggacaaagagtgagggacctgtggaacatcataaagtggaccagcatgttcattgtgggattctagggagaagagagagagaaagcggtagagaagttattcaaagaaataatggctgaaaactttctaaatatgatgaaagccatgaatgtaaacatccaagaagttcaacaaactctaagtaggatgaactcaaagagaaccacactgagacatattataatcaaaccatcaaaagacaagcaatcttgaaagcagtgagagaaaaaggactcatcacgtatacagaatactccaaagattaacaactgacttctcattagaaactatggaggccagaagacaatgggctaatgtatttagcaaggaaaaacaaaacaaacaaacaaaaaaaattgtcaaccaagaacccaatatccagcaaaactgtatatcaaaagcaaaggggaaattgagacattcccaggtaagcaaaagccaagggagtttgctactgctacacccaccctgcagaaaacactaaaaggaggccacagattgaaatgactagaaattagcttgaagccatatgtagaaataaaggtctcggtaaaggtaaatacatgagcaattatagaaactagtattgtttcactttggtgtgtaactccacattttgttttctacattatttaacctattaatgcataaaaaatacaagttcatgtttttggacatacatacagtgtattaagacgtaattttgtaatatcgataactgatcccaacactttgggaggccgaggtgggcagattatttgaggccaggagtttgagaccagcctggccaatatggcaaaaccctgtctctactaaaaatataaaaactagttgggcatggtggtgcgcccctgtaatcccagctacttgggtggctgaggcacaagaattgcttgaacccaggaggtggaggtttcagtgagtcgagattgtgccactgcacttcagcctgggtgagagaactgagactctgtctcaaaaacaacaacaacaacaaaacctgaaaagggtgagggtgctgttgcataggagcattttttgtgtgtgttattgaagttaagttggtatcaattcaaattggagtcttataacattaggatattaaacgtaatccttagggtgaccacaaagaaaatagctatagaatatttacaaaaagaaatgagaagcaaattaattcactacacagataaagactaagaatgaagactgaattctaacatccatatatatatgcatgttattcagtcttgggaataaaggaaatcctatttggagtgtcatgaatgaacctggaggacattatactaagtaaaataagccagacacagaaagaaaaatattacatgatctcacttatatgatgaatctaaaataatcaaacttaaagaagcagagaatggaatggtggttcccaggggctgtggggtgggagaaatagggagatgttggctaaaaggtacaaaatttcagttataagatgaataaattctggagagctaatgtacagcatggtgaccacagttaattatactctattgcatactagaaatttcctgagagtagatatcaaatgttctcagcatcaaaaaaaaaaaaaaggtaataatgtgaggtgatggatatgctaattagcttgattatgataatcatttcacaatgtattcatatatcaaaacatcatgtgtacaacttaagtatatacaatttttatttgtcaattatatctcaacaaagctggaaataaaagaggaagcttctttaaagatgtgtctatgatttcccagtgacatggatcatttaggattgtaatcaaccattgaaactgttagttagccaactaaatctcttatatacaaatagaaaccttgaatctcataaaatcaatacttaatgaatacctactgcatgctgagttccagagacacatgaataaaggcgatgtaggctgtgaccttattatactgggctggattctgtggggtgggactgagtagaggggatgactcgctttatctgggggcatcggggaaggctttctaggggaccagtctggatcttggaaaaagcagagagctactttatgctttaatctgcattaaaattgtccagtggtaaagcttgatatgctgtgtggatggtaaatgtttcttacttaatcagaaaagcatcctaagagtgatggattctaaattgatttttactgcagtggatgcatacaaaatgaatgaagggaattagtctatagttcccccacgcccctaccctaagagatagtttgtgtgaaagattatacatgagtgaggaaacaacagggccaaacctgaaggatgaaaactgattgacggacttgagttgaaaataaaaacaagcaggacgaggctgcgattgcaatgtgaagtcagcatgcatctactgtaatttattcaaatccaaccaggcccagagagcaggccaggcccccttctgtccactccaccttccacgctactcttgggtccacactctggagagaccatgagatcaaacataagaatcctgcattcctctgtcagtttcagctcttcacctgcctctgaagtgtagtaattacgtcatggccctccagtgcaaccacgccctaacagaagcgagccacttcagctgctgcatctattccaatgctggaagaaaagctattcatgcctatgggcatttggggcctataggaccttaatccctgcttgccctcccaagctgagatatagttacacttctagaggacagggaaacttcctgaggggtgtattagtgcattctcacacagttgtaaggaaatacctgagactgtgtaatttataaagaaacaaggtttgatgagctcatggttctgcaggctgtacaggaagcatagcggcttctgctcctgggcttctgcctcaggaaacttacaatcgtggcaaaaggcgaaggagaagcaggcccgtcttacatggttggagcaggagcgagattagggagcagatactacgcactattaaatgaccagatctcagatgaactcatacactatcgtgaggacagtactgagggggaaatccgcagccatgatccaatcacctcccaccaggccccacctccaacactggggaccacaattcgacgtgatatttgggcagggaaataggtccaaactgtatcaaatgggggggatgtgtctgggtggaagtgagtcttttatatatttggagtgattgagagagtcagaacaacagtgtgtgcagagcgctcttggttgtagagaccagcgacagcagtccaggtatgacggaaatgaaaatgttagccatggcttagcaaaggtcttttgaaagaaacgagtgtagatgtttgctcatggcactatttctagggcttaggtcaggggctcaagggccattctcaagggtttgcaccaggataatggagaggaggaaaaagcctgagaagttggcaccttaaaatcagcaagactgaagagttcattaagtatgggctgcagagaagaagatgattcaaaaatgactgagaagcttgggtgttaggatggtgatgccgttttcagcactggagaacacaggagacgcaggtggtgcattgagtcctggacgtggtgagtcggaggtgctgcagggatccccagacgagcactcacagaagcaagttggaagggcaggctctccatgcctgtcccgtggccagcatcatttctccactccctgtcaccctcggaggaagagtttcatccaaaagctgggtgagcatgcccaggtacagctaggaaagtggaaaatcagaaagccaggagaggaaaatcagaagttgaataaaaggaggatgaattcagggaacactcatcccacactgtctagcgttacccttcagggtccctgcaaaccatctaggaaagagcatcacagtggaactcccagtcacacttgtgaatgtggaacccttcttggtgccagcaacaagtacagaattactgagtggcccctgtgctgtggcttcagctcactgctcaagggcaggggccacctagagactgaggccgcctggctccagccactggggaggtttcctaccccagcactaaggaggctggtggtgagggctcccaggaaatcagaaaggtcatgaaaggagtggaggttttgagattgcaaaagaaaatttctggccaggtccagtagctcatgcctgtaatcccagcactttgggaggccaaggtaggtggatcacttgagatcaggagttggagaccagcctggccaacatggtgaaaccccatctctactaaaaatacaaaatgagctgggcttggtggtgggaacctgtaatcccagctactcaggaggctgtggcaggagaattgcttgaacctgggaggcggaggtggcagtgagccgagattgcaccactgcactccagactgggtgacaagaacgagactctgtctcaaaaaaaaaaaaaaaaagtttctaatgaaaaagggaggcaaggtcactatgtggagattagataatcaaactctgaaactgttcagctgggtagaagaaagcaagatcatggatgtgacaatgtgttgatgttcatgcttgttgtcttacctaatgtacaggcagagaattgacaacatggctgttcttaaaattaggttgaggtttaagagaactaagcctgtaagagtgatgaaggctgacttaagcattccgtcttaactgggacatagaaaacctcgagtctgctattgactctgtcagtaattcattatgtggcattatatatatagtctctgtgcattaggggagaaaccgaggtgaaaacaggaattatttcctcagagcacactgactgccaaggtgtttatacactgcacaaggaagaggaaaataatacttgccacctacctacccattaggggtgacgtctggagagaggcattcaattttcggatgaacgggtttatgaatagcagcgtatcacctgcttctgatctgtcttatttttgcatcaattcacctcctgagtgatagtggcaatggtgccacttgtcctttgagtcactgattccatgtctcctcacccagggcatgtggaagggaaggtttgagagaagtgaggccccattctttaaggtgtgatagaacattactaattaaacacaaaaaaatattttttaagcaaagttactgcatggctaatgtattttatttatagatccccgtttctgggtcctttaaaggaaaactgttattcatgttaggctgatcctaccttacctatgtcacttgctaacttagtaaagaactctttttaaaaattcagagagtgtcatatttattttccatacatcttgtcatttactatatatgtttgtaaacaaatatgttccatttcttaggagacatctggtttctaactggtttgacttaataaggtaacagaagttccatgttcaatctgccttcaagggttgcattctcttagtgatttaatgcttcaaatagtgtttcattcaagggcagattctgattctctatttctctcctctcacctcctctttccttctcagacatgtgggaagtgacccttgcatagagactcggaaaaactctgaaaacagaacacataaagctttaggatattttcaatgacccattcctgttctttcctttacttgaaaaagttcagaaagtccaggtctaggtcacattctaagagagctcacccagagtggactctgcttaaccaaagccttcaaggggctctttcaggcatgagcaggaaaatacatccacaagagtccccgctgcatgcagatcccagggccatctgctgtgctctcagagatgctcattgttgtcatttaactgcgagggccacagaggggacaactgcagattcctgctctacagctagactcctggggcccaatacaggccacagctcttcgcagccatgagatatgcgagcacgctgcctaactcatctgtaccaccatgttctcgtctgtgaaacttgggtattaacagtacttacctcatgggtttgtttcaaggattgagtcaatattagcaaagcattcaggacaccacctggcacccagtgagtgtgacgtaaatagtaaagaaattggcttttcctggcacgatgatcaagtgattggtgcccagcagctctaagcaaactgtctttgaagggagagaagaagccccagcagagattgttcagaacagctcaacgtcatgcaggagttgctcagctacacccatctcgggatgatggagactccaagtgttacgtattttgcaagcttcataaatctgaccagatatagacaggagattgtaacctgtgctttttgtttatgaatcttgtattgagttgttgaagatggttaggacaatttaatgttgcataaaaaccacttcttgtaacatcttaatagtgagaataggagggtcaaggcaagaaaagtgctgagaaaacaatccccccaaaaagtttctctcttaatttcaacatcattttatgtatttttgttgttgttgttgttggtttgttttatagctttaaatgttaggattacattttggggcttattattcaaatcaaatatctggcaccattcattttctgcttccacatttgaaagaccaaatgttcatcatttctggtgtcggttcagcctctggcctcctttctaagacacattttgtagagtattagttttcccattcatagcacgagaaaaataatacattccttttttataatagaaatgtgatttgaggttgcttacagagtaggtagaggtttagggggaaaggctgtgttttgtgtggctctaggatgaattatatgaaataagataagagggaaagctatagtgggtcacttgaatactgacctagtattcaactgtttttgaaaagaagttctgctctgctgtaactcctgctggccttccagaagcatcagctgtgtcacaccacaagtcttaaaggatctcccttgtttccactgcacatctgcccccatgaataaactaagtgggcaacatggtcatggttatgtgttcttagctactctgtcctcagtgtgtgaaatgcccacctttaggggcgctgttggggtgaggcattttagctcccaaaggatcctattagagtttgaaggccctgagaccagacagccacactgcacagaggggcagcctggacccacgggacatgagatgagttaatccacagttagccaagaggttaccgcagaggtagatattcacttattcaaaatttaagtgcctactatgtgcaaggcagaaatctgcgtctactttctcctcatcagcaaaagtagttctacttttgtttttggtttttctttttaagaaaaaaaaaatactgtggacttctgtataatactcattttagccaaagaattctgcaactgaagagtttgagtcagtctccatggcatccctggatgagttctggtcatgaaggagctcaaatgatccttgtcagccgggggaataagctagacccaggccctcccatgcctggcctcattcctttttcaagggaacaatgccatacctcactagaccctagctatacattcctccagccaaatgccaggaagcatctgaccatgagactttaagagcaaaatgttgcttaaagaaaaaaatgggagctgttctaaattcaagagctaatagatatactcttccattttctatggtcaaagtcataacataacaacatcactacaaatttaagaaatagctacagttaattcagtagatattgtagtgaatgaatgcctgaaatatggtttgagggtcacatatttaacctcatcaaacctcaatttattcatcaaaaaatagaagtgatcattattttgttgtgaagaacaaatattataaaggaccttataaaccataaagcattatacatagtttatccttctcttttccattccttaagcaggactgtcagtgcaattgccttatattttagtgctatggagtacccttatctttttgctaaatattacaaatccttttgcttacaaattagtctgtcacttctattcgatggattatctgtctacctcggggcttctgtgatgcacagagtcatgggctcactctctttggctcatcttgtaggtttgcaatcactcttacaactgtcacttccagccgatccaggactgctgcggcctctctgctctgaaatacacctagtatgtgaatttcacatcacttctcagtcataaaacagacccatcagaagctcattttcctaagtttattttaaatttatagagcattcatttcatccttctcggtaatcttttttttttttttttttttgagacagagtctccgtctgtcacccaagctggagtgcagtggcacgatctcagctcactgcaagctccgcctcctgggttcacaccattctgcctcagcctcccgagtagctgggaccacaggtacccgccaccatgcctggctaattttttgtatttttagtagacacggggtttcaccatgttagccaggatggtctcaatctcctaaccttgtgatctgcctgcctcggcctcccaaagtgctgggattacaggtgtgagccaccacgcctggccggtgatctttttctctttctcttttttcttttcacttgctgctattctatacatgcggaggagtttttggaaggaaaagagggcgccttattaatggtcattttctactaatggtgattttgatactattagatacctactatgggcattgaaattggtctctagttccattgagaagagtagaaaaatttctagtataagtacattcataatgtttagataatatcttgagaaaaaaatagacaaattcacaagttcttctttgacttgatagatttctgagttctcatgtgtttgtccatcttcattctgctttaacgcatttacacacacacacacacacttccttttctatttgttcagctttactgagatgtaattgtgctatagttggtttgtgtgacccctccgaatcgcttgttgaaatttgatccccactgttagaggtggagcctaccgggcggtgtttgggtggtacaggcagatccctcgcgaatggcttggtgccctgcccatggtaatgggtgagttctcaccctgctgttcccacaagagctgtttgtttaaaaaagcctggcacctccccctcgctctctcgcttcctctcttgccacatgatcccttcgcaacagctccccttcgacttccactgtgaccagatgcagccccagaagtagacactggtgccacgcttcctgtgtagcctgcagaatcggaagacaaaaaacccctttccttcataaattacccaaccccaggtattattttatagcaacacaagtggactaagacaaattggtatatgaaaaccacacataattaatgtgtacaatttggtgagtttggaggtatacatacatttatgttaccatcaccacaacaaggagacagacacatccatcatctccagaagtttccttttgcgtgtctgtgtgagggaagaaaacttaacataagactactgatacagctccgaagactggagaaacaccagggtcctttgtctcatgccaatgctattaacgacaaggacacccgtggagtggttttaaggagcggagagtttaacaggcaagaaacaagaaagaagaaaacagctccccggtacagaaggagctgggctcctaacggagaaaaaccccgtgtgcccaggaaaaacagttgtttatacctggaggctggaggaggcggtgtctgatttgcttagggcccaggggattggcttgaccaggtgtgtcattcacatagccaacctggtcctcccaccctagccttttaatatgcaaatgcgggtcggcatgatgtcctgcacacgtggtgttatttggaggcagccatgacagctgtggtgacaaggagaagagggcgggaaccgccatgtcgggtggacctggtttttagctgctggcatttacatatcaatgttgccagcctggtttttcaagctgctttctgttagaaaggaaatggtttggggggtcgctttttattataggaaaattccaccaagaactctcaccctttctagctgcctaaaaattatttcttaataactcctatattactaccctcctaacagaattttaagtgcacaataccttatcgttaactctaggcaccgtgttgtacaggagatctctggaacttatcttgtgtaactgtaatttgataatccattgaacagcaactctgcatatgccccctctccatccgctagtaaccagcgttctattgtctacttctgtacatctgactatttttagatgctccatataagaggaatcactcagtatttcttcttctctgactatttcacctagcataatgtcttccagatctgtccgtgttgtcacaaatggtagtatttccttctttttaaagccaggatagtattctactatatgcatataccacatttcattcatcagtggacaattgggttgcttgcacatcttggccactgtgaaggatgctgcagggaacatgggagtgcagatgtttcttcgagatcacaatttcagttcttttgggtatatacccagcagtaagattgcctgcttatatggtattctattttaattttttgaggaacctccatgctgctttccatagtggcagcagtatgtattctttggagaaatgtctattcaagtcctttgcatgttgtaattgtgttttttgggagttttcactagtgagttgtaggagctctttgtatatttcagaaattaactccttatcacatacatggtttgcaaatatgttctcccattgcataggtggcctttccactctgttgattgtttcctttgctgtgcagaaattgatgctgggggaaaaaggggatttgaagtataggccaacttcagaacaatttgaccaggacttgctaagtttttttttaaattaggaaaatacatagaatgtgacttaaaaaaataatcaattacctaagaccttgtctactgggtcttaagttgaatttctaaattctggagccaactatgtgaccttgggcacgtgaacaaaagttaattctataaactagtttaaatcctgtaggaatataacattattttattttattttatttttcttaagaactttttggaaaagaggctgaggaggttaggaaagagcctctgattttatgaagaaatgtccagcatttccccaggaatgggattccacacaagaacaccagctggagcagtgccgtagagtcaaaggaaggaagaggctgcagttcggcaccagtggggaagccaagggcatcttgcatgctggcaccttcgagaggccgtacagctggagggtgcactttgcattgccccatgtaggctctgtaattaatatggctgtaaattttgaaaaactgttattctggcagtcaaaaataatcccctatatataggcatcatgtaaacttttaaaacgtctttcacatccttcaaaatgtataatctcatgaattacagtctcatgaaaatatagcaaataaatatttggaattataagagaggaaaaaataaagaagtgaaaaggatttgccctactccaaacaaagcaatgcaattgtgcaacggaaggataagtcataagaaaacagtagagcgttcagaaaaaactccaagagtgtatgtgggaatgtagaaattcaataaaggtgatattttaaatcagcaaggaaagactagattatttattaaatgaaattgagttaattgattctccatttagaagaaaataaagtcaggaggtatgtctcatagcagtctccagatacttttaaggatgtttaaagatttaggtgtaaaaatattaaatctataaaagtactagaagaaaatataattttgttaaataatttcagagtgaggaagccattttcaaccacagaacaggttctaggaagtataaggaaaagattgatgggtctgactatataatataaacttaaaactcacatacagtgaaaaaactcaatatagagctgcacagcaaacggcaaattggaacaacataatctcaacacatgcaacagtaaaggcttaatgcccagacctatgaaagacccctaaatagctataagaaaaagacacacaactcaatagaaacagcaattcagaaaagaagcatagtcaaaaacaatgaagaaatgagctacctcattaacagtaaattcaaaccgctatgaaatataacctccagtttttatgaaattccaaggaaatggacattcttgttaacagttgatgagaaggcaaataagcatgatgtttttgaaagataattagctttcttttaatactaagtgtgtataccattcaacccctaaactctactcctaggaaactatcccacaagaaataacaacacagatgtcaaaatagtaagaatttctgaattttctgaaatagtaaatatttctgtgcagcattttaatcaaatgatacatatgttctgccttaggaaaaaggagcacagtttattgtaacataaaacatgcacatatacatacaaacacttacacattgcagatcaaaatgagctgtctacatttatctgacagatggtctgtgtgtctgtacgtgtgtatatacatacaaaaacacttacgtatatcctagtaacagcataggaaaaagattggacgaacaggcacctaactgtgatgattctttgggggtcaggggattgctgggatgataaatttttatttcaaacaaagtatgccaaatgacgctttcatttataagataccaaaatacaatggcgttcaatttcactcagtagcatatgcaaagaattgtctcattaacctctgaatcaggcctttcaccttttgctggaatggctgaccttgagaccaaacactagaaccacccatggaacacctgttgaatacattaatccccctagatgagccttcccacttctgttcatttcacagaactaatttctatggcattttatttttacacaacattgaaaccaagattgtctttggtatttatgagggcatttacaaaaggaacagagcaaatgcggttgagacaggtcacaataattctctctgtctctctgacacccagtgtttcaagcttcaccttccttttacacatactcaattaaattaaaatacaacgtgcaaagaaagcaatggcgaaagaatctgaaagggcactgcagaggtgaaaatcaaataacctcatataaacctttcctattaagagtgaatatatttagatttttaaaaataaaaacccagaataattatgaaagcaaaatgccacagacccagatagacagggaaagaaaataaaggtgctgtaaatccacaaggcccatggtgttcacatttcttcttgttttgctcagctctgagctgctggcaggtgttgacccgaaggggagtctatccaggcacccaggtagcactgctggccaggtcagatgccactggagggagggtggaaacacaggtcaagtgctcttgagcccctccccatctctcaccccagctcttcatcgctaagtagctgggaactgactacgtagcatcaattacacacgtacaactctgaggagttgtcagactttagccctaatagtgccttcagtttttttatgagactatgtaaatgaatgccaacagggtcaatgaagtggcaagtgccatttctaacatttaacaaaagtggcgtcatttccagagctctgcccagctctgactctttctcctggagggtgcaaaaagaaaaacagaaacttttctcgaaggcatcatatttcagacaagtattgtttcaattatgacattttgtcaaattgtgaagtttaaaggacaaattgcctcggcctattcctgcttaagccttttcatgccacttatggaaaatagcctgtgcttttaatgggtattttgtcagttaatattgccatggagagagaacaagctgtagcttccttctgctgagacttgaagccccatgaaggacagacttgtctgttttgtccactgcttgtctctaggtctgccgcacaagtgtgtccttcacattcactattgttaaataagaatcttcaggtcgccttataactgcacaccctcaattggattaattcttattagtttccccttcctgggctatagaattaggttagtcatgacactgaagttgcaaaatgcttgacatagaaaagtgtgtatgctctctgtcatatatgaagaagtctttatctttacatttacagaaatagtttatcgtaaagtcttgtcatttgagtctcaccatgtcatcaggacacaatgtgccataacttccacacatgcttgtagctcagagtgcacagtttagcctgatgacagcctgctgattatttataaattaacagatccagtggaaatattatatcttttgtttggcagaaatatatattttaatatgtctcacttgtttttgtaatccatctcataacatgaactttagaatatgtactatgtatttttaaaggtatttctttgttccttgattgtggtttattatttttcaaacagcttcaaaatttccaatttccagaagatttttaaatttaaagtgtaattgttttaaaataccaaaattggtgagattattgaagaagatgattctctctactcaggaaagccacttaaaattggatgaaattgaggaagtacagcaaaagcttaattctcaggatattaatctaggctttctttggaacaagaagcagggctgagaaattgccctcagttgtaaatggaaaatgagtttaagcatcctcctaaagaatcataatttagttctagtcagaagtagctgagcaggagaaaacttgattacttaaaggcactaagtatattaggaaacgaaatacaaataccttcaaccagggccgctgctgcagtctggctgtgtaaggtctggtattctgatggaaactgataggctccattagagatgtctatcatgtagaaaatgaatttaggatgcctttgtcatttctcttgtctgtaggctgagcttttttaaaaattgagctatattcatgcaagttatataacttaatttactgctgaaatggaagctaaagtggttagtgcagtgatactcagcctcagaggctttaaaacactggcagattgttcacacagaattgtgcctgatttgcctgatgcatgccattaggatgatcatggacaagatctcagactgtcatttagccaaaactgtgtacatattatgcatagaacaactcacccaaaattgatagctaatgggaaagtttccaactaaataaagatttggaatccatttaccgctcagtaagctatttttgctccatatcatcaagtttccagaagtaactgctccttacatatattctaaagaacgtataataaaaaagcccagtgacaaaatttgatttgatatatatctcatccatctgttttttttggtagaaacctaggtggtatgtgttaaatgttaagtataagagaattctcaatattttaaaaataactcaaaatattgaggaaaacacctaaaacccattgatgattgtggtagctcaggctctaacagtttcttaaaatgtgtccatgtacacactgggttagaatcactgttctcatttacaagtagagcttcctaggccccacgattctcattcattccttaaatgagaatgggggggaagttggggaagggtctggaatttgcatttaaacaatttgagcgcgatttgaacatgcattcaaattccagaacccctgctttgatattatgtcaatgattttggaggcagatttagtcccgtcacaggacattgtcgttttttaggtgcccaggtttcttgtgacttcatccatgagatggcatgtacagtacctgagtacctgccactgggcaaaaagatgaccaggtgagagacgaaggaatgagactgcagccctcaccatcagggcacaaacaccccagtctcacattccgtcaagagtcgttctattacttacatgtcatccactctagacagtgcctacatttcaatgttgagcgtgttccttgttttcttatgattagaggtgacacagtactctgtgtccagtggccgcccaggtttttgaggtaagcaaacactgtcctcctgatcagcagcctccatcttcctactgatcacagggcagcgtggcagtggttaggagcacggactccacctctttccgactgtacatccttggccaaggtatccaacctcacactcagtttccttcctacctcacactcagtttcctccctcagtttcctcatctacatcataagggtaacagtagttttggctgtgaggattaaatgggtttatatttacagaatgcttaaaacagtgcttggcaaattataagagcttatttggaaaaataacaagattagaaggggtggatcattccagaaaattaaggaatcaaagagaaagatggagagattaacaccaatctggcaaaggaagccttccaaagaaaagtgtacctcatgtgtctcttatggttcctggggacatagtgggacaaaagaagtaaaaggagaaatggcaaaggcaaaataagcattgtcttagataaggaatgagggaacaatgaagaaaacagggctgcatagtcacttatataaccacaaagccgcttagtcctatgtgtgccttgactatgtgtatcccactggaatgaaggtggctgcactgagcacctttgggggtggaggatgctgaacaatgttagcaaactgcattggatgtcacacccagcttccctgtgtctgtccggagaaccctcctttctcctggtcttctatgcccaacgtctggctatttcactttattttttctcctcccttggccttaagtcaggaactaatttttccccactttgcccttcctatgtcattattctttcctttctttcctactttcttttctggtaccctattttgaatgtgtgtcacctttaacttcaggtacatgaacaagctcttagccagtctttggaagcatctgaccacagcacctccaccacttttctgtgcaaaacccttcaatgaccctgcacaataatgtcaagactttatcagtgattttcaaagatttttcccactttgggcacaacgtgcccttctagcatcatctcccactactgggcctctcccccatacctaatcctcctcctacaagccctgctcttgccaggctcagcaagcaggtccatggactgagagcacctttgcacttagcgggtcctttgcctggggttgtgtctgatctggcccaggagcagttagggaaacgttactgggccagaagcactgcaggtgggtgtactgagttgaaaagtctccccgcaagatccatgtccttcccagaatctcagagtgtgaccttctttggaaataggattgtgtaattagttaagataaggtcctactggagtcgagtgtgtcctaattccaatacaactggtgtcctcttaagaagagaaggtacagtcggccgggcgcagtggctcaagcctgtaatcccagcactttgggaggccgaggcgggtggatcacgaggtcaggagatcgagaccatcctggctaacagggtgaaaccccgtctctactaaaaaatacaaaaaattatccgggcgtggtggcgggcgcctgtagtcccagctactcgggaggctgaggcgggaggatggcgtgaacccgggaggcgtagcttgcagtgagcccagatcacgccactgcactcactccagcctgggcgacagagcgagactctgtctcaaacaaaaaaaaaaaaaaaaaaaaaagaagaagagaagttacagtcacacacagagggaagatgacatgaagacagtcacacacagggaagaatgccccgtgaagatggacgcagagagggggccgatgcagcttcaagccaagaaatgctaaggattgctggcaactaccagaatttggagaggcgcataaaacaaattcttctcttaaagccgtcagaaagggtggccctgttgagcccttgattttacactatgagacacttgtttttagtcaccaggtttgtggtatgttttaagtcaccaggtttgtggtacgttacaacagctgtaagaaactaacatggcagctgttgaatgttaagagccctcagctgtgaatcggagcgatcctacctccctcaccaccgaagagtgttgcagggatcaaacgggctaagacgtgagcgtgctattagatgtgtaaaattctacacaagggtcgttaaactttgacttattttttgaaaaccctcccattcccttgcataacccctaccacaatactttacccataaaatgcgttcaataggcacgtgttgaatgttttcatttattcatttactatatcacattaattttattttaaaagacccaaacttagtcataagtaacatggctcatcttcaaactactgcgtagccatttgtgtgcagctttgactgcatgtggtgttatttcagaaagatgtgatttggtttgtctagctgaatgtaagtaatacattcattataatactagcttactatatattaattttaatatgctcatgaagttaaatatctgtggatctgaaaataagatttattttatttaagatgaaaaaatttgttttgacaagattggctggttttatttatgccacttactagaaatctaataaatacatattttatttaacatgactttttaatagcattcctttgaatttactcatcagtaaatttaatcaatcacctttttaagaaacagaacaaacttgctagtcctagcaccataagatgatctcttgcaaggaagtaaagaagaatccaaacttgagtgccaggaatcattattgataaggtgaaggagaacaagtttcccttttgattcccaacttctacttgaaatatgacacccagaatgtgattctttctatatccatttcctctaagaatctttgagcaatttgtgcgtgccctgtggttaatacagcctagtcatagcccagtgaagctgtcggcagtcctgcttagagcagaaacacagaccatgacagttacaagcatgtgatccacagagccaggaaaagaccctgagacataacccacttctgtacctcctcagtaggagctatactcaactcatgaattaattttgagctcttaatggcacttattaaatccagaagaaaaatacctaaataattcttacttatatttaatagcaatttagattcctgcaagtggggacaaaagctttatttcacttccaaatggacttcaaataacatcaattggatgtgcactagaaaaatataattttaaaaggtgttcccaagaattagtaaagaagaaaagtcatgggaattagggagagtaatttctaggaaatttttattggctgcttttgtccacatgatatttacagtgtatgagttaggttaagctagactataccaaagtaacagaatatactaccaaatttcagtggcttaagaatcagtaagttgatttatttttcaggttaataggccagtattggtcaggtgcagatgacttgggagaagaaggatttgctccatgcagttgtagggacatgtggcctcatgattctagtcacaaggttgatgttgtggaggaggttttaataggccaggtctggaaggagtatgtatcacttatacttcttccattggctagaactcagtcacatgaccacacctcactgcgcaggaatctgggaaatgtagttcatcaaacactcaagaataagtggaactgaattttaatcaataactacaagtctctgcatcaaggagaaatgtgtacctgatgtttatcatggaagagaagaataattagttgactttttgtgtataatccccaagcaaaagaagtctgattcatgctaaatcttcctaaaacagaagtagatcatttgtggggaatatgttattagaacacccctagagaggagcctattacccaacttcattttccagcttcattctcttggcaggagacgtatttctctttctgcctgtccacggagtctgtgccacaagcaaagagatgctgtatgtcttgcctataaagcagggctgggctgcgaagctgtcgagcccggtgcaaaatggaaatgtggagctcttgattcaaaagcaggaaagcaatgttacaaactaaaatataaagcttttatctttcttccccagtctctcaatttgccatagtgttttttacttgctatttagctgcattctaagaaaaattaaacatttaaatattggcatgaattttaccgttcatcttaatattgtgcaattccaattttaaacgtaaacatttaaaacagggtctaactcatacgtgcaatcactgaaactaactacacaatttgaatttcgtaacttatatatgtgcatatacactttgttcttgcaagaacagcagacatgtcgcataaaaccaattcacttgtttttatttcacttcttgagactcgcacattctaccaacattctaccttcagtttactgatgaataaggaagaatggaaagggaaagaactatggggtcccctatctttcccttccgttccatgtcatcatttcctgcttcagttgctggctccaacaagaaaagcacaggagtaagaaaggatatgatagggttcattggtcactatgtttcttagaatgccattgccttctttctgcattcaaagcaagttctggttcaaacgaaaagtttggcgtctcggggctgtaagtacccctgcttactcagtaggagatgtcacacatttaccttgacccctgcacactgtgggttcaccaaaattctgtctccaatgggcgttgaagagacttaagccacgcatagagcccttctaagtgcagggcctcaagcaacttcatgttctgtactatactaaagttctatactaaaagacacatatttagaggaaggataccacagaccaacactgatgtctacagcagcaagaactgtaggacatgccgtcaattttgtaatggcttttaaggggaaaaaaatactctattaatgtacatcttaattggaaggtgcatccaaatttcagaaaaatgtaaaataacagggggaaagcttcaattcctggaattgtagcacatcacattcttttccctaatacctacctaacaactactactactaatggactaatatatgtttttaaatatttcaaacatccagaaaaacattgagactgatctatgaatccctgtgtacctaccaatcaactttatcaaatctcaacagtttttccacatttgcttcacaagattcttaaggggaaaaaaacatttcgaataacaccgacaccacctgtggacccctcctgtacttatttgacctctcctccctactctgaggtgatgagtttcctgaaatcattctttatcattcacacgcatacttttttactctcagtatatatatctgtaactagaaacaatacatttttcacgttgtgaatttgataaagaacagtataataatactgtacatatcattcttcaacacgctttcttatgcatcattattactttgagatctgtatttctacatgtgattctagttaagtcattttttttttttttttaattttagacagagtctcgttctgttgcctgggctggagtacagtggcacaatctcggctcactgcagcctccacctcctcggttcaagcgattctcctgcctcagcctcccaagtagctgggactacaggcacacgccaccatgcctggctaatttttgtatttttagtagagacggggtttcaccatattggccaggctgatcttgagctcctgacctcgtgatccacctgccttggtgtcccaaagtgctgggattccaggcatgagccacagcacccagccttagttaagtcattttaataactaactagtgtaattgcataaatataccccaatttatccatttatttgattgtcattttaaatgtttctcctttctctttattataaacaatgattcgggaaatcttcttccgcatttctcttagtatatgtgagctggagtgattttaaggtaaatacctagaagtagaaatgctgggctgaaagttatgtgcatcatatctttaccttttctacatgtggccaaatggctctccgatctacaagcccagaggcagtgtgtgaggtgcatcgctcgacaagccggctgacgcttgtaaatgcccaacatctgaatccttgttaaacacagaagtgcaagatgtatctttaaatttgcatttttcccaatgactagtgaagttgagcatcttttcttgtattaatcaagtttcttttctaaaaattgcctatttcaatgctttgttcatttttttctgggttatgtatctactttttatcaatttgtggtattttattcattatgaatactactgtttggtcatatgtgtttgcagactttagtttttgtgcctatttattcggtcttttacaaaaataagattctaagtttaatgtcattagattcatcaaaatcctctctttgtgatttcggatttttgtaccttgattaagacaaccctccattccctgacatagtagtgtcattgtcccaatctcaattattgacagcatcaccctaactccctgctctgcctctctctgatgtgaagtttccctttgtgcatgtgttttctgcttttcttgttttacccactgcaggtatacagtccctccatctccttcgaaattatctggtctgttcttaaacctttgtgtttctatttgaatttgaagatcaacttgtcaagatccattttaaaaatcttgctggaattattttttggaattgcttagatttacagattagtttatgggaaatttccacgtttaagagattgaattttcccttcagaaacaaagtgcatatctccattaatttagaattttttatacttcattcatgtttttaaattttttccataaagatttgcacagctttcgttagtttcagggttcattttttgaaaacactttgctgtttactacagtccttagatttcctctgtaacataatctcttaaatttattcatagttataacggaaactgttgtactacaccttgattttttgccaatttagggattactgaatgaactaatgcaaaatccattttatgccaatctatacacttggttttgaataatttattcaactaaatactttctaaagagaatcatatgcgatgaataaaaatatcttgaatagattggaaatgttcctgttttgttttcattgtaaatgcatactaaatgcgttaacaacatagaaagattctgggttctagtagattcctcaaatataaacactttggatgcaccactgtttcaaaagatgaatagtttaaacggaactcctatttacagccatgtttgcaaatgcattttttactttaactattctgagatataaaaataagcacagagattttgtgatagctttgcaactagcagtatttttgaaacatgaaataggcgttttgtctggagaagccttatctatcacagtccatgtctgaaatcacagttgtttaatgaactctgttttatggaagctgccgatgcctcattcgtaagtctccccattctttccaatgtcacacagactttggagatgaatttaaatttcatcattatccatgacctacaatgtgtgcattgaccatactagattttccctttttgaatatattcccaacactgcaactccctgccctgctttattgttcgcttgccagtcctcggcatcgttttattcctccggcattttaaacaaaataaagatccaggcttatgctgaggcagtgctgaacaaacccaccaaaatcctcagaactccatccattcaaagaggagcgccaggatttcccaagcgacaagaacagggcgagctctccgatcctttctccatccccccaaacctcccctggctctcgagaacaccgtcagtactccctaataccccgtgctccaaatccggagctcggtctccacccggccgcactccaagtgacagcaataatagctggtgtttctaaagtgcttactggtaccaggggctgcatccgtgtagactcatttaatcctcacagccctaagagagacacgtttgacagatggagaaactgctccgggatactccgtcggggaatggcaggagctggccccacagcccggcctggcgccaccgcgcactgcctgggccctgcagcttggagcaggccctgagtgggctccctgcaaatattctcatgctcccttctcaccaccgccctgcaaggggcatggtactgagctcaccgttttacaggtgaggaagccacggctcagccttccgagtctcctctacctgagcctcagagcctggctcagaggctctgtgcccagaacgacagtacataagaaggagtgggggagcctgtcggagccgcctggggcattagcagatccaagttccaaatttggaaaacttaaatcgagttacaaacctgtcatcaatttgacagtaatgtttttataattacacattgtgatacttacctgcattataaagcaatttaaatgttgttttgtttaacacctcagcttggatctggacgtttttctaacttaagaaccagaacaacggtcacaaatgggctcctgaagaatgtttcagaatgctctgttcacaaccatgggggcgtatctgccacctctgcccccaaatggacaatccgtcagtgtgataacccatcttctagaatggtaattaactcgagaagaggcagtccccaacctttttggcaccagggaccagtttcatggaggacaatttttccagtgaacaggggagaaggtggtttcaggatgaaactgctccacctcagatcattaagcattagattctcataaggagcaagaaaccaagatccctcacatgcgcagttcacaatagggttcatgctcctctgaggatctgatgctgctgctgacctgacaggaggcggagctcaggcagtaatgtgtgctcgcccactgctcacctcctgctatgcagcctggttcctaacagaacgtggacctgtaccactctgtgacctgggggttggagaccctgcttggagatgttctcctttatccctacctgttcattgcaacactgaataaaaatttaactgaaatgttcattataattcacatgcattcaaatacttggttgtacttgggtaactgtcagagtttcctatattacctcactgctctagctttgtcttttgttccattccatacatcatttctagactagtcatccaaaatgagtgttagaacatgagtttagagtcatatagaccggccatatcctgactccatcctacactgcccatattagtttcctgtggctgctgtaacagatgaccacaaacttggtggcttgcagaatgtgttctctcacagttctgaaggccagaagctcaacatcagcttcactgggccgaaggcaagctgcgggcagagagaatccattcctggcctcccccagcttccactgctaccagcattgcttggcttgtggccacaccacgcaagtccctgcctcgtcttcacattgcctcccgctcttctgtgcactgtgtccaaatccccctctgcttccctctcataaggacactgtgattgaatgtaaggcccatctgggtaagccaggatcctctcctaggatccttaacttaatcacatttgcaaagacccttatcctaataaggtacatttataggttctgggagttaggacctgacatctttctgaccatgggtcaacctgtgtgattgcagggaaattatttaatctgtctattttcagttgttttcactgtctaatgggtatctgtttcacagggttgcctgaggctcagaggagacagttgacataaagcacttactgcaatgcttggcaaaaaaaaagagaaagcttttaatcaataactatttgttttgtttctatataccaaaagttcagcatctctccattactttctgtcttaatcccttagtctattaggttggtgctaaagtaattgcaattgccaaagtaattgccgttaaaagtaattacaaaaactgcagttacttctgcccccacctaatagaaatccctatgtccatcatctagttccaacaattttcccaaccttgtcttttactattttctttgtagactttctagtctaactagatgcgtttgctaaggagtccctcaactgaatgttcttgcttctcccctttgtgtctttattctttgttgctcctgcctgtgaaagttgactccttcctctttgcctatccaagtactgtcccttctgccaggacgagccccattctcatcctctccttgaagctttccccagtcaacccagcccaggctggtctctccccttgaggatgatcagctgctctccatgatgctgcctcgctcttaccatgatggctctatacacgtagaccaagctgcatatagacatttacatgctatgtacgaagcacgcagcaatgatggataaaccattgcgacagagaaccccaggaagtcagacctgggctcagagactaaattaacatcttagatccctaggccagaaacagagtaggcagtgagggggcctgaagcctcaggcctcctgagatctcagttgaaaagcagtccgtggtggctgagagcctggcctccatggggtagagaggatgagagtctccctgtggggtggagtaccaggccaggcctgctgctcagaggcagaggccagagtggagtctttcactaaaaatgaaaatagaaataaaataaaaatctgctgccaatgccatctgctgctggactggaggctctaggagttgagtgcagacagccacaaaactactagctgggaaagagagagcaacaattgagaaggagtgaaagaaatggggaaaaacccttttccttctaaaataagtctgcaaataaaaaatttcataacccatgaagaatttccatgctaaaaaaaggcagcccacacaataaaaatttagaacacatgttcattctgttattaaaataaattcctataacagcatgagaggtcccgaaatcatgctagatatccaaagaaataaataggataagttcataaaagtaaaaataaattattttttgaaaaggatagaaatcttgaaacaagagcagacgaatctgaagaagaacaaatgataaattgggttaaataaaataagaagctgcccagggaggatggaggttaacggcatcatgatgggagagacgaatgagctgaaagctgctcttcgaattggaagtgtatttccaattgagaaagattaaatatgtaaattgtatcctaagcacagtgtgataaaactgaaaaacattaaagacaacaagaaaatatttaggccaccaaagagaaaaggcagacgccacaaagacccactggatcgtcagtggaattatcagcagcccgagacacaaggcagtgggttgatatctcgagtgctgagaaaaaacaaaagcaactacctagaattttacacacagttaagatatcacccaagagggaaggtaaaataaagacaatttccgacatacaaagatgaaaagagttcgccaactctacttaactctaagtaaaattacagccgaagtgagtacattagtaagaagaacaaacccacagctaagactgagataccagaaataatggcaagtcccaaaattgataaaatgtcagtaagacttatgaactataggatttttgtaatgtatgtgttttttttttttttaaagccaaactaacactccagacaacaatggcaggatgtcagaggagttttcagtcgtcagccaaagctttgttttatctggaagaaagttaaaaatatttaatcactatggaatttccatacctaaaaccatgctaaaagatttaaagaaaaaaaatgaaaaatccatattaagctaaagaaacataaggagtaatagtaagatcagattaaaaaaaagcattaatggagaaaagaggggcatcgtaggataagaagaagcaaaatccaccaaaatgacgtaaaaatcatgatcctgtattatcctaacaatatagcagaaacatgtaaagtaaaagctaacaaagtgataagaaaactggacaaatccacaaagtaaaggatcataactctaacagatcaaataaaaaattattgaggatatggatgattttttagtaagaaaattaacaggtgagttttgacatatagagaattctgcacccagtagcgatagtcctttgtatgctcctagaacatttacaaaattgaccatgaagaagattaaaatttcaacaaatttaaataatttatattatttaaatgatattctctagcaactaaaaaaggtacaactaaaagtatagtgtttgaaatgaatttataattcataagctaaagcactggatgaaaataaatgtagaccattcaatttaagaattagaaagtgagcaacaaggtaaatgcaacaaaaccagaaataaacaaaagagcaaacattcatgaaatagatgtcaaggaaatggtaaagaggatctgcaaaacaaaaccaggttctttgaaatagcaaataaaatacacgtttcaccaagaatgagcacaagaaaaaagtcacaagtaaacagtaactcattcataaatcaatgcaaatgaatttggaattcagttgaaagaaataatttactagaaacatataaattaccaaaaaatagaaacccaaaataagccaataaacattaaaaaaatgaataagtaatcaaaagcttccccaccaaaaagaagtcacatacccagttcattttacaatcaattttttctaagtatttaaatatcatttctttctctcaaactattccagagaactgaaaaagaagaatcgaagaagaaggtaggataacttatgtgagcaaaagacagaaaatatatgaacatagttgtaaaaatcctaagtaacatgttgtcatatttaaaaaatcctaatagatcaggatgaagtaggactgtccttggaatggacgtgatcactgtgttcccagagccttgctatgtggtttgagaagggcactgcaccctgtgatattctctccataaaacataaccccaacttcatgatgagaaactcatcagacaaacccaactgaagaaattctacaaaataccaggccagtatttctcaaaactctgaagatcatgaaaaataaagaccaagaatccgtcctagaacagaggagactctggagacctgagaactaaatgcagggctgtatcctggtggaatcctgaaacagaaagaagacagcggtggaaacgctggcgaaatccaaatgctatctgaagcttagttaaaaggaatatgttaacgttgatttcttagctttgacaaatacaagatttaatacaagatattaacattggagaaactgggtgagggatgcagagagctctctgtactatctttgcaactcttagtgttagtaaatctaatactattccataataaaaagtttataaaaaaataaaaagttcataaaaaaataaaaataaaacacctcaacagctactcatgatggaaactcttagcaaaccacaaagggaaaggtgtctcagcttgatgatggtgtccaccatggcttcgtggtttccaacgcataagtagaggttttatttcacacgttgtagtgaggattaaatgaaacaatatgtatgcgatgtcttatgaattaatattattattcctgtgatcccagagcaacaacatcagaagtcggcttgttgctttagcgcagagttcttggccttctttatgccatgcagcacttggacagcccaggaaggccttcagaccacttctcagaatgtctgccaatgcataacacacaattcatgtagttactctgtgtgtacatatacagttgttaaatcacaataatactttttttgatattgaactaaacttccattctaaggatagccctatttggtcaccatgtgtggctgagaaatcaacaggcctgggcgacgtcagcaaggaggtgaggcagagagaagaatccacgtccaatgccagggctgggtctcatgggtgggtgggaaactcagggcaaagagatcctgagaggggacggggaggaaagaccaagaggtcggtgtgggaacttgttgagtttgagttgaatgatgtttccaactggatatttttcataattgcgtaatcttttctgaaaagtagttttcaggccaggtgcggtggctcacatctctaatcctagcactttgggaggccgaggtgggtcctgaggtcaggagtttgagaccagcctggccaacacggtgaaaccccatatctactaaaaatacaaaaattagccaggtgtggtggtgcatgcctataatcccagctacatgggagtctggggcaggagaatagcttaaacctgggaggcagagattgcagtgaaccgagatcgcaccactgcacttcaacctgggagacagagtgagactccgtctcaaaacaaaaaaaaaaaaaaaagggaaaagtagtttttaaatcttttgactgaccatgcactcactccatcagtttaaaaaattatgcatgaaaagcaacacacatacacacacatacatacacacacacacacacacacacagttatattactgcaacaacgtgggttagtaatatgtaatgtatattacagtactaacgtttgcataatgaaaacacacgaataaaaattgtaaaggatgatgttaaaggtaatacaggccgggttcagtggctcatacctgtaatcccagcactttgggaggctgaggtgagtggatcacctgaggtcaggagttcgagaccagcctagccaacatggtgaaaccccatctctactaaaaatacaaaaattagttgggcatggtggcgcatgcctgtaatcccagctactcaggaggctgaggcatgagaatcacttgatcctgggagatggaggttgcagtgagccaagatcacgccactgcactccagcctgggcgacagagcgagactctctctcaaaagaaaaaaaaagtaagcacagatataagcatttttctctctgcatccctttgatttggtgagctccaggcagtaacatcaggtacagatgtaaagtctgaaaaaaacagaggagttgtgtctgcaaaggatcactttcacaatgaaagactagagcaggtagagagattggggacccctcccaccctcttttccccatcccctctgagccctgctgatgttgaaaggtagctgatgcctcatgcttcagctctgagctttactgctattgatgctacatctcagtgagttctggcttggagaccactggtcccacccaacccaccatgagagacgatttgtgaaaacagcccagagtctggagtctgaatgccttggtttgattctggtctctatccctttccagctaaatcttacatcttagacaaatcatttgatcactccaagccttggttttctcattcataaactggaggttgtatatttcttttcacagtgtaatgaggattaaatgagacaatgcaaatcaaagtgatttgtgagctagaatgccaggaactacaccagcatttgttgttactttttgtataatcaaacctagtcatgcagtgtacattttcctgtctacatcttccatcaactgtaaatacaatgggtcatattctgcctaggtccagaggtggcaataattctgcaatcattaggttaccttttcctatccacagcacttgttttcctgtcctatgcaaaacactggttttcaagctgggatgattttccctcccaggggatgtttggttgctcccagtgagggtggggatacagtactggcttcagcggataaaggctggccatgctgctgaacatcccacactacacaggacagcgccaccacaaaggacagaaagcgtcagtacctggagcggttaatccatcctctgaaccgactgggatgacgggcatggaagttttggttgttgatctttactcctcagttgaatcccattttctgttagaggttacttacctacattagcagaaggccctggcctggctttgggtgtgtctagggggcactgacgcctaccggagatgggagaggagaaggagacctgcagggtgagatgagaggcggtgaggagagagagctgctggctctgccttcacttacgaatgtaacctttctaacatgtattaagtctctggtggtgaaaacctcaaaattattgaatttcagttttgtataagtagcagtcacattttactgctttcccttcttctactgttctcttctcccttctgtttagttcttctgactcttttgaagttcaaaaagccttatgtaccagatcatcactcttccgttctccctcttcttctttcttttataaatctttgtgcatgacacacatttaatgaccaggagatgccgtcggtagccttgtgtccatttctggaatcccaagacttggctttcaccaccacttcctgaccacagcaagcagttaccaagggcaatggagatactttcattcctagccttggccacttaccctggtgccttctgttgattttcagaatcagaagtcaagttgatcatctgaattatgagttattcagtctaatggcaaggaaattaataagacaaagtcgtgaaactcccatctgtctccaagctatctacttgtggatgtttatcaagctaagaaacttgccatatgtgtaacatattgtctgaaggaaaagaaactctctacttttttctagaaaatcctgacattgtatgttgtgtttttgttccaccttattaaatggccttctcttcttgtcacaagtaaataaaatggcttcatcctgttcatctttctctgttagctttccataatagtaatatgaatggtttctgtttacatggggtgttcaacctcactcctcaaaggatctaataacatcttttaagttcaatctgttcttgtattttgccttacaaactaacatgtttttaaatgtcttttcagaaatgataaacttgaatttttctcatggtggcttttgtccaaacatctctaattgttttggagataatatcctattcattttcacaatattcctctgaaaatgtaggcaatattatgccaccttgcgcatggtcagaccacagcatgtgggagttgattaactctctttttgccatgcttctacattgctcatcccttttccattctgttagcacgtggatgctatcaattctcttctaatcatcctttgcagttagctgaataccccttatgaagtttatcagcctcaactcctgtgatagttccttgaggacatcttatcctccttcattagcttacagggtcagtctccttctctgattggtttaggaccatgtgctgaactctgcacatatgatccacacagttcaatgtatataattacaaaaatgtctaagacccaaattaaaggaagcaatatgagcattacaaatggatgcatcattgaacacacatatatttatttctcaaatatagaaaaatgaaaatgtagcattcttataggatgatagtaatatatttgttttcaatgtgcttttcttatttatttaatcctcatgaaatctgactatataagcagggttgccatgcccaacttaaagatgaatgaactgagactcagaggctgggttgccatcccagtgtctccaatcttgcaggaaatacagtatctcctaacaaattccagtgatcacatggcagttctttctattctgactataatattttctctgaagctctattcaccaatcttgccttcatgttcacctccctcatatctcactttcctaaaacccaccttttatcacatgtcttcccccaaatcaccaatagttagcaaatgttcctcagagggaaataaaaagtattgagcatgtgagttacagccttccataatatgggagttttgttcgcctagaccttcctcttgcacagcctttctttttgggcacactgggctgttcactatcccagccacgcttcacatctcccagccccggggaagatgctacccccttagcaatgcccctctagcacctttctttaccaaccagaatagaaatggactcacagagactcattcactgcctgtttcttcagcattttatgcccctttcaatcctccgtgctgcctcatacatttcttctacacagtagacatttggttaatactcattatctggttgataccactgaaaatatgaaattaggcaggaaactcactctgaggacaagacgatgtctactgtaatccacctgcagacgtgttagaaatttgcactaagtcacagatgcttatagtgtgtgtgttgagggcgggtattcttaccagatttttctttaatgctgcaaattggcagcctgagtgttttgagcatccatggccattagaggcagtctttcaaggggagttttcacgtcagtcatctctgtgccctcccactgtactgaaaacagtgtctggtatgtattatgcactgtaagaatatttttacatttttttcattgaataattcatttaaatttgatatacaaagggatccaatgcaaactttcattgaaaggcgtgatcctggagcctgttataatgtgtgcaggccacatctggccatcacgggcaggttcgcatctcacacagaaaacatttctagccagagagctgcatggaagcccaccacccttcccttgagaacacactgctttatgaaagaacaggacaatggcatctcaacatccatacattcctcttcagactcaagtagtggcatacccagtattccactgcaggataacactcagaatatggaaaatcggtcccagtgacacagcttttctctgcacagtagctagctcctctccagctctttcccatctgcctccaactttgcgtgtccatttctgcatgagatggagcatgcgagaacatacagcacacagaccctaagcagctcccaacactggaaataccttcctctctcctgaacgtgctctgtgcaattgcaatgagagattccagcgccactggtaacttacacttggtaccaacccataactggctgctgcacaactgaccggtgatccatgcacagtattctcgtggaagtgaatgagggttttgtgaaaaatctatggcggggggggggggggggggggtggaaaaatgtccctgacgtctgttgaaaacagtcaggccctgctggagggaattgtgtcactgtcgactggctctgttaggaggaaacagtttccaggccctgcagggccgtggctggcttccttccccttccttgaagctcctgccccggccctgccacctcccgcagaccgaaccctcgctgtcacctccccttctgcacagtccaggccggtcgggtgtcctcactccctccttctcctgcagagcttccggaggggacgcctcccgcgggcgctggccgcttcccaggccccggccctccccaggcctctctccccgaggctccagccggctcccccttccatcctccccagcgcactggcccgtctgccctcctcgctcaagtctccacccggtagatttaaaaagtgaaaagccaaggccacgtctatgtgcggcctcgccctccttccctgcgaaccctggagaacacggccttgtgatgaagcaaaccccagtctcctcgctttgcatgggcttttctatccaccgcgagctgaaacttctccctaaagcaaccgcgtctccagactcctgggcgctttcccttccgactccccgaccccgcgagcctccctgcaggccccttctcctccctcccccgggctgcgggtgctgcccgcacagcctccgccctctgggcgctcctatccttcgcactccagacccgcagccccaacccaacacctgtgagctccagaagctgtctcccccgaccccgggccagcctggagtccctgctgcggatcggatccccggtgcaggcctccctgccagcagcgcagatcctccttcccaccctgcgtttcctacctgggtcctgttgctcccgttggcttacggaaaggaaactcggtctcatttccatttctgtaggaaactcagagatgcctgggactcctcccgccctgggactccccactctccgtagttcacacaatttaaagttccccatttttaattttccctgcgggactgtctagctgtgcgttagttcaatccttctttcgatggttttctcactgggattcctgttgctagtcctctccctggccctcaacccgcaaaccggcgatgttcttcctgacgccggagtggcctctacctcgcaggctgtggaggtctgccacctgccaagtaacaccacgtgtttcttaacctgcgcctcagtttgatcatctatgcaaagggggagtgatcacatctagctaatacgagtgttgtgaggattcagtacgttatcataaatcatgccccaagggcatcccggagctaaacaaggctaggtaggagttagtgctgtcccacttgtcagatcccagcaggacacaccaggccgcccactggctggctctaatcctcctctacaggcttctgtccctctgggaccttaccttcctgctccctcgcctgtgctcacactggaccactccttgtcccttgaccatggggccgtctccatgccccaaggaagatgttctcttctctgtcaggaacatctccctcctgtcccccagccatgggagtttaaagtcaattcaataccaccttcttcagaaatccttccaggctcaagttcccccgcctcttaccctctaagaacaggaaaacccgtggaattatttgctccctctgtgctcctacccgtacccgggtcatgatttcagcccagcaattgtaacgatccattggcggttaccccgcttggtagtgactgctttgaccagtgaaatctggatccaacagtcttgagggtcactagaccactgaaaggcgagcagtaggtggcaaagaaatactggctaaatttaaatttttgaaattataaattttggaaatcatgacctagggtaatgttttctgtgctgggttttatctacattattattggtttggggtgtttgctctgcccgggaacttcaaaaaccagtttctgaccttcttttaaaagtaaatctcttacttaagattgaaatatattaaattcctttatttttgatgaggaaccataagtaaacaatggatggatttttaaaacttttacatctcaaagaagacatgaaaattgaaaaatacccactttgctttaacatgactgcaatttgataaacttttatttgcaaaagaatatacagaatctttattttaaagacttatttagtggagctgaaatctcaccattgtactccactagaatgaaacctttgttggcccggatcttggtttttgttgttgttgttgtttttaattccttgctctttagactgttgtttaaaatcttatgttttttaatgtgttaccaaggagaaaatgtgagagcaaattccacagtgtagactggaatgcctccccctgccctccccagcaacacacacttcacgatgtctgcatatgttcccgtcctcatcggcaggcttttgttccagtcctgagaaagacagcctcccactaaacaaataaggcctccaaagcatgtgtttttctttggtgttcctgcaaattagcacgaatctgtgctatgttgtatggaatttcagagagacattttattatttgtcctcgataggaaaatgtgcaaaatccatggtttgcttattccagatagaattatctcacttttctttaaatcagcatcagtaagcatgaattcagccacataaataactttacttttaaaatcatgaataaaagttgagtttacccgctaaaaagtatcctttgatccaaagaatatcaattatatagccttaattttttaacggaacttaaatattatcaaagctgtatgtctagaatgaagaatgaaatgaatcaatgtattagaaatttgcagatgtgttacataacaatcacttcctaacgaatgcttagaagatcctatttatacttttgagcccttagattctaccccaaatatgtcttcttaaatccactgtttttcttttctctttaatttcagtttgtttggtttaatgatagctactgaacataaatgccaaattacaatggcacttcccagctgtgtgcagaactttatattttaagtaccaatttgtgataaaagaatgcttccagctcaattctcatcagcattagaggttttagcaattgccaattatttttctaaattacctattttaattaagtaaaatattgtgaatttaagattatgaagtgttcaagcattatttcatctttaactaattagtgagaaaaaggaaattatattttgggacattaaatggctatttttagaataaaatgcttctatggtttcaatgccttaaattaacagaaaatgcacaaacttctctcgaaatcctgttacatctggggtctttgaagtacaccttgaactgatcatttgttctaatgtaacataaatttgtatattaattagagccaaaatgcccaagagattaagcttggtatctcccttgactaatttaacacatctagatccctcagcaacattttaaaaccacctgtttctattttgccttcatggaacaaagcctagaacataggaaggacctcaatgtataactattgatatgactgtcatccttagttcagttctgagatttccattcctaacttatcattgcatctacattctatttcttacaagagcacttcaagaaatatgtacagatgaaggaaaattggcaccaaaatctgcctgcctagcagcttacagcaatattggaaggcgttgaaagccattattaactgacattggcaaagtgattttgaaaaatcttcgttttatatgtcaatgcaggctatgatggtccctaaactgttgcttcaaggcagagatcacaaactttttctctaactgtgggtctcccagcattctccctcctgaacacggcctattaacggtagtgagctccggagggtaaaagggttagtcaacaattctgcttggctgcttcaggggagagccagtgttttgcagtctagtgaactaattatgcactcttgatgagatcattaaaggacaataaaggaaaatggaaacaattcacaatatgtatagacaaatttctatatcgaataatttttgtttgtatttaaatgttgggtagaaacttttctatcctgagtaatggttggttttaaaaaaagaaaatcttcagattgaaacttatcctttaagcataaaagtatagtcaggaatttttagtctttatgactaacacagatgataccgatagtttggtatctccgatctgatcaataaactctactcttacaatggagtggtgccctgtgagggaaggggtgggcactcctggatccccctgagcattttcagtgcttctgtttcattcatccaccttattctggaaattcaactggggagatttatattttagatatgtttttattaaaatgctcctttcaaaattgttttccaatttattcaacaggcaatattaggtaatatatttgaaaatacaaaaaatggtgaattttgtcattgattcctgtgtagtcacgtgaattcttggagtttctaaaaggggattttttttacattggtttacatcccatttcacgtgacaatttgaagcatccaaaatgatacaagcgaattggatggatgactcaattaaatacaatggaagtcaataaagatcaatgcaaagtagtgtcttgaacagcaataatcccataaatacaaactaagaaagaaaccaattaaatttagtgtgggaaaaagatgaagaggttttgataagtgagaacagtacaactcaaagaacagccaactattttgtgacatgtcaatactatcgctattgagtgtaaaatgcatgagtccgtctccctcaaaaccaccagctcctgctgcaatgtaaggctctgtggggtgaacagtctggaaagaagaaagcagtgattcccagcaatggtcagaatccaaaagctgagaggccctaagaggaagaacagcggtgattttgcaccagcgatcatatgtctctgcgggaagggcagcatttaagagtctgtggaaagagggttttaacatctcctttccccaggagggatgtcccagtctcagaactgggatccttctggcatcaggatgaccagaattggggtgcccttaacggccagccctggtgcagcctcctctgcggagctggacgtgcccccagggttgctcagccaaacagaaggatcgagaggcaacatgataggtgcctaggatgtggctataaaaggttcttgtgggcactgtgtgatccttcattggccagtgccactgcaggaatgatgaggaaaatggccagcagttgagatatttaggctggacattagctaaggggctgtcttggcagctccaggagatgggctgatagttcatcttaaagattacagacccttcctccttgcggcatagaatcctatgtgaggcagctttccagaggaatgctggcgtccccagtattaagacagacaaaaggactggaaagctacgggggagaaaaggaattaaataagccacactgatttgccagaaatccctccattctgtgcctagatgttgctcttgctcatgtgctatgtaggactgccagattcacaaagaaaaatacaggatacccagttaatttgaatttcagatgaacaagaaataatttttttaaatataagtatgtgtcatgaaatatttaagacatgcttatactaaaaatctttttgttatttatgtgaaatgtaaagttaactgagcatctgtgtttgatcaggcaactacaggaagaaccacatgcctcacacatacatggtctatgtcctctggccacctgcatgtgacatgctgaaactatcacatcaacaaaacaagcccaaagctcttatctctgaagcactgggagttaagttactaccttagaggagatgagcactttttaaaaattaaatgtggaaaaaaaaaaacgtggaacactcacaatgcaacatgacttatccttggcctccaaagccctcacacctagattattgaattaatttttcactagttcttcctactttccactttctccccatacctctcttctatacaaaactctcaaatcaactgctgcgaaggctgctttcctaacgtgactgggtcccctttgggcatccagtgaatgcccaaacaggcatgaaagacccttcccgagcccgctttccaaagatacgtatgcttcctctgcccttgaatggtaccccgggctaggaagttacagatgaggccagtgaagaggaggctcgtccctccatgaagctgggagggtcattccaactcaagggatcagggaacacttccagagggagatagcatttgagcttcgctttgaagaatgagtgaaatttaggtatgggacgctggggagagaaaagcctggctggtcttgggcaaaggccctggattaggaaggtcttgtgtgttctgagagcgagaggccctattggctaatggttagaggatgcccagattcaacaaactactgacctttttgtaatctctagaaactttttggagtgccatgtcataattaaggccatgcaacagggaaagttatctgcaacgattttaagcatcagaaactaagaagttcatttaaaatatttctgatctgtacctttaaaaattcattttcagtatcactataatccactcaactgactctaagtctcatgcccatttcagaagccctagctgagtctctatcctgtcccaaccccactccgactgcaggtaagattctaatggctgatctacctttgtgcccacgcacatcctcttgctttacttgctagccttctcagccgcctctagatctctgcacacaccgcgctgttcaggggcctttttatgtgctgttccctccgtctggaatgtcctttcccctcttttctccaaattcatccttcaggattcaagctaagaattgtctccttcaagaactcttccctgagccccgagacaggccgaggggcccttcgcagcgctctcctgaggaagccctcgccgccgtgtgcggaaagctgccttgggaaagtttctcccatctggccctgagctgccgcagtctcctctggctcttggctcctgcagcctcttctccatcagggctgtcagccagtctctgggcttcagccaccgcctttaagctcatgactccgaaatttcagtttgcctgagccacagacgtatatattgaattatctgttcctaaaagcctcaagatcactcccaactcaacatgtttaaagctaaactctcatcttccccaagcctgctgcttgtcctacatcgcttctccatccctgagcaccagaggagcctgggggccgttttagactcttcttcgcccttctcctgaaccagcaccccagcccagtgcgccacaggtcatatctgagcggtctccctacgaccgccacgccccatgactccctcctcttccactgctgctgcctgggttcccactgaggagctctctccttgggagccgtgcccctcccacttcagtcctccccaagacatttgtatttattttctattgctgccaaaacaaatttacagagttgggggcctaaaacagcagaaatttattatcttgcagctcaatagtgcagaagtccacataggtcatacaggactaaaatcgaggtatctacagaaccgtgtcccctcctggggctctgctggaaagcctgtttcctggccttttccagctttcactccttggctcgtgggcctcttcaaagacaacttcttcaaagccagcaacgttgcatctccctgaccgtttttcgtgtcatctctagctgtcatcttgtgcctcactctgccagtttaaggaccatcgtgattatacttgatccacccagattatccaaaaggatctccctatctcgaggtctttaatgtgagcatgtgtgcaaagtaccttttgtcatgtaatgcaacatagtcacatagtcacgggttccaggaattaggttacgttcatcttggcggtggtgggcagaatattctgcctaccacacagtggagtggtcttcctaaaacacatctcttctcctactgacaattactaactactacctgtggagtaaagtccaaacttcctatttgggcataatggtctccatcctccgtcccgcgtccagtagtgcctacattcaagaaaccactggcatttgctccgtagcagtgtgactgcctctgtgtctactagttctgctctttgaccttgagtggccttaccttccctcagctctcgtgatcattcccaagtcaccacctctgcaaagcctcccaggacccaccctccgaggtggaacggcacactccttctaggtgcttgctgtccctacaaccacatctctcatgtcacctctccctcttcattgcaccttgctggttaccagcagagctccctgtgaacaggaaacttgtctgtcctgttgctgcatccccagcaccaggcatagtgaattacaaatgttagttggatgggcagatgaacgcacattaggctgcagagctcgtgggctgctcctggggcccatgcttgctctcacactaatataagaacagttatccagccagctgaggatgtcaacagccacttctcagaatgaaaaaggacacgaaccaatgtttcactttactacaccactagtgaattaaacgaagccacaagcactcggcttggaagattctatcattccttatgttctattccccaccgtttgggccacttagtattttcttcagtgaacctttcttgagtgttcaataacactatgaaagttgtcattagaccaagaacaaatgaggtttagtttactccttagtagacaactaatgaacattaccaagctgacaggcttaactcttgacttttctattaggacctaaagaatccatagaaatgatctacggttcttggaaagaaatggaaaacaaaatatttgtgggttcatgtgtagacccttatggataacacctcttttattcctcaccaggaccatgtgaggtggtagcactgagagaatgggaaatgctcccaaattcttaggtacatgaagaaaacaagattggaccttcatctatgtgttttctgcttctgtagtaaaatgaggctgctgactgtattaagaattgtacctacagggagtggccaccttgattaatgtgtgggccgagaaagatattgagatgggcatgagtggagaattatagtaaaagcaatcccggtgatgaggaggagggactgatgggttttagtaactgcttgtgcatgcctggttgagctgaaccacgaaacctctttcacccatcattacttgcatcttaggatagggaatgagctgtttgagctgatgaacccttaaagatcaaagcttccatttttatgcaaatagccaagagcaataaaacctaggaaagaaaagtagggaacgtgaattacagtaggatgtgtgtcattaaaagttacagcaagccgggtagttattcagaagtaagctcccagcaaggacaacttttcaaatttgtgttttaaattatttttaaatgagaagaggtaatagcaaaatataaccctgagtttcatttgttctctaatacatcacagtgttaagatgatataaatatgcaatcttgaattagacattactaggaaataatattgcacactgacgtgccaggtacctcctcacactgcagcaggcacagggctttggtgctggaagctcttggaatctgacttaagtaccactctcaaactaaacatggcttctttagctttttttttgcaatggaattgcaaaacccattttgcagtccaggtattgatcgtgctgccatattatactgtggttctatgtaagaaaccacatccagatcctccctgaatagacctctatcatgttgcttggaggtagaacatgcctttaagaataagctgctttgaatgccatgagcacaggttttggagtgagagagctggttccagtcacagatctcctgcttccaggctgtgtgacctcaggcaacttagagaacttctctgaatccacattgtcactgcatactgttgttgtaagcgttacataatgtaaccttttgaaagaatttaaatgttatatctatctggcatttagctagagtttaaagagtttaaagtttcattttagctaagaataaatactgttatttattataatattaatctattatttatatatgttatataatatataatttattatatatttacattttagctaaaaataataaatgatttattataatataaaatttattgttatattagttcttatttttagctaaaatgaagtaaattcatgtgctgtaaaggaagagttattctacccttattataattgcatttatacaatttttaaaaactgatgctgaatctctagtggaaagagtactggactgagtcttgcattatgggttttagtcctgattctgtactcactaatttttttctaccttcctcagccactgtattcagtatttaatataatgagcgttctggtaagttctttacatacattatcttatttacttttacaaggtcaggggtgacattgacccaattacttgtcctttctaggttcttcttctgctttgataagggtgtcgagtgttctctcggtcatttcagcaatagtattctaaaggaatacctcccacaaattgttttctaattttacttcgaagaattccagagatgacagtcctagggtgttcatgacactggtagacaccttcccctccccttcggtggccccgatcctcattccgcctccacccccgtgacttcctctcctgcctccttccaggatggacaacccacgctcagccccactctctccttgccagccctgctccgacagaggctggctttccccatcaggtgttggttagcacttctctgtacttttaattatttttcattttgattattttcgctgtgtgttgggaatcactatgaggtagagagaaccatatcaaagacattactctgcatgggtctgtcctctgtcaagtccaagacatggattcattgtcatctcttatattttttggacacaagtttgatgaggtttcttaattttgacagttaatgcttccaagaaacttaataaagattctacagccattttagtaaccagggaactacagtggaaatatatctctgagtaataaaatccatcccctggaagctgtcaccaaagactcaataatcatgttcgccacccagcatcctttctggacctcaagctgtcttgtcaagtgtgcttaatatccaggatatttagtttaccacagagttaactcaagtatatttgtgttcatttccatgcaggattttgcaagtcaccaagacttaagataatggaggttttgacctctaggtgaacaattactttctttcttttcatgtactgaactcatgaaaatatattgatgaattaataaatggcataccttttataccaaattttaacaaaacaaccttaaaagaagcttgaattgctgcgtggacaatatggacatcatgataggaaagtaaggcattttagtaattaagttaaacagctattttgcccccataactcagttttccttccaattttccaaccccaattcagaattactgaacctgaaacttgctgagaagaataatatgtagtcagcttaatttccccccttgaatatgcttaagggaacaaaaccctctcttcttggaggaattcccaccatggtctctggtttttcctttccccctcagctaccatattaagcatttactctcttgggcattctgctaggcttcttgtaaatatcattttatttgctcacaagcactttatgtgaatatgaggcacctggagcccagagctactgcacgcccaaggtgacagttaggaagcggcaaagccaggatttaacctgtgtgttagaagtccatgctctcatctgttgcattagaaaatgtgctgctcttgacatccatcttccgggtcatgtaatcaacatcacgtatacttggctctctgttaccttttgcatttcaatacaatcccatagcttggagttcaaggtcctccaggatttcagtcttacctactgtctccactttgtcattactccagaggttgaatcttcatcaggaagcctaaggtttttatccccaccgagatgtgcctgccatatttgcattcttgataaaaaccttatttaggattattcattttcaaatcttcaagtgggtgaactgttgtttggtttgggtttggtttactgtgtaatgtgatgcctcgcagaacatgccatattagggcattttgatgtattcatttgttcaaagactggatgcattcctttgtactggcctgcacatatatgtaaccagttccttcttgatggacattaggttattttgaggatcttgctattgagaaccatatcataacttatattttgtacacgtgcgtatattttgtgcacttgtgtgtatatatctgaaaaatacagtcttaagaatagaatgtgcatgtttcatttcgaaagagatcaaccctgaccccctccaatcctccagaagttgaaaaggttgtcaaggtcctcattttcttaatttggtgttttacgtttgggtgtcctctgacatcggggttcaagtgagttcattccgtggctccgttgcactacccagcacccaatagcattactaaaagctgagtggacctctcaaaatccaggggctgcttgtcgagtatttagaaagggattgaaattgtaggcatgtgtttgttgtagccataaaagtatcttctcaaatgtatttgcatgaaattttaagtaagtctagatcttttgagtggaacagactgatacatacctgccagagaacagatactgaggagtcaaatacagctcattagaagacacacagaactgcatggggagaaaacacctgtcccacagccttgggtatggggcttgctggagcctccacatcctggactctgctggaggaaaaactgaaagtaacccgccagctgccagggcccactcccagcctggagagccaggacagccaggtctcggcaggtgctgacctacaaaaaggacggtcctgctaggtgaagtgtggtcagggagaggcagctgcaggtgatcttggaaatcaatgctcattaattatcaacgtggctagtaaagctctggtgggaccttggttctcaatcctggctgcacgttgaaatcacgcgggacgttttaaaagttctgatgccaatttctaatcccacttgttgtgcaataaccccaatccccctcaaatgcctccaaataatctgagtcacatgtgcttgacacaggcttttcagctttcatttcgtttctgccaatttcttcctctcctgctccatctgatgccacaagagaacagcctctggattggcaagtgcagactaccagagtggtaaatgcttgcccaagaaagaccccagttcacacggtcagagggtgattttctccacctttctagacctgcaaggattcaagtgtcacatctggagcttagctgggcaattttgcaagcttcccaggtggtacatgcagccaaggctgagaacaactgtggtagggctgcagccagggtgaggcccactgggtccagcccccagagctggcaagagctggccagccgtaaaggccccagcaaagcagggcatggtggtctctaactctgactatgaaactggtgatgaagacagagccagtccttctggttttcggtagcacagtagggttgtcaagggttgtcaagggcagcacagagccagggaggtggagctgctgtaggactcaccagagaccacacagcaaggcaaactccaaatcgatcagcctggctgctaatggaatcgtgtcctaaccaagtttcgttaggaaatgtgtgcaacttcgctgcagggcatggctccagctgggagggactgcaggaaatcaggacctgacccacctttttctttccaattaagtggatccagcctgtgtacaccaccggggatgtggctggcagctcccacctaggggttttcaactattgccacacctacttgctaattcagctgctttatcagctccacatggttttttttgttgttttttgttgttgttgttgttttcttttcgagacagagtctcactctgtcactcaggctggagtgcagtggcatgatctcggctcactgcagcctctgcctttagggttcaagcgattctcctgcctcagcctctccagtagctgggattacaggcaactgccaccacgcccgactaatttttgcatttttagtagaggcagggttttgccatgttggccaggctggtctcaaactccggacctcaggtgacgcgcctgcctcggcctcacaaagtgctgggattacaggcgtgagccaccgtacccggccttcagctccacttttgagctagatttaaatgccgaggattttattagtataaaaaataatattgtccatatttttgtatcatgttattcttgtatctgtgttattgtattttattaatttagaaatggtttatgagtcattcaaaaagtgttcagtagcatattaaatattgagattattaaggcaatttatacccaaatagatttagaccttcagtctgaatttcttttggtataataacttttattgtaaaatacaaaggttgataaataattgtgaagatacattttcaaagggaaaaagaatttgtaggcctgaattattattttaaatctataaataatatattttacagataaatagatattgcgatttgtttttaagctgtcatgaatcaaagaacagcctttctcagataagcagaaattgattaaaatagacatgatttcagatttttatttatattatttttctgttctcatgcctaatcatgaagttctacaaagttccacatttaaaaaaaaatgtttggcttaaaaaaaataagatgtaaaatatttgtttttgaaaacactgaggccatatcaggaagggtaattgggaggaaaaaattaggtcacaatgagtaacaaaatagtatttgtttctgttttcacttgctctgcaatagccataatctccctcaaattcctttcgatatctcagtcacatgtgttcatggcacagccttttcagcttccatttggtggctgccaatctcttcctcttctgctccatctaacaagagaatatcctctacgttggcctctaaactaagtccccagttcacactgccaaagtgtgaattttctcccaggtctggacaagactctgcctcaattcccatccagcctctatgtcagtccacactcagtgggcgctggggatggttattaagggacctcgggctcttccctcgcttgagttaagaagctgcataggagagagagtagagctaccttaagatctctttgaacctttcactcctccaggaacgatgcgggctggattgcaaaactatcagattaacagataatacagttctcaaattcattccacctctcagccactggcccgtttttggggccttagttcaagctgggcccccatcacacttgaattccaaacattgtgaactagataggccacatggtttagagacagaaacctagatttaaatcccagttagtagcgttagctgagtggccttaggcaagtacctgaaccattctgaggttcaggattctgactttatttcctggcagagctcctgtggtgatttggtaaagtcatgcatgctcagggtatgtatgtatgtacatgaaccaaagatgctggacaagggtttgcaatggtgacttttttttaacagaggttaaaaagccaaaagcatgtgttgagcctctcctaggtgccttacacgtatgttagggtctatgggggtttaaaaaaaaatactaacaccaggtccctatccccaagtgccaacactctaccaaggacacgcatgtggcaagtgctacatggtctcacatacagaatgcagacaaaagctttagaaaggtctgatgaagaaaagccctccagaggagtgacagtttctggagatgcacgttaagtgctgtctagggccaggaacagcatagcagaggcaccaaacagggaggccgcgctgcctgcgcaggaaacggtaaatggtttggtggagccagcgtggggcaggggctggtagggggcgctgaggacggcagaacggaaagggccctgggggagagaggtctgactacaacccaaagaacgcaccaaatctcagtgaggaaccgcggatggggagtgacatcactcatcccatcagccagtggatatttattggttgcctggaggaaccagtaccaagaatacacccataaaggggtcaaagccccacccctgtggagacccctgtctcagggggaaaaaggggaaatggccacaaacctccatccttgtgataagtgttgagatccgggtaagcacagcgcactagggtaacccaggggagaggcgctggcccagcgtggggtgagcaaggagggggctcaaattcaagccttcaagtcggttcaccctgtccaggcttcgggaagctaactggagggagggagcctggcagaaaggggaaagctgggaggagaaacatcactcagaggcctctgtgacggcccaggcgaggggaccagggaggcctcatttaggacagtgaagatgagaatggggcgacagggggagagaacgaatgaaagggcttcattgcatctaaggcaccattagccattctttaaaaacttccttcaatacagaattatttttaaaacgttatgattctaatataatacaatttctcttatttgaaatcttcactggtttgcccacaagcgccccgatttcatctaaatccgagtgtaatgaaagacagatgcattgtttggagtaacacagaagctccaattcctcggctgcagggcttggcgcggggtttctgggcagcgtcgcttgcgcccggcacatgtgaaagggttttgtgctcgtttcctctgcatctgccgagggcaacactgaatctgtcttctctccctgctctcctctttgactgttttgtttgttccatttgccctgctcaacaacaacaacaaaaaaatgtagattagaatcggccctttatttcaacagcagtgaaagaattattttgttaattggtatattgataccccaagaactgcttactgtgccaagttattaagaataagtagacgaggggcagattaaactttgaatcacctgttcctttgggcaaaatacataaaccaaattgactgcaaccaaatgtcatattatttacatggcgtgcacaatttattttctaaaaacgtgctcaacaaaagatttgaatttgctcttaagcgtctaatggatcccacttaatagtgaagctctgtcatgtgcccttctgtataattaaatcatatggaaaaatgtcacaaagcaaaataaaatgtatttatttcagccatatcttcccaaagcatgacatgaagtctgaaaaaagaatcactaagcatttttatgccatctgtgctggtaggggatatgtttaccaagtatgtcactgtaaaatattccattttgaattaagcatagtctacttattactatatagtgtctggctgaatgagtataaaattggacaaaattccatatctgacaaaatactttttatttgttattttgttgcaaacctagtccaccgtaatgtcctttactgaattccaagaaatccaaagaaagaatcatagattatatttgtgttaaaaatctgcatgcttttctatccaaataaagttcagatcatcttttccaacagttgaaattatagcttctcattagcagaatatgtctcactgtgacaacttggatgatgatgctattgggtctgttaatctctattgcaaaaggagggctaaaatgtctgcacaatcaaaaaagctgttgttccagtttgctggtaaaacacaaagttatatccattatgatttctacctaccagacagaagaaaccttaagcttatagtttgccattattatgattaaattttatgaatacttatagaatttttatttcctatatgcgataagccctctttgtagtttgttaatgagatgtaaaaattctgtaaatttttcggagggcagtttgatcgcctccagaaagcatcagagggtcgcagcttaatcactgattcattaagtaaccctgatctatgctatatccttcagggttctttgccaagttgatatatcatggcattgttttgagactcatgtgaataataaaatgtaacatagtttagaaatgaaaatactttataactatgttgagctccttctagttgtaaatcttcccaagtcaataatattcatatcaaaattttcaaatctagctaaatgaaggagatgtgacttggtaaaaagtaataacataaaattgtatcattttgatcatgattaaacaggaaagctattatttttctaaaatgaaaaaaatagaaattttagtttgtcatagaatcaagggctagattcacttaataaattgtcttgattctgctcaaaactctgaaaaaatttaaagctctgtaaggtttttgaagtcccacttcctttcaaaccaaccctgctatctccttgaagccatttttgacaataactgcctgtgaatgtgatttgtaaactattagacagcacacaaaagtgaactgctgtcactaatcatataactatcattcagattgtggcagctactctttccgatagttcccataggtttccaattgaacatagtattttttgctgcggtgtttgttttatcaattgattgtatgtattttcatattattttgtacactgtctttgaacttgaccttaaatattttctgtccatggcatatcccttgatgtgattacaggtcaaagtccacatcatagatgcctaaagtatcctgtaggaaaacagaatgggcactccaataaacatttattaaagcatttggccgggtgtggtggctcatgcctgtaatcctagcactttgggaggctgaggcaggtggatcacctgaggtccaagaccagcctggccaacatggtgacaccctgtctctaccaaaaatacaaagattagctgggcatggtggcaggcacccataatcccagctactcaggaggctgaggcaggagcattgcctgtccctggggccggggttgcgggttgggggtgggggtggagtttgcagtgaaccaagatcacaccacctcactccagactgaacaacagagcgagactccgtctcaaaaaagaaaaagaaaaaattgttaaagcattgcatgaaatctgctttaactcctattctaataaaacaacaacaagaactctgaaaatgactttcaccataattagttgaaaatgttactttcctttggcccaactgtatgtaattcattattatatctatgtctgagactgagtgtgggttttcaatataatcaaacgaaagaccacctttaccaaaagaacaaatttaaagttcttttattcctgtgaaccatattctccaatcatctacactgaatattttaaatgggaatttttgaagtgttaaatatttatcaccatgtttttctttcctcatttatatggagtactggagcttgtggccataatattctaatgcaaaatatggatcaactttcagtctgaaagtttgaaagttaatacactgattttaccacctgcaaaagatatccatatttgaataaaagcgaccagaagtgaagctaatcaatttaataacacatgcagttatttcctctttcttttaaaacccagaaggaaagtggggtccacatggtcctaattgtgttattagttcttagttttcctctaggtgctcttctaagtcttcttttgagcaaatatcatgaaaagctcaagatgagaagcagtgttgatttgaatgaaaggctaatcccagttgtcctttttctaattgataaaaaccatgatgatcaggatgagtctcactgaagcgtgtattatgataaagtaaactacggttcatggagtcacatttgatgttcagggatctcatctgagaaggaaagagagcacctttcctcagcctggagaaaatgaggcgtcggtgggagcaggcagagctgcatctgtcagtgtgagtgaggaaatccatgtctgattttccaaaggaagtcaagattcgggtcaactgtggggcgaaagaacaaagataccactggtggttcaggacgagaggtgcgggttgggaatagccatggagctggacgtgtggtactgaccagggatgggggaattgttgttgcgggtgtggaactggccccacttcacacggctgcgtgctgtgctcctacggcagccaggctgtagagcaggaattctcatgtgaccactggtttggttatcccagattaggaattagcaggaggagtgtggcaaaggccatgtctagaatgtgctaggaggagctggccagacggctcaggagagagaggccgctgggcaggctgggcggggaggggccatacagacttggggagcgccttcttctgctctggttgcccagccagccacaaactgggtggcttccacaacactcgtgtcctttctcacagtgctggaggccggcagtccagggtcagggtgtcagcaagatcggtttctcatggggcctctctccttggcttgtggacggccactttctcgctgtgtcctcacagggtcgtccctccgtctgtgtgttgttgtctgtgtccttatctctttttataaggattagagcccacccatgtgacttcatttcaccccaattacctcaaagacacttctccaaatacagtcacatttttcggaggagctggaagtcagggcttcaacataggaattttagaggctgaaaggtgacagttcagcccgtaaccagaaaaaggcagttgccctgcggggaagggaactgttgaggggtgagactgctggaggaagaggaggctgtggcttagagcggggaacaagaggtcccccaagagagatgggacctgagtatgagttgaaatggcctgttccgtgttgttctcaccctgtaaaatccctgagggcaggaatcagctttctgcatctctggttgcctggcccaccgtcagctcggagcattaaactatagggactcacccctgctgaacatcagattgagggtcatgtgcccgcaattctctccaggcaccactagagggcgagcctccattttgaaaactacccagaatcccctgctcccgctggggtcaggaccgcccctactctctcaaggactcaccctactctgttgtgccacacaagccgctgccacagggttcgccctgcttttattctaaatcttatggtagcttggaaagtagcctggcatctgatagaaacagccctcaagtggtccagcttcccccaccttgcactgccgggcagtctctatttgctgtcgattccacgcagtctatgcatctgggttattttcacttttccaaaaccaactctcagccgattcactgatcttctacagggttgctccagttcctacttcttttatcgcttagacctttctttttattccctccttcattctcccactccttttcatctgtagtctcttcttaccagtacgagtccgtgttacttcatttgtagctcctaatgtcagctcatcaaatgaactatagtgaagtaaaaggatatcgcctagtgctaggttatagcaaaactctcaaacagttagacttgcttttctgcaaaatgtgagcatgtagacttttgcatcaactcatagtaaactttaattttgttttgatgtctcaaaagatttaaaatgcaggttcgaccataatttttaaaagcaaagtagaacatgctggctatattatgaatccattcaatgacaagtagtattagtgactaaatgatcattataatgtaatgttagctgcagagaattttgaagaaagataaagaagcttgccacctagtagtcaagatgagaaaagaaaagaaaaaaaaaatcacagatcaaagggggaagtcccaagagagcatccccacattgcaatagccaagaagagctggcattgactgagtgctgactgggcaccaggctgtgtgtccactaagccgtttatctgcttttgctcacttattgtatatctttgcccctccgtgaggcaggtatgactgttctgcccattttacagatgaggaagctgaagctcagagcggttaagcaatttgcccatgaccacacaactatctgatctaaagcataggctcctatctactcccaatgatgtaccaatcctagcacgattatagctcttctcaagtgcaaaaagttcaaaattaatctagagataaaataacttttccccccagtttctcatgagagtaactaagcccttccatcagctgtggccagctgggcagtgataaggtagtagatgtatacagaggactgaaaagaggagaagaaacacagacagactgaaaaacaactgtctcctccctggtggagcatgagcccatgggtcgggaccctggactgcagctggcccaagtcggtagcactgcctgtggggaccccttctgagagtgtggaaaagtcagctttcccctgtgagagcagctgggtggggaggggacattttccatcacagactctaccatggatttatttttataccaaaataaacaagaagtccatcaacctggcacaaaagttaatggacctgcccccagctagggccctgtctacctggggtctggccccgtaagtgtgcaaattacagaacaggcttccaaacatagaaatatctttcactgtaatcccaggaagctctaagcttctacattttattaagctgcagttattattttaaaacaaggccaagtgcctcttggtatatacttaaaacctgcaaattgctttttaatgtctcagacttgtagccagcattggaaatttccagttcctctaccttgatcagctcagacatttccaccccctcaacctaaatgagcagaccttaacttcacacctgattctctaaagaaagctaccaaaaatacaacaaagatgatgggatttttgttactttaattattttaattgccagaaagtatattttgcttaagcattaggagaaacagaaagttgccccagagaaagcctctttgattcaggccgtggaataatttgttttagtgtacacatgcacacacacacgcatgcatgcacgcacacatacatacaacctgaggaggagtaaacacttttgtggatttttcttttctgggaagaagaatgcagcgttcattgattaacacaatttcttgctctcttgacttctggtggatcctgaaacacatgcgagaactcacatctgggggccagggagctgggctcaggacactgtgtgacactaagaactgtgcggtctccagaaagttctaaatgtcattggcctcaattacgaatctctaaaacagagactggtgtgccaattaggttttaaaatattaaaaaacttgacctaatcatttgaattctaggagttaagcctaaggaaatatcaaagatagaaagaggcttgaatgcctagatattttcaatctgtttttaataatagtgaaaaatgaaaataagttaaatgtctaccaatatgaaaatggctaaatcatgttttgttctcataatggaatattatatcaccatttaaatgagtggagagtatctaagaacatgataaaatcatcatggtataaaattaagttaaaaaacaaggtataaaaccatataatacagtcttagttgtgtaaaaatatgtgcttgtgtgaatacacacacgttaggaaatacacctgagtggcaatgatggctatttctgaggagggagattacacaggatcatttttctttatccctctctgtttgccatctcttccataataaactgcatcatcaaaaaactaagttattttgaaaataaaaataatggattggtctagattatctctaaatttctttacaatataaacctctattccacttatgaaccaattaaaaacaaattagaaaataacagggaggttttggcatttccaaaaacagtggctccttggggtagagaccttccacacctgatctcatcccatccaggccaaaaccgtagaggatttgcagccagggttataaagatactgcaacccattttagaaaacgaagcatgaatgtcccccttagaggcataggtggtttctcctctagaccatggcttgaggcttttgagccctgcagtaaggtgggctcgtcctcactgatgagagaatcacgctctccgctctcccccgcaagtggcatatggtttttgcctcaggacctccagaacgtgggtgtggctgaagttgctgcttccttttccataggaaatattttcaaggtcgccctctccaccctgaaaactagagggcacctcaatgggtgtctgcaagttcccagctcaggagctttcacctctatttgacaggcccttcataagttcctagttaaaaccttggggttagagtgttggtgccttgtcctctccatagccaaaggcatcgctctgtgctctgggcttcagatgttaaggagaggtaaatactaaaggacgtcattgttccctggagcacgtatcagctgcacagttatgactcaaggcacaaaatctgaagtaatcaagtcgtcctttgactactctgtgcaagaaaatgcatgcctcagaaatgtgtagccacgcaccgcacttttttcaaataattctactcagctggaagtgattttttatgtagaatatcctttcatgattactttagagcaggaatacccaatcttttggcttccctgggccacattagaagaagaattgtcttgggccacacataaaatacattaatgatagctgatgagctaaaacaaattgcaaaaaaaatctcataatgttttaagaaagtttatgaatttgttttgggccacattcaaagccatcctgggctgtatgcagcccatgggctgtgggttggacaagcttgctttcgaggatcagtttgcttttcagtctgggcatagaagagagaagtgggaacttctgaatatgacccaaaacttcaggttcccagtgcctggtcatagagtcacagactccttattcttttgaatatcactttgtttttaccatagagagactgtatagaatcatagtgcaagaaagtgccttcaaaaatgaaccagtctatctcattgccttcaagctaaaccataccaaagccattgctaactagtaagtaagggtctctattttaaggaccatcgcaggagaatcccagactcgtacagagtttgtcaatcatcattgttgggaaactttttcatatattcaacttaaacctctcagaagagtttgtcaatttcttcttattcaattctcattcaaggtgaaaacagctgggcaccgtctccatcatcatcatcattattgttactgttaccatcactaatgccactgctaccacctgagacaccaaggacagtaggtgctttgcctccactgtctcattgagtcctcacagcacacgtaaataaatagaggggttttatttccacctttgatacatgaagaaactaaggctcagaaagacaaaatgtttgtccacagtacagcttgttgtagcagagtcgaaatatcaaccaggtggactttttgtacagggccatgttactgcgtcatctactttgtatgattacaaactttcttaatctccaataggtgaaattattttagcctctcatcctgtttcctaacccagaactctatacctctcagaaatggttgctgatatctgtttgaccactaggaaaagggggaactggactagtattttctactgcgttccgatctgccctcctaagataattaggtttgagctggggagggaagaacagctaactttaaagcttggggaacaatgtcagctcccaaatatcttaggggtggagccatctgtttgggagggacctgaagagacttctgttgaagctttgtttgtttgcagagggagcatagagtgtttactcaaatgatgcattcatttggggttggcttgcgggggagtgggacctgtgaaggctggggggagtggttaaaggacatcactcccccccagccacctgtgactctactgctcctgagggattgtggtaacagttctttctggtgggatgccactgaggctttctggtatccccggggttgtgtaaaagctctaggtgctgggaagtggtgagcagctgctggggtgcataagggggagtggggagggacggaatgtcgggagcaggtgagctgcaggtggaaccagggtttcctgaggcctggcctgtgatactgtgaaacatcaaggagtgtgagtccagggagatctgagcagcacctgtcaaaggaggaggaggaggaggaggaggaggaggaggaggagctctgcttctcaggctcaatttccactgaggaatcccagcatttttaactcataacccaagcttttgcctctgggtcatagtggatcaaaagataaatgggccttttcaattttgtatttccaatctcagatactcgaatcattcccaatctaaagcacagtttgtgtttcagttctctggtgcatagcccaggtaatgagtctattctgtttatttatctagttcagagatttgggcttctagtcaaagtaaccttacacaaagaaacaacaaaacacaagtagacccgttaagagcaattgtaagatgtcagtttctccgtcttacctgccccccaccccccaacttgtgggggtttcttctatagtctgcatagagaatctcaccttttcctttgaacggcctctttatttctttaggcagtcatgactgttcttggacacagaaggtgatcagaacaaagatactaacacttcactggttctcttttcctgctcacagttgcttcaacaataaaaattgtgcaatcttgatataagtcacaaagtgtaaaacattcctattctttcataagtgacacttttccctattaatggagaacaaaggaagaaacaaccagacagaaggaaaatgctcaccacacaggcagtaaactagccccgttatgcccttgactcttttgcttttgattatcatttgtttactcaaatatttattgaaacctaccaggctaaaaagcattgtgctaaaagctggaaaagaaagaaaggggggagggaaagacgaaggcaaaaaaggggagaaactcagacaaaattcctgtccttaaagagactgcagtcaagtttgcaaagttaacgtatgtggtagaccgtgagagtgattcagatgaaatgctcttggagcctggctctagagatgagagaaggtttcctaagacatttcacttggacttcagacactgggcaggtggaagaaatatattctaggctaaggaaatagcgtgagtaacgtctttgaacataaacaacaaatttgcagccgaagttgcatggaaaaggctggagagagggaaagtcaagaaataatggagggtgttaaatgacaagcccaggaatctgggacagtcagctgtcgttgaatactgacaaataggcaagtgacatcatcacacatgggcttctgtttggaggggagtgacagccctccataaggagtttagggagttgaggtggattcaggtgagccagcctggagactgttgctgtatccgggacaaagagcaagaggcagaactaggacagtggcagtggaaactaagaggaaaataaaatgcttaaaacagtgcacagaaataacaacataacagacgccccaaggcacacacagcttagcagttagttacacatacggcccagggagatagagacagacagagatatttgggagtgtccacatgaaaccagtaactggaaatgttaaactgagtacaattaccaaagatcttctggtaatgaaggaaagtgagccaggaacagccctctgttttcgagcatgtccatttgagagagggatggagacagaagatgagcctgagggtgacttagaaagtcagagctgggaggagaaacctggaagagtctcacatcagagaaacctagggaacagagttttcagaaccagggtctgagtgacaatgtggagagctacacaaaggaaagaaaataaaagaccaagcgtgaagaaaggctccaggctgtggagggtttgtgctccacaagttacaggaggctgcggggacagaagccaggcaacagggccaaggtgtggcctggggagtgacggatcataaagccccctctcgtgagaaactgggataatggaaggagagactaaaagagtgttagctaagaaattagaaaagggatttttttttttttttttttttttttttgcgggtgggattcgaccgtgtttttctgcaaggagaagagtctgagaaacgtgccctaggcctgtgcaggttccattccaagcacgtccaaacagcacacatgcttccaaacagcacacacgcttccctccatgcacccccaggtgggaactgtggccacaggtcaacgcttctcttccctgctggaccatttgttcaccacaggcacaaatctgctctgtcttgttcaccaactgacacttagaagaggctcaaacctggtcattggctggggactcaagacagaacaaggagtgttcccactaccaagcttccagaacaggaaggaaagttggaacggagagcagacggagctcagccaggagaaacacgaggccagctgaagccagtgggcctgtgagaaggagggctccctgcctggcaccagggctgcagtcccttgttgaagtgcatgcagaggcagggtctgggaatgctcattcccaccttgttgcctcatgagcacgccccatgcaattctgggcaccaccctcagcaacaagactagctctcagccaccctcacagctcggcgtggcacggacgtgctgatcttatggtcagagggacaaggggaagtgctgcgtagactccaactggcaggggcggatcttttgtcctttccttctccttcctgcagcctggaactcaaacgagaaggcccgggctccggcagccacctttggctatggagtaatcttgagacacagacacatgcaggaaactttagtattaaagtaggagaagccccgttcttctctgacttcatagagccgttgcactttatggtagcctggttgcttccttctggactttttctgacaggagagaaattaaacacctgtcttacctaagccagtattatgttgaattttctgttacatgcggccaaacttaatctttacattaatgctacaacattaatgaaactgctaggagaagctgccttgccaggctccccggtggctgccatcacatccagcacccggtttctcaaacttccccacacccaccacagaaaagcaagaactaggtacagtatctggcattctgtaggcactgatggtcatggaattcagtctctctggtgtattttaagttgccattcaaaaataaagcactcaggtaatataagtgaattttgattaaattacaagtaacaattcctattcgggttgatagagctctttctttaaaaaggctgaattttatctccttttatagaattaaagtttttacttttcatttgtgatgagctgaattttcaggctgatgaaataagtcactgatatttaccacacaggacttaatcaaaaagaagcttaggtttcaatggtgggtttcctttttgggcatggaccgtggttttatagtggaaagctttgtagcttggctcacactgatgtccgctgctcctcacatgtgcgtcttatcttggaggctgggctcctccgtaggttctcctgccaacaagcgagacagaaaggaggcggcagctgggggaactcagccttccttcccaccacacctgcaccttgctgagccactgctcccaagacgaggcacagaattcccagagcagcctggcttcaacctactcatttggtgttctttaaattaaaaaaaaaaaaaaaaaacttctggcaaatcgtggtggctcacgcttgtaatcccaacactttgggaggctgatgaaggtggattgcttcagcccgggaaggagttccaggccagcctgggcaacatggtgaaaccctgtctctataaaagaaattcaaaagtaatccaggtgtgttggcacgtgcctgtagtccctgctactcgggaggccgagatgggagaatcagatatctgagcctggcagtttgatgctgcagtgagccagattgtgccactgcactccagccggagcaagagagcaagatctgtctcaaaaaaaaaaaaaaaaaattttcttacatcactagttttcttgcatggcctatgagttcccatccactctgtaagcctttataagtgttatggtgggatccaagtataagctctgagttactgtctcattctcccccgttcacttacagatgacattctcgcagaccagaccagcaagtctccttgcccgaggccacacaggcaggaaccgccaggcaccccgtccagtgtcccagccgagccctcctgggaggttcctgtgtgctggacacatgcctggctggctattacctgtgtagtttatccagtggttacactgacttgaagtggtctttctgaagacgacattgactttgaaattacttgcattatccagtgatcagctctggtcattgtgatcctttccaagccatacataattttgggttttgctgtggctgctgaccagcatctctgtttaagagactgagctttgtgctagagattctggttttgatgcatttcctaggcacgcccacttctccagtagaaagccaggagtgagtccctcaccgagctgatccttgtgaagatgaacagttctctccatttgtgtttagtgacaagtatgttcgttaaaatatcacgaagccttcacaagatgttctactaactagttcgagacacagcttgtatactgtgcactgaatgagtttgcataggttgttacatagattatcatacacctataataaatagagtatggaaaacactgctaaaaagtttcaatgaggaccaggtgcagtggctcacacttgtcatcccagcacttcgggaggctgaggcaggaggatcgcttgagcccaggaattcaaggctgcagtgagctatgattacgccactgtactctagcctgggcaacagtgatactctgtctcaaaaaaaataaaaataaaaattcattgagtttaagaggggttttttgtatggttacaaaaaaaaagcagtttaattcctttactcttatgagccacttatttggttcttcaaacatgtagaggccaaaaaggcactgtttctttaggttaaaaaaatgggcaaaaaatctgattttatgtttcttttctcaaaaattattcactaattattaacagcaaacgctgcgtctcctggagtcaccaggcaccgagcgttgtgtgtgtttcacccgcttggcgttttcattctcatttcatgtatttgaaagctggggctccgtacagttatgacattgacccagagtcactcagattgcaaatgacagagccagggtgtgaacccagataggtcaacctcagcctgagtgtctctaactcttcaggttaacagccttctccggataccaaagcagcactaaaccatctattcagctgtgcgggcacctgtgtgggatagaaggggctgagggatcctgctgccacattgataactatcgctggaaccagggtctgaaaccgagtcagactgaccctgaaacctacttgcctgaccattttactcccatacctcgggctatcttgcaaaggaagggttaaagaatacgtgatgcaacctcctgaaacaggcagcctaggaactttgacccacacactcagccccgatctctgtggccacctctgtgatacagacggccgcttggggacagcagaggctcaggggcagtgaaaagcagtgccggggctggagatgaaagagccaattctccattcttctgtgagtccccggagatgaacactgtgaacttgttcccagtctctgtgtctcgtgccagcggccctcccctcccccttccaaggacaagtccacccccagaggatttgcccctggaaatgggtcctcatggacaggggagaatcagagattatttgcttgaggtggcaaaaaaaaaaaaaaaaaaaaaaaaaaatacagacacatctccggccaaccctttttatagatgtatttttgttttttacaaaccaaatagcagaggttgattattagtacagtagtttggggttttttctcatcattaaccacttagttactataaatgtgttttaactcacggggaaaaagtccagcataccgtaaaacctgagtcccacccagccagctcggaatggaaggcttccaaggcccgggaggcgcgctctgtcaagttgctgattcgggagatagcagtgaatcggggttccaccacgcccccagaatactattcacagcagctttgtcattgaccgttctcccttttggacgagatctgaaacaaagcttccaatcacttccgatcctaatagcgttacctctcttaggtagggtgtaaggattcttagtcaaatttcaactcaagtaggttacctaggaacattcttagggcttaacctacttagttcttcttgcggtttcagttgaaagtgatagactcttccaggctctttgtgttccacggtccggtggtgaaatcactgctatctctccctccttagagagcccactgcttcccaccaatgagttaagtagtttttcttgcccatttctgcaaatttgtgttcataaaatcagttgatggatgaaagttactgaagaaattgctaacaatttcgaggctttccttaaattgatagtttgttttactttattctagttctcagtggaaacaaaaggcaagaatgatctttggaatgttctgtttacaaaatcaacccaaacaagatatagatgagactcattgtcttcctccagaataacaatcgcctttaatttctgtgctgctgaaacagtcacaagagtcatgatagatccagaaagagacccttggtgcttcatgtggtatctttctttagtacgggtctcttttacattcagcaggtttcattagaaaaaagaatttcaaagtatttcattaacaaaattgagaaaatgcgtatttaaacattgacatccttatgaaagagtaatttcttacataaatgtagcattttcacctatgttacctcatttaatcttcagaactaatcttaagttgcaatttcacaattttatagacaaggaaatggaaactcatagatgttaattcactcgttccgggccacggaggtgtactttttagagcatagtcttatttaatggtcttgactctaagtccaaaacagaagcctccactttgctgagcaccaaaagatcgggagatgagtcagtgtgtgagtcccaagaggaagagaatctgcgggtccttagcagttaaggaagcgtcatgaaacatttcttgaagaatggataggatttaaatagtttagaagatgcagtcttgaaactatgtgggtgatccaggttgcatgagcaacaaatatttgttggacaattgaagagtgaatgaatgaggacggagggtgtctgagatcaggaaaatgatctgggaaggtatgaaggcaaacattcccacgacgtgttcggggaaccgtgagtaggagccactggctctaagagagtgtccctctggacaagtagagagagatggactgccatgggtgctctgggggctcgaagggcatggaagggcatggaaggccaggctaaaaagtgttgattttgccttacagattaggtcaggtcttcattgcttttgactaaggaactttatcctgaagacaagatcatgggaaatcattgacaacttgtaggacatgatatgaccaaactcagtgttttaggaagatgagcagggagtgaagcacaaaacagatgaagagtgtgtgttgactctggttttaggaactcaccctgtgcctctctaaagcttctgtcagctcttcccatcagtgggaagcagatttagaggccaagctgcctagaagacatagggttaaagaaaaaaaaaaggaagaaaaagaaatgcacctttaaaatttcccaaccttgatttatacctacagagatgtatgtgtggtcactccttttattagggtttttaagctaatcagtaggcttgactaaagaattgtaaaactttcactacaagaaaaattaaaagaagtcatttcctgtatctaaaatgatcacgtatacttctgaaattaggaaaacgcaggccaatgataaaaatataactgtaacgaaactgtaggttttttactgattgtattacacaatatttccttttggattcttaatacaaagcaatgcaacactggtttggtttaaaataaaatatggagagattcttgttctgtaggaagctcatcactctaatgggtgtcttactcactggaacagtattttggctgtactggagcacatcgaaaggaatgagatttagctttgccaaacttccactgtgaaagagtttgctacaacagtgttttattttattcttattgaacttcagccagttgaaaatagaatctcctcaccatccttttaaattagccttaagctgcagataaaagacaaaaatcaatgtgcaaatttagctccttgtgctcggttccttaagaaatttaccccagtgctaatatgcaggatgcatagataatagaacatagagtaactggaagttttaaagtagcatttcttgttcagtttaggtctacttaagagtctggtaaatcctgtacataaattgtttctttaatgctacattaaagacagtgcatctctttatactgtccatactagctcagtaacactgcccctgataacatttcatgtggccatgacaaattatggtgaaattttcagtgtccaattggaatggaaattgctagaaaaaagcggtgcctaaataatggtgcaattctatttattccatttcactaagaattactaagggcttcgaaaacccaaatcgaaaaaggaagcacataaacaatgttcgtattggccatactagcttgaatgtctctaattgttctaagtggtacaggtgctatgagctcctaagaatatccctgtgtttgagaggagttaactcagagccttgggttgcttgctgtcctgccgcactgcacgagaaaggttagcaacataaagaaatgcaactttgcctacttcaggcattaatataaagaaacctacgtacaggcacccagagacacaaaaagagagagaaagctcaccattcttgaaaaaggcagttctgcaggctccacaaacaagtacaccagtgaatgggaatgataagaggagaacaatttggttacattcagagacctggtgggcaaatggaaatgggacaagcagtagaaattaggccagatcatggaagatttgttttgttttgttttcatggcatgatacctgcaaggccaggaaggctgaagccagaacaccaatgcaattaattagcagaaaccaaaaagtaattaatttagcacaccaccatatagggcagaagcaaatactgctgtttgtagccagggatggggaaaggatctaaccacactccaggcacctctgcacatggcaccacagagagaaagatggaggaggagtgcagccgtacgctgggagtcatcacaattgtttttttaccgataaaagcaagtgggaacaattggccaaaacaagcctggattgtagtagaaaattaagctaagaaagaaagatcaggggacattgtgataaaacaatccacgtaatttctataacatggatccagcttaataagatgtcctgaagttcagcatgagtaaagttccaggacagttcagggttgtcataggaaatctacatttttcaaattaacaggacttaaagatgttactgttacttcaacacttggtaaatttcactgcaaatatataagccattttaaaggaaagtattagataatcaaagaattcgttaagaaaaagaacaaattgagtgcccacaatataaatggtggccctgctgcagattagttcccgatgcctgagataagatgctggaggaaatcgcggcatcatcaatttaatcccacacaaaatgcaagcgaccaccttagcttagttgcagttgtggtgggcatgaacttcacaggggcataattgaaggccaaaattaaatgctctttatttctctgtatctccgtgtaatgtcctgatcctgagccccagactgcctcatgggtccagtagggatgcctctcagcaggttgtgcatcgggagaattttgctgcattgagctccagagctgcttccctgtgtctcctctcccactgctgaccccacccccatctactctaagccccagcaaatcaccccagcactcccaggcagtgagtgggggagggcgtgccccctcctctctctgttttggtccagcctatatgtcacagggcttctttaaacagtgactgggcctttctgctggccttcacttaactctcagctcagcttgcaggcaccctctgagacgcaggcactgcccccttatagaatctgcatagtgggctgcctagccagggggcttcgttgtgtggccttttctctggcaggctttcagatttcccccttcccccaagaatggagccaaggggtggaccccaacatagcctgctggctgcaaagctgcacacgcctggagagctgctgtccaatggcaaatggaagcaacattctcattgtctccactctcagacaccctcagattactgagggaattctctcgtgtgcccccttcaacacacaggcagacacagatacacacacacagacacagacacacacacacacgcagacacagacacacacacacagactacttgtcattctaaacttgccacctctgtcctcagcatggggccagtgtggtggagaggcctgttttgcctggctgtgcccacagtctcatctctcccaacttagattcttactaagagttggaactcttgattcctctggccgcttctggcagcctcttcccctggacacaccctatctccctgcccagtggagccgtcgcgtgcaggtgtgcatctctcactcctgccggaccaggcgctccctggccccatctcacagactaaaacatgaggctgttcctttgcttccgagtagtttgatgtcattcaacccagcatgcatttcctctccaccgctctgctccctccctggaggtgcttctgttcctacccgctgaggggcacagtcaggaggtatttagtcggcctcccgtcgccctcaccgcacacacaagaccaatttgacggttgtttgggggcatccactcctggggctcttgacattttccccgggctctgcgccatcagcgccctttcctgcccccacttcacgggctctgtctcctctccaggcacctgctctgcagggagggagacaccccccgtcctcaagctccacagggtcccgggtaatttcatccgtttcccttccctatcagtggctcccaaatctgtttttctcaaagtctgttttcctctgaacaccaaatcacagtttcaactgtatgtgatacaacacctgaacctcaggatggcctaaattgaactcattattgacttctcacatccgctcctccgttgtatgcccaacatccctccatagactgatctgttcgcggcctctgctggaacctcagtgtcaccttggacgccaccctcgcccaccctacccacgccagtcagtgcacccaggcctgtgcaagtggcctgtgaaaggcttctgtgctcgccgcccgcctttccagtggctcaggactggccccatctctttgcagcactgctgagaacgcctctcaactgagagcccgcgctcctcccctccatgaatgtatctgctttccaccccagacttcatcatggtgctgcaacgttgacagccccgtcacctgcagaaccatccaaacccatcggcagcacacagagaccctgctggatttcccagccccgaatcccaccttttctacttcaccctcttttctacctcactcagtgggtttcccatcccaaagtggattctcacctccatggtgtatcaaagtcctactccttctcccaggtccaaaagagcttctctggggaggaaccccagcatcccaggccatgagtcaggactctcctccagcactgctgtgacgcggcacgtgaccccacctgcgcacttagcacctcctgttacgcgcctgtccgctgatctgcgcctgtcatcacgtgaagagctccagggaggccgggctttctcccagtcccctttatattcctcgggtctagggcatgcctcacactaagtcaataccaaataaattgtccactcttcaacaaggcaggaaacatgaggggagagttaaaaagtcccaaaatgagcatatctctttgaaacaccccttacaatattagtttttaaaattctacttgttgagctatgttggagttgtgtgggtttatatgagtatcttttcctacagggaactatgtgatctgtgcaaatagagtccccacacacaggactggtttgcatcagaacatcggggaggcaggagccccaagtcaaccattctttgtatagaaaaagctctcccaagtcactcttttctttggcatgtgcatagtcatcttttaccaaatgtttagtcagtatcaaattcatttgctactggaaaacctgttttgatgacagttgttgctaaaaacctgtacctgatcaaaatgattgagcttactaactctaaattaaggagtgtctatttaagcccccgaagctacagtagaaaatctaacgtcatctcttagaggtgagcttgttaaaatactgacgtgatgcctttgtgagtccaccgtctcctttataagaatcaggccactgatcctcaggcctgaaggctcatctcttgggaaatagaggtcacaccaagggtttggtccgtgagtgagaaggtcgtctccagcctagaaaggtgaagactctttgattctacagttctaaagcgtggcctgaccgttttattttagtggcctttctcacactttgtctagtttcatttttgttacataatctgcataaaaattccctcagtagttacaattgcagtttagttcatgtctgacttggtgtgtcgttctgttgtgtttgagatctgaaaaactgtcgtcattgcccatccagatagcattcagtagaggggaaaggattcctttgtacaaagcaagcatgggcttaggatatttccacatactattcatttgcagacattgactaagaacaattaggaatgtacgctagaacgtgaaaaacatcttttacatttggatccatcttgtaagtgaccaacatacttttctttgaaaaaatagagcccatacgtttgtggcctaacaagacatgagaggataattgattaaaatgtcaaaggtggttggggaatgctgagatggaatgatactgcaggaaagatttcgcaaaaacaaattaaagtggaaattacaattcatgtataaagcccgtttgtatgatcaaagcaggcatcatctgtactgctaagttctacgtataacatagttttgttaaagaaaagtcaggcatgagatggacataagggatttgctgacaaatgcataacagctctaatgactaattttggttttagttagtgcaattctgtaggtggacatttagccagtttgttaacaaggtgttttaagaatgtcttccaggacaatttaaaaaaagagagaattatcttctcttacagaacaatgaaaaacagaattatctttcagggatggatgtttattacataacctattggagaataatggaagggaactagatgccttatgcccagcttattcattatctgatacctttaaaggctgaatggcattgccaattattcattgtggcaggggctgccatcaatttttagcttacagattgctagtttctcccgtgttctcttccatgaaacagcaacatactccattttgttctctatttaaaaattttacattgcagccctccaacaaattaattccatttaggtttcttcgggaagagatacaaatgagttttgtgaaagtgtacttaaatgcagccatccagccatcagcatcaacaggcagtcagctgtgcccagtgccatgcgcctgatgcccgtgactgacaagggcccgcattcactgtcccgggcttatgtgaatgctgacacactggtcaccgcagggcatactgcttgttgctgcttagttcatgcttgcacgggcagacccccaggtggcctgtcatttatttctataagctaggtctggtaacaccacaaaagcagtaacattcatttatatgaaggagaagtacataatccaaaaatcagaaaaattacttctgatagaagaaactaggtttcaaatgcgggtcttaataatacaactggattccgattgcattacattggttttctcttccaaataattggcaaatgaggacaaacagctcatccccatcctaacaggaaggtctgaatctgaagccttaccatcggtgactcattaggaccccattaagagccagaaaacttgcctaaatataatacaaatcgaatcttcaatgaggactacacatttgtaaactaaatttgaagtccccaaacatttacaagtacatttgttcttcataagtacagtcgtaaagaaaagcccagtcagtgacagtcaaccttgagcaacgttggaatatgaggtttgaaagtgaaaatagaggtcggcgcacaatctagttagtgcagagttgcattagacacaagtagtcagtgaccccgatgcacggaggaaattctgaaggttcaacatctgtctgaaaataatcgaaaggccctgcctagcagcacaagggactttcaagaatgggctttcctgtaaattttggatttcttttcttagagaaggtaaaaatgacctgctttctacttttcttctgattggactgcaatggccaaaaatatttataagaataaaagttaacaaaaacagtctaacccgtcagttcagaaccctagtaaaatttgttttggagcctagaactagaattgggcaaaagtgtagggctctttctcttataccaaaaagcccactcaaatgttctgtgagcccgctccaaagataaagtcagaaacaacttaacaacttcgtcttctttcactgattacttccctcgtgttctgtctattgctgatgatgtcctgacaaacagctccaagcacactcacccagtgcccgtgtgcagcatgcagaccacttgtcacccaatccatttctgagggatgactgtgttcctgaaacaactgaaatcagaaatcccttatttagcatttattagaatactgaatttaaaatattacatattatcatttgaaaaacaaaacaaacaaacaaaaaacctgttacttagattcaagttaaaagagggactatgtattcacccttagtccaggagaacagcttaaaatatgagcaccttttcctaagccattccacttaaatggacactagacctcaaaattgcaaacaataaatacataaataaaagcaataattaaaaaactaacttcaccatcatcccttcccgccaccccccaaacctacttccttcccaggcttcagatgaaatttctatgaatgatcccacccagtctcattcctcagctcagtgtcaagttccagtgtcctctgatcttccctttctctgacccccacacctttatggcgagtggccccccaacgccacgaggcctttccccttcactgctatggccgctttctgcaccacccttgggggaggtcacagcctctctgtgacctaagctctctcctctctaaagagaaggcatccacttaggtggtttatagggtttctcctagctcaaggatcttgagtgtatcgttgagctaagatacactcacgagctgagacctcctgactcaggcactgtggctgcactccaccaggtgacttatctgtggaccacactccacgtggccatctgtgcctatgctcttcctccacccatccaccaaaatgccatcttctccactcccactcagagccatgacgtccctctgcccccaggttgtccaggatcctctcatcttccatttccagccaccttttttctctaaaccctgtaacacttcataggagtccctcccaatgaaagccacaccccgcctggtgtctcacaccccaaagcagactgtaagcttcctgaagactgtcctgctcctcaatgtcccatcccctcccgaactgaccagcggtgctatctacggggaagcaccggggcagttgttgttgaattgatttcagttaattcagtttttaactgaatcacacaaaggatgtcacaagctagcttttataactaaagaaagcacagttgtgcagctgcctccagagtctctgggggttagagggaatgaaatagggaaagtccccagaagccagctgactgctgctcaaaccaggtgcaggttgggagaaaatctgtagtgaatgaaggaaaatgaaatgcacagtggaaaagaataccaacattcttgcaaaggaaccttaaagtattatttttgcaaagaatgcaaggattatttcagttcccttgttgactgttttgtatggtcttcctacagatactttcagaaaaagatctattgtttgtttttctctgtgctgacacagtatccattgtttagaactgtaatcatagcacacatagttgaaaatgtgggctcggggacaagctgtattttcccctctggttctttagacagtgaatactgtgttctttatctcttatcacagctcttttgtcaaacatttaatgattttttcccccagacaaatttgtagtttgttatcaaccataaaaatgtctattgccttatttttaaacatttaaactttggtaagtgtgtctcaagatgagcatgaattaaggtgtttatttcattttaaatacttttttttatcatagcgtacaaagctagagttctctgacatggatggcttatgtggatctctatttagacttgatgagagaacattttatttttgtactgtgtgtatttgcagggaagatggttaggctgactggctcccaggttgggtgtgttgggagcatctgtcaagggttggacaggtgcagacatctgtgacgtcctgcagtaggcagccatcactcgatttcctgcttaaaaagatctgacacacttcttcactccttggatctccattttttccaaatgcccgatacttcttaccattctacaacccttaaaccggatcccaaagtctgtgagagataaaagccttttttaaacccaataaacagtcactctttgttgttcctggttttaaaatgacaatttattgcttgatacagacatttgaagcctataattcaaatgaatatttataaaaataaatttcaagcacactggcatgtaactgcagggtaatttttaaatattcatttttaaggtggtgatagagtctagaaaaattttaatgtgccacgttatattttataaatatccaactatagaaatatgccttgtgtgctaatcatttccataaggcttcacttagattgagagagtgaaaatgggtgtcagtctttcaaatatccagaggaaaaactttcattttgttttaaatttgtttttgagggctgaatttaaacttaagacaatgtatgaagagttaaggtcagagttggtactttcaccactattccatttgtattgctttaaattctctgattaagtgtggaaaactatcaacaaggcgattgttcccaggggctgcccggccagaaataccgagactgaccatttttaagaacccagtgctatgtgcggaacagggcggcatggtggcctcctgagaactgggagggaaacactaaatgaagacgtgaacacatgggatttctttctttctttatttttattaaataaaaaatatttttattttgttatattgaactcgacaaattttcctcagagataatttttgtttcaatattcaaagttagaaattgtaccagcccgtcatagtttgaaagtattcctaaaagtaattcaaataaaaatgtattttaaatgtagtacacattttaaacatattggagaaaacatagaatcagagactttttcaaatccatgttggactaggaaactgtttctttttgtttctttttttttttttttttcctgagatggagtctcattctgtcacccaggctggagtgcagtgccgcgatctcggctcagtgcaacctccacctcctgggttcaagcgattctcctgcctcagcctcccgagtagctgggactacaggtgtgggccaccaaagccggttaatttttgtatttttagtagagacagggttttgccatgttggccaggctggtctcaaactcctgacctcaagtaagactgtttcttaatactaatcagatttgacaacagatgaggccatctgtgatggaggttctgcgcccgattacacattcccctgtagctcatagactcagtgctcctttctacagaggagagattccatagtcagtgttcctggggttctgtttttacttttgaagttccagaacttagtttcagttcttcctcttgatgtctctcttttgttctctccccctctctccctccctccctgtcttttctcctgtctccctgtcaccctccttccctcctttcatatctttctttcttcatcttgttatttccatctgtctgcctttcccaaggcaggaaaccccggcgcctccaggctggtggtgtctggctctgggctgcacaagccacaggccacctgccatcaagcacagaatggacttgacggggaccctgacagccagtcattcctgggactagatagggtgcagccggggtgtccgaggtgtttgtagtcatagtggcatacctacactgaagaggacagcttttttgtaagcggtggttgcttcactcatcaaaatagcctatttgtgaaggcatcaatgtgcaagtattttggagcaagtaaaatcagtcctggagattagaacatgcaggcctactgggccacaggaatggggctgcctgttgagactggagtgcaatgccccccaaccccacgcctgctgttcttccctctgctcttctcccttcccacctccttcactctcccctccttccccacgcccctccctcccttttggtcatcagtgcactttgcaggcatcagatatttggggctcttcaagtgcctcccctctacatcggtgtccacgggcttgctgaacagtgagcctctcctccctcctgggactggtcctcttcaacttgagccttgatctggagtcgatggtagagggagtccacttctcttgaccccgactctcaccatgtcaaaaggaggtgatgtttccaaaggtagcaattgaaggagcctctttatccccccataacagagaaagcatcggggatgccttggcctctcagccacgctttgatgattggcatttgattgttctcacatttcattatcgtgaaccactaataatgttggctaattgtttatttcatttataattccttaaatctccatctagtcttgaagctgttgcatccaaagagagtgctgccaaagagaagtttaaccacaggtgccgccctgaccacacttccaagactatctcctcatgtgggttctccttacatcatacatttgaccgtgaaacccatgaagacaggcgtccaatggagaggagtgttggaggcctcttccctttccacatggccctagagcccagtgttttcaatgtggtgtgactcccttttccagcggcgaaatcgttcccccgcttcccagaagtgtgctttaaagacattttgtgataagggagtgcaggtaggaaggggtctaacctcccccagggctccctgcgcctcggcggctgaggaggtggcagtggaggccgcccgacccccctctcagcctccctgtgctgcgttccctgccctgccgggaaatggagattctgcgcctaaagacacacagtcacgctgctttcaaagtttcagttcccacggccattctaaaatggcccctggagagctctggcttcctcctgcgccccttcccgcgcccgcccctgggtgtctccgctggctccccagcatctcctcccagctcgggatctctctcactcattcctccctccctgattctcgcctccattctcccgctctccagcagggcgcagctccctcttgctctttctggagaagcagggatcccagagaccccctacgagctggttccctcccagaccccgtccctccagtcgctggctcagtttccttcagtttcctccagctcatctcctgcccacctcaaaagcaacaggtccaagatcccaatcagcatttctcgcacagcgtttccgcgagaacgttccctgatcatctagagttagggaagtagaaccgtgccctgcacatgataagcacatggagactctaatcaatgagagctactatgattgctgctcacggacagcgcccaacagctctgttgtccctgctaatgacaccgtcgtccctcccctggtcaaccacgacccaaatgttaaagtgacctttcactcttttcgccaacatgtatccgctccaagacctctcctgtcctagggctactgggagccttacctgtggcctcaccttgctgtgcagcattggggagttgctgctctgcaccttagagatgtcaaatgggaagagtgacagctacttcagcagggtttgaggcaacattaggcaacacagtgtaaataaattacataacaatctgcttggcacttagtgatggttcaataaatgttacctgttgtcgtcgttggaactgttgacagaattcagtgagacttcagtgatggtttcttgaaagagtcacttatcatattctgcaatcaaagaaggaagagaggccaagaaataaacagatacatgtgcacatgacacaagacccagggtgagcagatgttcagaagacagagctaaagaaagactagagagacagacagacagacagaaagactagacagacagacagacaaatagataaacaggtagaaagaaagactagacagatagacaaatagacagacaaatagacaggtagatagatggatagacatgtagacagactagacagacagactagacagatagatagatagatagatagatagatagatagatagatagatagaggcggacagacagcttggtaaatgggcaaatgatagaaaatataaataaatatatgaaggagggagaaaactgaagcagaaaaaaagtaagaagaactcgtggtcattttactaaacttttaaaaacttgaacctaaaattttcaagataacttttttctgccaggaaaaaatacatatattagtagaatgtgtcaatacctgattttttccacagtaagagcatttccctttgaatacagtcataactggttctccgttagtagtaatcacagctcatctctgtggatattgttggtgctttcagttgctccagtacacatctattttgaaatcacctttagctataaaggaagaaaaaagaaataccatctgtaaatgcttgctctagaggtgtgtcataaaagtacagtcccattaacctactgtccttatgaaactggtggctattttcttttcttttctttttttttttttttttttttttttgtgagacagggtctcactctgttgcccaggctggagtgcagtggcgcgatctcggctcactgcaagctctgcctcccgggttcacgccattctcctgcctcagcctcccaagtatctgggactacaggcgcccgccaccacgcccggctaatttttttttttcgtgtttttagtagagacggggtttcaccgtgttagccaggattgtctcgatcttctgacctcatgatccgcctgcctcggcctcccaaagttttgggcttacaggcctgagccactgagcccgccggctattttctattcttatgttaaatgttctctctttaccttccattttaagggaattgacaagggagcaattcagagcaggggttatcttatctttcaaaggaacagaactggccacatcccagtagaaagtagaaaggatagcatccctgtccatgtcaggagcacaaaacaaaaagtacaaaaattgtgatgtaaaccacttgaaacttacaaggcagtacatagggatataatgacttcatcatcactgatgcaaagagaggtttctagatacgtgtttatctgtgagccccaggtccccgctaatctgtgctgatgtcttgaggaaaattggagtgagagtaaaaactttgattcactcacatactttcctttttcaagtaggcatttcagtctagccttggacatgcattaaccaaacgactggaactagttattcactaaagtgaccacagatttttaatatagtctgcatcaactgttttgattatgagaattttacttctcttttcttgctaatataatgagtcaagatagctcagtaagttaaaaaatattcagagtttgattatttgtttatcatttgttcaaaaaacaccatcaaatacctagattgtgagataaatgaggaaatcatagcaccatctccatactgcttatgcatcaggcacttgctctcagcactttacatgtgtgtgtgtgatttacagttgtgtgaagtggatggtatcattgttctcactttacaaatgatgaaagtgaggcccagagatgttaatttgcccagggtcacacagtgagaacgggtggatcggatgggcaccgaggttgtctggcaccaaggatctgtgttcctgttttgctacatgtagaaagtgtgttgccttgcccattaatgaggtcccagcatctgccccggtgtttgataataataagggcttaatgatcgtgaacccagaaaatctgagacaggtctcagttaatttagaaagtttcttttgccaaggttgaggacacgcccatgacacagcctcaggaagttgtgacgacgtgtgcccaaggcggttggggcacagcttagttttatgtatgttttagggagacacgagacatcagtcagtacatgtgagaagtacactggtttggtctgaaaaggcaggacaacttgaagcaaaggcaggaaaactcgaaacagggaggggcttccaggccacaggagatgaaatgaaaggttacattcttctgagtttctgatgagcctctccaaaggaggcaatcagatatgcacctatgccagtgagcagagggtcactttgactagaatgggaggcaggttggccctaagccgttcccagcttgacttttcccttgagcttagtgatttgggggccccaagatttattttcctttcacatgatcatgtacggaataaagaaatagatgaacacccatgatgttcaatgtactcaatgaagctctgagtacttaaagaataagaatgataaaatgtttcctgccctcaactaaattgcaggctgattcttgcagcttgagctaattcataagaaactagagattctaatccactttcaccagagggccttcagctaggacagaggctcctccagggtttgtgtcagccgctgttccaagtgaaaagtagtgctttgtgtctattcattccttcaaggctcatgacaaccctataacccagggactattatcatcccgtttgcctggggaggaaacccagccacagagcaggcaaggacctaggccttgatcacacaggcaggaaagagctgatcccagattcaaactcaggcagtgcagcccaggaggcctcacccttaactgccaagcttggccgcctctcaggcacctaatacttccctggaggagtaaatggtggaggtggggatagagaatggccagactgaaactccactgagaaggatgcctggggcagagctgtcttcctttgaactcctcgcagaactcattctttaacttagccccagaggcaaccacaattcagtgtggttcttttgtttgttgtgtgtctgtgtttgtgtatgtgtacagatatgtatctacgtgtctatatacatagatagctacaaacacaaatacatatttgtatatactgtgagggttatatttgtattatatgtaacatatatctctatcactgcctagaggaaggtcttggacattttaaacatcattaaatggcactatagtgtatttatctttctgcagacttgccgaagaatacaaaacatttgaccctaaaaagtgactctgctcactttttaattttaaaatgtgatcagagatatagtacttggatgggcaaaaagtgaaggaatttgctttgataaagactggcaaccagaggaatcttttagtcctctttatgtactgccagtctgagcctacaaatattttttattaaaaatacagaaaaaaaggcaacttttttttctaatatagaaaaggaaatgtcctaggtcttttagtcccctgggactcttgcatcacaaaatcaggaactgggacattggcacctcctgaggatgggaccacccagtgtgggcttatatatatgtgcacacacacagcacacttgtcccaatgtctacaggatgttctactccatgatctagaccatttgcgtgacctcgcgcaaaggcaacagtactaaccttggagtctaaacgccaagggtatgaacgtgggcacgtgtcgcatacttcccagttcatgcatactttccaaacaacgcacagccatgagtgggagaggggagaggattgaatttcgtgagcagcatgcaagatgtattgacaggactgcaccgagagtcttttctccaaggaaggtcaaattttaaccttttaacgttggaagtgaagacacctgatatgatcattgacaaaccaagaaatactaaaaaccctcaagagttgaagcattcttttacaatccttgttttagatacctttttaatagggtgaccaattgccccagtttgctcagcactgagaagtttcccaggacacagaacattccaggctgaggcaggatgcttggtcaccctacttctgcacgtcagcgtgcttgggaagcgccctgcaccaccggcattcctgggccccagaacccaggcactgggccggatcaggccccaggccccaggccccaggcactgggtgggatccgcagaacatgggtcctgcctctcagcagttcaggtctcttcacatttctcagcctcctatggccacggtttcctgtgctctgttcacgtttttcaaatgtgatgtttattatttcttaacttgtaatgtgtcaaacaagtataaggaaagctaacgagacggaaacatagggaaaaaatatttttaaagcagtattacaagaagaaagtgaatacttaagcggaattggtgaaaacctttaatttacagaaagtgtcacaaacccacttccacttcattagagtacatatattatatcaattcttaatagtagttataaattgtaataggaaccaggaagactacaacatttatcagttcacaagtggatttttcgtaatcctgctgtcttcaggtatacatttatgtcccaatttctttaagacacagagtcataaagagattcgggtgttccctgagctacaaagcagaagagcctccctcggcccctggggagcctgctcaggaatcgggctgtgtggggacagtctcctcacctttgggcatgaggtggggctgggcaaagaccacccagctccctaacccctactcatccacctcctgccccagttaaaatcaataaatatttactggcagctacaggtgtctggggaggcagaaaggaacaagtcatgggcccccacccaaggagggggcaggatgcagcgtaagaacctgcgcttggtcactgaggtgcttggcctcaggccaccacctcacctgcgcaattaggtacatggtaagagcatggtgacggttctctctccgctggggtgacatggggatgttaggtgacctcgagggccattgacacagtcagatgtgggagccccgggtccattgcaaatggatccagtctaatgggggagagagacctgccttcctcacacggtggtggccaacctcgacgttagatttgggggaagttcagaggagtgagcgggcctccctggggggcttcccagaggtgggcttagagccagactttgaagggcaggcagggttagagtaatgagcaaagggcagaggaagcagtgcgagcaaacgcggggacctgagcaggcccgttggggcagcaggagggcagcagggttctgggaagcaggggaagccgtcctgtcccggccggctgctgggagaaggtgggggcagaggggaaaatggagggaaactggtgcttccgtgtccactggtcaggggtgggagttgattagtaactgagggaggaaacataagatcctctctgagtggaaagtctctagcagtgactatctctgagtccttctccagtcccaaagctctgccatttctgcctttgctgctatgaaataaatatatatatatgtatatactgtttgtatgtgtttatgtgcatgtgtgtgtgtatgtgggggtgcatatatgtgtatatatgtgtatgtgagcatgtatgagcatacatatgtatgtgtgcgtgtatatgtgtgtataaatattatagattcagattttcccatatttccccacattctgccagcagtaatagaacaagctacataaattgccacaaactgtcaaatattcaggattctctgttctcagagttcaaagagaagtagttgtaacgatggttttcatattgaaatgagaactactaagctaagctaacctagagaggattctagcaaatagatcttggattgattccttgcttgcaatttatctaagcaatccataccaaaaaaaagtaataaatatgcaattttgcctaaatctcatgaataactgataaaaagctagattatctgggcttcagcaagtactttcacatggagttataaatacagaacattgaaggagtggtcgggaggccaggatcccaagtcagactgtgagaattcaatctctgggtgccttttcatctctagtctgattgatagactgtggagtgcgttctccaaaaacaagttttagaggagccacaaagtcggaaggggctgtgggggaagcaccttcggttgcctgcttgccacagctgctagtcagggaataggtacatcgggccgttcctcatcttcctggcctgctgacccacaattatcctcactcaaaagcactgtagatgggaccaggcacggcggctcacacctgtaatcccagcagtaatcccagcactttgagaggttgaggcaggcagatcacctgaggtcaggagttcaagaccagcctggccaacgtggtgaaaccccatctctaccaaaaatacaaaatttagccgggtgtggtgacatgtgcctgtggtcccagctactcaggaggctgaggcaggagaatcacttgagcccaggaggcggaggttgcagtgagccgagattgcgccattgcactccagccgggcgacagagcgagattccgtctcaaaaacaaacaaacaaacaaaaaaacccaccaaacattgtagaagaaggaaacaccctcactgtggatcacatgcatcacttctgaagatttattttgttaaggaaagaaactttgtttgcctcgggttttgggttggtgatgagttttcctcgttcagctcattagcccatagaacaactgcttcagcgcatcacgctggcagggccctgaaggagaagataatccgctctttctgaatccataggacaataatagcaaattctgagcttattaaaatacatggtgtcaccagctcatcagaaagggcaacaggcagtataccaatgcagttctggtcttgtagtttcaaaaggctaattacttttacaataaaataaagagaacttacctgtcattgagctgatgcatgtaaaagctgtttctagctaatagaggtttctgcaaatgattcagtacacattttccacaatgttccacaaatcatattggggtatagttgttggcggcatttcatacctgagtgaggtgtgatcatgttttaattaggatcctgtaaggtgaaaatagactgcacatgcaaatagtcggaactaattgcctattttcatgatacatagtgatttctaagaaaattatgactaattttaaatgaactaaaaatatgaagtgatatccaacctgaatcctgtgatagggtttgggagtttcttacctaaagggctaaatctttgtcatttcatttatagccattcatgaacacaggtaatagtgtttgcagatctttataaaaatgtgtgacatggattgttaacattagcttggcctcaaggtaattttcctctagaagtatttatatattttaatagacaactgacagactattggggcttcaagtcctttccttataaatttgaatccacctttatgttattactgcattcaattttctctagattatatgtgccaatacaaaaattctaaccttttccccttggtttaatatttttctgtgtgtttttatatgcatatgggaaacactgacagagatgaaacacccatcccatctgttatccttgtcctctttctcttctcctctacccccaccaatcacaagtgggaccctggaaacccggggctgtaatgcatgaaagatctagaaacgaggagaggtagaacacactaataagaagagcccatggtcagagcacccctgcagattgtcaggagctaagaatggaggaaaagagagactcattaagccatgccccatggagaggcaatgggaggtgcataagaaatgtttctggaagtcctgaccagggcaatcgggcatgagaaagaaagaaaaagagaggaagtcaaactatccctatttgcagacaatatgattctatacctacaaaaccccatagcctctgctcaagacctccttgatctgataagcaactttagcaaagtttcaggatataaaatcaatgtacaaaaaccactagctttcctgtacaccaacaacagccaagctgagagccaaatcaagaacacaatcccattcacaatagtcacagaaagaataaatacctagggtatagctaaccatggaggtgaaagatctctgcagtgagaattgcaaaagactgctcaaagaaatcagagatgacacaaacaaatggaaaaacatttcatgcttatggatagaagaatcaatattgttaaaatggccatactgcccaaagcaatttacagattcgatgctattccaattaatctaccaatgacattcttcatagaattagaaaaaacaattttaaaatttatgtggaaccaaaaagagactgaatagccaaggaaatcttaagcaaaaagaacaaagctggagggaacacattacccaacttcaaactatatgacaaggctacagtaaccaaaacagcatgtactggtataaaaacagacacataaaccaatggaacagaatagacagcccagaaataaggctgcacacctacaaccatctgatctttgacaaacttgacaaaagcaatagggaaaggactccctattcaataaatggtggtgggatagctggctagccatacgcagaagattcaaactggaccccttccttatactgtgcacaaaaatcaactcaagatggataaaatacttaaatgtaaaacctaaaactacaaaaaccctggaagataacctcagaaataccattctggacataggatctagcaaagatttcatgacaaagacaccaaaagatgttgcaacaaaaacaaaaatttacaaatgggacctaattaaactaaagagcttctgcacagcaaaggaaaccattgacagagtaaacagataacctacagaatgggaggaaatatttccaaactatgcatctgacaaaggcctaaaattcagaatctataaggaacttaaaggaatttacgggcaaaaaccaaacaaccccattcaaaagtgggcaaatgacatgaacagacatttttcaaaataagacacaaatgaccaacaagcatgtgaaaaaatgcttcacatcactgatcattacagaaatgcaaatcaaatccacaatgagataccatctcacaccactcagaatggctattgctaaaaagtaaaaaaataacagatgctgacaaggttgcagagaaaagagaatgctatacactgctggtgggggagtgtaaattagttcagccattgtggaaagcagtgtggtgattcctcaaagaacttaaaacagaattaccatttgacccagcaatctccttattgggtatatacctgaagtaatataaatcattttaccataaagacacgtgcacgtgtatattcatgacaacactcttcacaatagcaaagacatgaaatcaacctaaatgcccatcagtggtagactggataaaaaatgtagtacatacataccatggaatactatgcagccatgaaaaagaatgggatcatggcttttgcagcaacatggatagagcttttatcctaagcaagctaacacaggaacagaaaaacaaatcccacatgttctcacttataagtgggaataaacaagaacacatagacacaaagaggagaacaacaggcttcagggattacttgaggctggaggctgggagaagggagaggatcaaaaatctacttatcaggtactatgcttagtacctgggtgaaaaaataatctgtacaccaaacatctgagacacatgtacccctgagcccaaaataaaagttaaaaaatagaagaaaaggaaagtaaacccccaaaaaagaaatatttctcagactcttggagaagctgtcccctcacagggaatggggagaacagtctcttaagtttccccagagaagctttgtcacaagtaatctcaaatccagatctggttgaattctctgagagagaaagaaatgcaaaattaacactcaactcaggaaggttgattaagagaaggtgctaatatttgctttccttttcctcaattctgaaaatatcatacttcattttttttcttttaccgctgtttataagtatgttcactttgctatcaggtcagtttggttcgtgtgggacatttcgctaggattttatttcttttcttaataaatagtcaatatttgtcaacatatcacttttgacattctgttttttaaatacgctttgtagaaagtgagagatttctttaaatgaaatgatttcagtcgcagaacacacatttgtttttaatctctggtcccagtggtatttatctcttactaagaaagcaagctttccttttagaaagtgatctgttccctcattgttttatttataatttagagtatgggtagtctgtctgctgaaatgaaaataatgaccacagcctattaagtttctccaaatggaacaggtgatacccagggtttcaaaagtctgaaaataacaaatgatcaatgagcaaagaaatgaaggtataaggcctaaaatttgcaacataaaaataaacacatcctcaagaaatactgaaatcgatttttatttccttggctcacatttgtgctcattacacatcagacatttccatgatattcaactccctacggtttagatgtgagaatagcacatggaaacaaggacactcacacccagttgtgtttcccatccctgtttcctggctcatcactacatgatgagatgcttgagggagctgctcttcacacttaacgcccagcactcagcgtgtgcccagatagaatggaggcatggatggtagcctgctccattttaatattagattaaaatgcaagcatctcatttctttctacaaaattaaaatataagactgtcaggatccataagtgtctcttataatgaaagtggaagaattagaatccataatcttatttttgcaataaaaatatgaatcactgttcacaaatattcagcgcaatagaataccaagtgagattgtgcctgtcttagaaagaaaggcaagctctcaatctgtggataccatatggatgtcgctgagaaggagtggggacttgggcagcaaagctgccaggcgttggggagcatatggaagtggcctgtttggggccacagacggtcgggcaatgcttccttctctcttcacagttgtctaacatattgccactgtctacatgagcataacttaatagccaatttgaattctattgtagttaaacttggtgttatcctgttagtaaactagcttatattgcacaatcgagtccaaagattatttttgctttatttactacataaagcaaatactctgtaaagaactgaaaccacttttattcatagactatattggagattttcttttcttttcttttttctcttcttttcttgtcctaagacataacatagtaccttcaatgaagatgacggtggtagtgctagtatagtatacaaattagaaaaaggataattgcagagatcagaatctaagctacattttactttttttaaaaaaaaaagattgtcaggttatcatgttaaaattagcatcttctctatattaataaatcaattctgtgattaaaagtccagaaataaaataacaaataaatgtgcattttatttagctatttttagtgtgctattggatttgaagctaatttggctaagcacacgtttggatttccatcttttttggtatcacttcctaggattttagtgcagtggctcctaaaaagaatgctcaaatattacttataatcccccaagatatatcttctttgcatggaataaaatgtgaactaacttggagaaaggaacactttagacatacatttcattaatgtaaatatccacctcaaactatgtggattagcatctcttagaattgatgttacaatgctaacaagagaaaaagaaaacaaagtaccggtctacaaaaatatttgtctaatgccgaatgttagattattaaacagaaaagcacattagctaatgtgaaatgatgtttttctccaaatttattacattttccccctctgtgttaaattttctttaaaaggagatctcacaggagtggataggcaagctggatctgtgagcagctacaaatagaagcacaagacaaagtaatctataggctggcactcacattcatttactaaataaggtcgtgagcaatattaggcacatttttctgacacctttcccagttgactagaagttgagtgcatttagtaaaggaagtacacagtgaactgttgttagtatttatcaggaaacgtgatgagtggccctgaaatagagcatcttaccatccaaatttctcagtagccttaataaagaatagtcagtagccttagtgcagactagctggagtagatctaagcagtattaatgtggcagtccgcctcagcatgaaagtggagctttgcaaaaggacgagaaatggatttggatgggcaaggttgaaagtagttgtaagttgatctggcattttatatttcattaatcaatttctaaatctataattaaaagaaaactacattgagtggttgggcataaagtagagattgaatgatacccacaacaaataattgttaatattgacaggttatgctacagggattgcctaatttcacagatgagggtaacacaaaatgagacaactgctacataatgtttattctaaaggaatattatgacattactgagttttgaattttcctttgtattgactttttcataatgcatgaaataagcatacatcaacctagttaatacctgaacaagacaacatatccaagccataatttgatgtaaagcatgtgacacaaaggaaatatcatattgtaaatatcgtactgtaaactaacaactgaaaacttccatatgtctaaagtacacaaacatattctttattttaccttcacattctttcttttaaagaaagaaaagccattgcaactcagcagtgaacaaggcaaagacagtcaattgaaatcaaccctccattgcacagtaagagtatatgtgtgaagttcttgagccgagcccctaaaagtctccatgaacatcaaaccacgcctgttgggggacctcagttctctaccaaatgtcttgttaattgagctttggcaaatgtctccatgaggaccattgtcacccgtcatgctcatgagagtcacggcctacgcttccacatacttttaaaaatcttattaaagattacagagcagtcaggtgagtacacagacaattacatccagacgatgaacagaaggacagaataatgtactaactttctgctctttaatggactttacctgtgacccaaatatattccttctaaagcatttatagaactatcaaagtttagatattgtaataccaatgtgtaatccattctataatgcagaatatctttctaaaatgtgaaaaagtgccaagtattcaattcaacacagtaagtgttgaacatgaggacaaagaaaattcactggagggccttcattaaaaaatatccccactgaaaataaagcagagaccaccagagtggacagagcactcaccatggccttagaaggtggagcttccaagcggatgcacccatttctatgggctgaggaccataacctctgagcattaacttcctcttccaaagcacatggatgatatctactgcagaggcatgttgaagggattaaattggttaacgcatactgaagcagccactaaatttctctgttaaatacatgtatctcttccccttacttttgctgagaacaaaataatttctgttctttgttgcacccagtttgtactgaagggcataaccttgaatatttgaaaaggaaaactctcttcagttcaatggaagatataggacatgttaagtaagaaacagcaagctctttaaatcagtgaatagctgtattggggggaaaaatgtggttcatcccaaggcagccaaaagttgacctggtgaactgtctggttggttttatgccctatttaaacacacattaaacagatctgaagtgtcttaaaatggaaaaatgtcttcgttcaaataataagaacttaataaaattcttcattacttcactggagccttatttgacaatactaaattttttctcctaggcttacatgatagattctatcacagaatctttctctcccaccaccttttttttaaattccctttggctcttaactctaccattatgacagcaacacttaaagctgacctttttttgacagagttagcaattctcctccaggctatgtagtgattcttcaatgcttatgtgtaaattatgcaactgtctcatacttcacagaaacattttataatcctgtgtactattccatcattggtttaatgaaaacattaacacttggtttccataatatttaccatatggtaaagtcactgttttatagagtaaagggacagatagctgaggtcaatttaaataattgtcttaaaattccccatgatgaacaaattttttaaatttatcttatctaccaatagcatggaaatatcaagcttatatacacaggtggacttgcacctttaccgtatttgattatttttcataacttagaatctaggcatatatctatgtaatggagtttttacagaagcctttggacaagaacacatttgttgtaattctcggtatttaaatcaattgcgcataataaaatgactcatgaaaacattctacttaatatggtatatcttcccgtagtaaaagatgacttcctcgttcctccccctataagagttaccaatgtaagcagtcgaaatggttgagcctcttggttttgcactcctaccaagtctggtttgtaactaggaaaataagcaaacaggtcatgagggtatgaggggagggtagcataatgcagtgctcattctcttcctcttcctcaataattcagcccaaagccaccaaatggagctgagcacgtgcagtcagcgtctacctgcagtggcagagggagccactgtggtccagggaggggtgtcagggcctaagaagagtgaggaagacatctgtgtggttgggaagcactgccaatggccctgcaagtgggatcagaataccagagtgaccagaaaggcatctgcattgggatgaagaaggagtacagagcagtgggatattggttacatacaggggtagatcaaatgaataaatataaaaaggataatgggagccaagagagttacaaatatgaaaagatagagaatttgaaaatactctggggtattggattagagttgagatactggcataaactcatgattttcattatagataaaggtagctgtggaaatgagcatggttgtaactatgtgtatgtgtgtatagctatgttcactgtgagggcccgggagcagtggcaccccaaaagcagtgagcacatctggtacctggattttggtttctaagtaccattctccctaaaaaggaaccaaagctccttgagaaatggccaattccagaactaaggcaggaaaagtccaagaatgatcttggaacagagccatgtcaaaaagaaagaaaatgcttaaagagcaaaggagacatgtgcaggggacacagatgctggctcaaaagggttgcccaattgccaagtcagggaccctttgaccttcaaaataaatgatagtaaaatgggctataacccatagactacattaggaattaatgactccatattaatataaatgaataaatgaataaaagtttgatgaaaaattgtatatttaccattatttcatattatctcccaacaaaatgcacattaattataaagggaagaagagtaactttactttggaaactgataatcttttttttttttttgagacggagtctcgctcatcgcccaggctggattgcagtggcacgatctcggctcactgcaagctatgcctcccaggttcatgccattctcctgcctcagcctcccgagtagctggaactacaggcacccaccaccacgcccagctaattttttgtatttttattagacatggggtttcaccttgttagccaggatggtcttgatctcctgacctcgtgatccacccgccttggcctcccaaagtgctgggattacaggcatgagccaccatgcccaaccagaaactgacaatcttaattgaaggatcaaggttaacatggctatgaaatggacaaattaaaagcacgtggcagctgatggagcacagtgggatatatctgccagaaatgcaaaacctgactctaatcattaggaagtgtcagacaaaccccaattgagggatgttcaatttttaaaaaacaaaactgccctgtaaccttttaaaatgtccagggcatgaaagtcaaggaaaaaaaaaacaaaacaaaactgaagaactgttttagataggagaataaagagacatcacaaataatgcaacatgtgattctggattgatctttttgctattaaggatgttattgggacaactggcaatatgtgaatgagttggggataaagtggtagtaatataccggtgtttgttgcatttcagtgcttgtgttacgattatgtaggagaatgtccttgtttgtagggaatatacactgaactatttaggttctttttggtgataaatgaagtttagtatcttttcatgtgatcattgaccatttatactttttttatgaagcctctatgtatatcctttacccatttttctattgttttggttatttttttctcattgattggtattagttatttgtaaattaaggaaattaaccctttgtcagttataggtattacgaatacccccacttaaagtttacaaataaatccattgatcttttcctcaaggacagtaagggattttgcttaattctgtttttacattttaattatttgctctaactgaaatttacattggtttaaataatgagataaagatctagctgtacattttttaaaatgattagtcaattgccccaacaccatataaaaagtagcctctctttttcccacctttgaaacacaacctatatcacaatctaaattctactttattttgatctacttttggactcgattctgttcttaactatttcttctccagggccaaccaaactcttttcattaataacatgcttcggtagagtattgtccaatagaaccgtctacaatgatgaaaatattcactgtttactctgtccagtatagtagccaccatcacattgagcctggagatgtggctagtgtgactaaggacgtgaattttttattttataaatttctaattaatttaaacttaaatttcaaatagccacatgtggctagtggctaccatattggacagcagagttttattatcttactggggagtttctacccattctttccacagttttccaagatattctcacacgtttatttttccttctcataagaaatctagactttctggttttccagaaaaggtcacattgaatttacagaacactttgggtacagttgttatacttttaaagtatgacatcattaagccttcttttaagtctctcagtagagttttaaagttttctttatataaatttatacatcatcttttaaatccattcatatatatttaatctttttttaatttttattttgttttatttgtttgctgttgtaaatggtgtacttatttcaatgtcttttactatattttctcactgataattatttatatatagtgcagctatgtaggtatattttgtaatcttttgggtaattctctttatgttttcaggttgttgtaattcttctttccagtattcaaactttctagttatttctcatttaacactgttggctgccatttcaatggcagttttaagtagttgtagcaatggttaggatcctcgtcttattccacactttaataggtatgttttagcattttatcattaagcttcatgctggcttaaaaaagaaatctgtcaattcttgccttaccactgatttttaacatcagaaatgaaggttgacatttgttaacatgcctcttctcctaccttctatgtaagttatataatttacctcctctaatatattactagtatatattaatttgacccatttgtaatttttttttatctacccatgtattcaggaaataaatgccactcagtcacggcattttttttttgtgcaatgtactgctaaatttctttggtaattatgtaaagatttttgtaatattcaagataatcatctattttagaactattctatcatctttcagtgtcagtggtatgctgtcattatttaaaagaattttggaggattctttctataatagtttaaataagcttaaatagagaaatatcattccatggaaagtggaattaatttgcttctaacgccatcttggcatggcatatttttatgttaatttagcaatagctttaatagcatgcattgttatattgttctgttttctgtctcttctggagtcaatttagtagattccattctccttgactaggttgatcctgatatcattaatctaatgccaaatttagaaagaggatgttttagggaaatatgataattttatttctagttctgttgcatttaagatgctcatgggacatcgaggtagaaacagccaataaacaaatagaatatatatcttagagctatttatgagcaatctgggctggaaaggtagccacatgcatgactgtggtggttaatgagatcacccaaggacaacataaagcaatgacgagtaatggcccctggtggaaccctggaaaccccaacatttaactgggtaggaagaggaaaaggcttgagaatgacaggagagacagaaaagtcaagaataaaagatcaaaatctcccaatgcttcagaaaggacaaatagacaaatactgaagcatacccattggatttattgtttaggagatcaacagtggcctcagcaaaagcgatttccaggaagtgtttgagacaaagcctgcttttgggtggctgtaaagtgcactgaaggtcaggaaccgcagcagtaagtgtaggatgtgctcatcagaagcccggctgggaagagaaggatccatgagtcttaagtaattttagagatcatttttcaattgaacacatgaaatgtagacttttccctcttttctgtgtccagaggacgtgagaaagaaagtttttcctgtgttgtctaatagagagctggccgttgtaaagagcatctggggacagctgccttgtcatgcactttgagggatctgggacaccagggtgatgtggagatgtgaaaggagggccataaagcagtgtctgtccccagtggagccagcaccaagggcaagggctggaaaccgaggggcttgcacatcaccaaggaaaccaaggtggaggaacttagacaaaaacctggtggaggatgggcagaagacagtaatgaaaccatcgattcacaggctgctctcaagagaaaaggggaagaaaaacgaagaggaacacaaactgaaggcaggatttttaaggaaatatttacaaatgcttgaaaactataattaatgtaaagcaaggatagctgataaatagaatatctaaaatgcaaatgagagcttaatggcttagaaaaatcaagttgagtctgactacttcacccagccctcaataaacaccatccatctacccttcagcgcacccagcccccgtacacacatgcgtgtgcatacatatgcacatgtacacacaacgcagagatacaactttatcatagtgtgagatgctgtcgtatttggcaacattgctatattttcccccaatttgctgtccaatttattttaattatttatatttaggaaaccctcttccaagaacaaaaccacctattatttaaggttctgctgtctttaactagcactgcaactttacaatattcaatgtgcttgctttcaacttgcattgtctaattaaatcctccaataatccatataaaagcaatgatcgtttatacttgctgtatctacagaattacattctccatgaggaactttgaaatacccacaagcattccaccagcacgcctttgcaagtgaatcttcccaattttcattcaaaacttccgttgagtcctaataggactggggtctgggcacaagtgtgaaagactctgggatgggcagaaccaggcttggcgatagaggcttagcctgactaaatgaggcctgggaatgtaccgctccctgcagaagctaggggtgcagcccgattgttgtaggtatgatgcccaaaggctaaaacaagctcctggcaagcaccaaaggaaagctcagactcaggaaactcacccccaacgggagcccaatcccaacagagcaggtgataggcaggtctaggcatacgccagtccctggacaggaaggccagggttccaggggaggcccagtcacagatacaaagcccacgtccacgcagtctgctcaggaggggaggaggggcatccgctcacttgaaacctttgatcatgattctcaaataggcaacaatctttctacataccccgagggtaggggttcccggggtaggggtccccagcccccgggccatggactggcactggtctgtgctctgttaggaagcagctgcacagcaggaggtgagcagtgggcaggtgagcaaggcttcatttcatctctatttagggttgctctcattgctcgctttactgcctgagctccgcctcctgtcagatcagcagcagcattggattctcacaggagtgtgaactgtgttgtgaactgtgcatctcagggatccaggctgtgtgcaccttgtgagaatctaatgcctgatgatctgccactgtctcccatcaccccatcacagatgggaccatctagttgcaggaagacaagcttagggcccccactgattttacattatggtgaggtgtataattatttcattatatattacaatgtaatgattatagaaataaagtgcacaatcaatgtaatgcacttgaaccgtgaaaccctccccgacactggtccatggaaaaattgtgttgggtgagactggtccctgatgccaaaaaggctggggcccctgccctaggaaattcatatttgcactcttaggggtgttgtattcttcattctttgcgaataaattagcttcctcttctccaaaagaaaacagaaactatcacatgaagactagcacatcttcccactgaaaacttttatcaacttacctctctctgtcctcatatctcactttccctcctcgtatgatggatacagcaatctctgtgcagttatctaacacagatagatgctgaattctggctgtactgaattccatcctctgttatctacccaagaagttaatttctataattattccactttctactgcaattttcatgctagaaataaattcctttttgcccccacatccccttatgggtattgcctcttctctgcttctctcttcaacagaactccttccaagggctatgagtgctttccatggccacgtcctcaacactgaccccgtcccctctgcaacccactccagttatcttctgtctccttctctccattgaaatgcctcatgtcagggcccctggcagccttggtgttgccaaacccaaggtcctgttctttgtcctcctcttactcaaactcccagcaacactcaccccaaccatctgctctgataacagccttgtccacctgctcctccagctcctcccagctcacaggtcgctccctcatctcctgggctggctcctcctccctctgccgcaggggcagggctcgggctaccctcttctccagctgcactctctcaacatgtatatagcccagtggatctcaacaggggacagctttgccctgcaggggtcacttgacaatgtctgaagacacttttgtcacaaggtggggagatgccgcaggcattcgtgtctggaagccttggattcggccaaatatcctccaacgcacaggacagcccccactgcgcttactccgcatagaaggtccacagtgcctgttctgtccagcaaccctattctagtccatggttttaagccattttatacacagatgacagagtcacaggttgatatgcccagctctaaccacccctctaatttgtatgtccaaccgccgcctcactattcctatttgaatgtctaaataggtgatttagaattaacctctgacacagctcttcattttcctccaaagtccactctttcttggccatttccctctcagccaatgccaccagttatatagaccaaagccctaaaagtcaatctttattcttctctaatccttataagacacagcccatccagcagcaaagctcatgggctctgccctcacaacccaccttaaagctgagcatgtctcacagtatccagaatgtgtcttcccaagccttcactgtctctgggttgaacttctgcatttgtcttctagttcttctccttgcatctattcttaaagcctgaaaatctgctttctatgcaaaagagttatcttttcaaatacattaatcccatcatgccattctcttgcttaaatacctcccaatggtttctcattgagctgagagtaaaatcctcctccccactgcggcctgcagtcagcctgcctttcccacctgcctcctcctgcagctcagcctgcctttcccacctgcctcctcctgcagctcagcctgaatttcccacctgcctcctcctacagctcagcctgcctttcccacctgcctcctcctgctgcctccctccctcctaccagcatttccctaagcctcagaaacaccaaggacatttcctatttgcagcctttacagtttctgctcgctcagcccggagcatcctggccccggtctccatggggtgctcaccattgttgaggtctctgtccaaacatgcttccccaaagaggcctcccctggctgccctatggaaaggctgcacaccctcctcccatatcttaccttgctttattttgcttcacaaaacacactgctatttgaaaccaagtcatcatctactatttaatatcaatgcattagctctctttctccctagcatgtgagccccagtccaagcaaggatgccgtcttttcaccaccacctgcccagaatccagaacagagctgcacataaaaggagctcccaatacatgcagagtgacttctgtgtcttctgcgacagatagagtcaggacagagggcgggggtgggggagtgcaggaaggaaagggtgtgctccatctttttagtaattatgctcatgctcacaaagcctcgtctgtgagtttttccatacattgtctaatttatccaggggtgtgctcccagtactcaggcctcttggcagggcattctgagacaagggacagaaggactgactgctaagcgggggcaagtggggctgagatgtagatttgcacacgccctctctctctccatagtagacctgagaacaagggtacgaggcaggagtgagagccaggctctaaggcggagaagatggcacagaaaagacagcgtttgggaaaactcacagaatgccatagagtttccataatatatgataaattaaattaggtaagaaaattgcagtccagtacttaaagtcaaagaccactttttgaaacttccagatgtgtgtgatttggagataaatatttgcatatctttcctttaattatgtttttttaagagagtatgtggagaagttaaatactcatgattgcacgtaaatgttaccaaaagtatatggaatgtctaatcatcattaataatggctaaactgtattgcatatttaccaagtaccaggaaccatcctaagagcttacctggatttctttgttaaatcctcacaacatccctatgaggtaagattcattattgtccctgtcatttgggaaaggaagacctaagcttactgatgttatgcaacttgggctctgcatcactttgctgtcttgttccagcaatttcacatgagaggcaagacacagtgagaataaatcatatagttcaggagtaaaacaagctttagtgtctgcagattactattttaaaaatcctaatggaaatcaagcattttgaagacaaaatacataagaaaatactgtagtggtctgtctcagtcatctagaaagcatttcattatcttggaagtaaatggcacatgataaaataaatactctatttccccacatctggctcagcatcgcagttttcctagttatttgttcctgtattcccaaataaaacagagtccagagataggaatcttcaggaagccactgggtccttagagtctgaatctgggtgttgcgggaaggttgatgccacttctcttccgtgcgggcaaaggcagtgagaagaaggagccaagctccctgcaaactttgtacacgtgcctttgtgccttgcctacacctcactgtgactctgtgaaatagacattactctttgattaatttcaccgtgtgcagctgaaccagtgactctcagggaggtactttcatggttgcaaagcacatcttacgttgaagctggaatcctaggcttccgcctgattatcagaaaggagggtatttgcagccaagggaactatttgaaaataaccacaactttaaataaacaagcaagaaaacataggtaaatgaataatattccaaagaatgccaaagatgtgttgtgtccctgcaagtgtgctgaactgtactgaactgaccaaagcactgcagttcagtgggcttgctgaggacccaaagctcaatgtcattcgctcactgttgacagcaaggcctttgcctattaaaggacttccctgccaggcacaggtgtgtattggagagaagagctgaggatactgggtcgtgggaccttgcacagccagactgttaagggctagaagaatattttctaatccgcagctctgggatctataaaatctgctagaaggtatgagaatacagacaggctgcaccctgatcacctggcgatattcaggtgcagtgcaggagacactgaattcagcagcagctgatggaacatttttcctaaataaatcaagttgttcaggtgcgctgaccaaatgacaaaaaactgtaaagtattttgtaaacttttattatagattacagtggtaattgaaaagtcaagaaaattaacccactataaaaaagatatttgagcatgtaactatatttacaagaagcaggttggaattctcagggacagcttgtggaaatgaaggtcccccatggtccatcgcaaccaaccgtgttcctggcgatgctgtgagggtgcatgagatgggagcttgcatccaaagaaggatgtgtgaggccgaggcgggtggatcccccgaggtcaggcgttcgaaaccagcctggccaacatggtgaaaccccatctctactaaaaatacaaaaattagccaggtgtggtggcaggtgcctgtcgtcccagctacttgggagcctgaggcaggagaatcgcttgaacctggaaggcggaggttgcggtgagctgagatcgcaccactgtactgcagcctgggtgagagtgagaccttgtctcacttaaaaatatatatatgtgaacaaaagcattgcacggaaaacacttttaaacacgttcacaaataacaaggatggagtggaattaatggccatcctaaaagagctgaagcatttgcccaatctgcccaagaaagaaaaattaagagatttgaaccactaagaaataatgtagattctgcagaacccaatattgacatcagataaataaacagttataagtattaacatatataaattactgggtccaaactgcctccatcccaagtaattaagagaattgactacaacatttcaaatgttacttttgaaaaatcatgtagagttgtagtaatatcagaatgccgtagagaaagttaatgattatgtagctcaaaaaggaaaagtaaatgagactgtaatattgtgattatttaacttagtgtacagattgatcttgccttaaataattaccaattaacttctactgaaaaatgtagtaggtatgattgtgtataacatacctagggaaaaagaagtaaaacaaaagaacattgaccgggcgcgatggctcgtgcctgtaataccagtactttggggggccgaggcgggtgaatcacctgaggtcaggagttcaagaccagcttggccaatgtggtgaaaccctgtctctactaaaaatacaaaaattagccgagcatggtggcaggtgcctgtaatcccagctacttgggaggctgaggcaggagaatcccttgaacgtgggaggcagaggttgcagtaagccgagattgcgccgttgcactccagcctgggcaaaaagagtgaaactccatctcaaaaatgaaaaataaaaaataaaagaatattaaggataaactaaaatactgagaataaaaatgtgtgtgtcccattgagaaaacattttctgagtgcccactgagctccacacacaatgggaaagcagaagaaggatggaagtagtagaagcttgcattctaatgagagtgttagacgactcgactgtaatgcacaggaaaaagtaaatgctataaaagaagaagcctaaatcaagggttacaggaggatttaattttggaagagggaacaggaaagagaaagtggtcagaaaaggcttgaggtagactgctttttgctggctttagcatgtggtgggctttcgactggctgaggaccagaagaaacatgcttagggagagggagctggtccacaaacaggcagaatggcatgcattatgaagatgtgccttgctaattgaattgcttttctaaacagtggatgaaaaataaagtagaaacagagtgattctgttagtcaggttccctggaaatgggctctgagttggagattcttgcacagaaataacgcctataagagactgagaatgctatccttatcaaaattccagtggcatttttcacagaaataggaaaactatcctaacatgtatatggaaccacaaacaccctgaatagccaaagcaacgttgagcaaaaagaacaaagctgggaccaggcgtggtggctcatgcctgtaatcctagcactttaggaggccaaggtgggaagatcacctgaggtcaggagttcaagaccagcctggccaatatggcacaaccccatctctactaaaaatacaaaaattagccaggcacagtgacaggcacctgtaatcccagctactcaggaggctaaggcaggagaataacttgaacctgggatatggagcttgtggtgagccaagatcatgccactgcactgtagcctgggcaacagagtgagactccatctcaaaaaaaaaaaaaaaaaaaaaaaaaagaacaaagctggagtcaccacactgcctgatttccaaatacactacaaagatataataatcaaaacagcatggtgctggcataaaaacagacatgtagaccaaatagaacagaatagagaggccaaaaataaatccacacatttatattcagctgatctgcaacaaagctgccaagaacataacacagggaagggacagtctcttcaataaatggtattgagaaaactggatatccacatgcagaaaaatgaaactgggccttatctcacaacatacaaaagtcaactcagaatggattgaagatttaaatataagagttggaactgtaaaactgctagaagaaaacataggggaaaactacgtgacattggcctaggtagttttgttgttgttgttgttgtttttgatataacccaaaaggcacaggcaacaaaagcaaaactagataaatgggattatatcaaactaaaaagcttctgtacagcaaaggaaataatcaatagagtgaagagataacctacggaatggaagaaaatatttgcaaaccaaaaatcctatgagttaatatacaaaatatataaggaactcaaacaatttgatagcaagaaaacaaataacccaatttaaaaatgggcaaaggatctgaatagacatttctcaaaagaagacatacagatggcaaacaggtacatgaaaaaatggtcagcatcagtaatcatcaaggagatgcaaattaaaaccatgatgagatatctcttcacacctattagaatggctaatatcaaaatgacaaaagatagcaagtgatgtggtttggctgtgtccccacccaaatctcatcttgaattttaatctccataatccccacatgtctagggagagacctggtgggaggtgattggatcacaggggtggttaccctcatgcagttctcatgatagtgagtgagttctcacgagatctgatggctttataaggggctcttcctccttagctcctcactccctctctctcacctgccaccatgtaaggtgtatctcttccacttctgccatgactgtaagtttcctgaggcctccccagccatgcagaactgtgagtactttatacattacccagtctcaggtagtatctttatagcagtgtgagaatgaactaatatagcaagtgtttgtaaggatgtggaaaaagaggacccttacgcactgttagtgggagtgtaaattagtacagccattatggaaaacagtatggaggttcctcaaaacgttaaaaatagagatactgtgtaatccagcaatcccacttctgggtatatagatgcaaaggaaattaaatcagtatgttgaagagatactgcactttcattttcattgcagcattattcacagtagccaagacatggaatcaacctaagtgtccatcagtcgacgaatggataaagaaaatgtggtacatatacacaatggaatactattcagcctttaaaaagaaggaaattggctgtgcacagtggctcatgcctgtaatcctagcactttgagaggctgaggcaggaggatcacttgagtgcaggagtttcagaccagcctgggcaacacagcaagaccctgtctctaccaaaaaaacaaaataaaaagaaggaaatcctctcattttcgacaacatgaataaacctggaggacattatgctaagtgaaatataccagtcacataaagacaaaaactgcgtgatctcactcatatgtggaatctaaagtcaaattcatagaagcagagagtagaacggtgtttagcaggagcctggggaaggaaagcggattgggagatgttggttaaaaggcacaaagttttgatgagacaggatgaatgagttctggagatccactgcagtctggtgacgctggttaataataatgtatatttgaaaattgctaagggagtaggtcttaaatgttctcaccacaaaaacatgagaagcatgtgaggtgatggatatgctaataagcttgatgtaatcatcccacagggtatggcgtacatgtgttgaaacatcacattgcggactgtaaatgtatatagtttttatttgtcagttaggccttaataacgctggaggtgggaagaaagaggaagaaacggctgggcaggagaggttagactgcctggaggaggtcccaggcaatctccacttgaggccaaggggctggggctctgtgcctatacattagccagcccatgcaggctgctggaggaaggggtaaccttgagtgaagcagctcctgtctgaggcagagggcaattcccagggtgagacccagccatcggtggctcacatcccagtgcctggggagaacctgttctctaggagggttggggcagtactcagcagcagcctccaccgtgacccatgatgtagtaaaggataaactccaaaaatgtttgaaagtgtttgcatcattgatgtctattttaattaaaagagccaatgggattaaaaatcatggtaaactgatcctttgtagttcataagtgtgatgagtaggatttcacactcatgtgtgagatatgcctccctcaaaccttataaatgatgatggtacgttaaaaaaaataatggtaaaccacataagattccacgggaatttttgtggcatgtaaaaacatgacttcctgcttgtattaggccattcttgcattgctataaggaaatacctgaggctgggtaatttttaagagatttaattgactcccagttctgcaggctgtacaggaagcattgtgctgccatctgcttcccaggaggcctcgggaagcttctactcacgatagagggcgaagtaggagcacgcacatcacaagatgaaagcaggaacaagagggaggtgggaggtaaggtgccacgtacttaacaaccagacctcaccagtactcactcactagggcagggatggcacccagccatgaggcatccaccccatgaccaaagcacacctcccaccaggcctcgcctccaacactggggattccatttcaacacaacatttgagcgcgatcagatattcaaactatagcactgctgttctaatgagttagaagttgaagatgcaccaatatatgtaacggaaagataacgagaggactgtaagccattcccatgggtgtgccgtccttcatgaaggagcagagccagcagcctacccatcgttacaggacttgcactgagccaggtcagcaggagcagaaacagctttatactgatggggactacaaagctttaacacccaggtccagcaaacattcacccttacacccagaccctcatacacgtttgcaagactggacaagataggtctgcctgttccattgagacgaactgccctccctgtggcgagaatgaaacccacaacttgggtgttattagcacagcctctcatcaaattgacaccaccagccataggttatgataataagaaaataaggcaaatgcagctaagctgatatgtccaagtcgaaaaaactaatttcagcttagaaaaacagcacactaatgaagcttttaaaaattaacttgtgattaaagatcatacagacaggcagtgttggtgaaaaaccacaatgaacatcaaaacaagcatgagttcagagtctggaaatgtatccagaaggttattgtttttaaatatacagagaagacacatatatttgtttcctgtttaagatatatatgtatattagaaaacaagaaaattatttttttttcaatctaccactaatcagtgtgacaaaaatccatgaccctccaggaatttgaccagctctccaggcaatggattcttcaaatgagagcaagttgaagtacttgtggtatcagaagatgtagtcagagtccctgagcccagagggtgttcttaatctacgcctgaaaatgattgaaatggacatcagtggaggcagataagctttggaaatctttaagcaggcaaaaaaaaaaaaaaaaaaaaaaaaaaatggaataagtaaacctagaagagtacctggcacacagcggaggctcaacatgtgctggattaattcattaattcattcaaaattatgctggcggtcagtttatgacaaatagattaagatagtgcacgggtgcacggccattagagtatgattagtaaaccaactttataccaaagaattcctttttatggaaaaagtacagtcacttttttaaaactttcggcaatactgcagaagtaaaggaacgatggtgaacgatcatgattatttttgtaacatttcccaaagtaaaaatttcagctgaaaataaaaagaaacctttataaattggaataaatgcagactggagtgattctctagcacagtgaccaacatttggacacatcacataagtcttaaaggtcgcagaatgagtctagttatatatgtttttccattccagacagcttgaaatttactgtctaattcaaaagtccaaaactataaaactcctgaaaataatctttccaaatgaccagtttactttctccctggacctgaaaataggatggaagggaagtctaattctgagaaagtagaatctccttctgatgttttgtttataaaaatagtaaacattttactgaaccagaaagggctaaatttcatatctcaatttaaaagtatttgcaggccaggcatagtggctcatacctgtagtcccaatgctctgggaggctgaggcaagaggatcacttgagtccaggagttcaagaccagcctagtcaacatagtgagacccccgtctctacagaaaagtaaccaggggagaggtggtgcacacctatggcactcagggggctggggcaggaggatcactttgagcccaggagttagaggctgcagtgagcaataatcgtgccacagcactccagcctgggtgacagagtgagacctctgccttctgcctctaaaaaagacaaaaccaccaccaccaccacaacaaaaaatccagtatttgtgatccctttcaaagcactgattcttctgcttctcagagcactcagattgcatctgatctttgcttgccagaatcatcattttatggtttagcaaggagttgtctgcaggctttgctccagtaatggttccaaagacattcagccacagcttgaataacctgcacctgagcacaaatgtggcattcgtagtcaagcaccatcgttccccttcagttagttagtctcgtgacttttttaagtagtaattccacacctgtcaaatgctgttggaagagacccttgaatagttctaggagaaccctcctctgggaagaaatttgggacagaagaatttttcttaagaaggaagaaaagatggatgaggaaagcgctgacttcctctcatgaggaccaacaggctccacaattcctttagcggcagttgtcagcaagatgcccagaactgtctccaggcgacagcagaggtcaatttcaggtccacagagtcccactaacctcctataatttagaacctaattcaattgtaacctgatggtgaaattattcaacagtttgcttctgggcattgaaataaataataaaaaacagcaaatttaatactgccattgttgacattctctacagtggcatcagaaacgcctcaaagtcctatttacttccaagtggccatcttcatagtacattgtcctttgtgaaagctctttgcaaagagaatgtacgtctatatatgtaacatttgcaccatgcattacagtttttaaagagcttagcaaatatgaatcttctttactacacagcactcctttaagataaagcattcaataaccaatttttaatctcttcattgtagcacaggtaactgtgtccttatgttaggaaattatgccccttagaataccagttattccaatttatcagcctaaaatgtatatggagtacttactgtaagtctacatgcatagaattttttagtgtaataaaatattcactatttaatggacaaaacatccgaaagagatcctactttctcagaattagacttccctttcctcctcctattttaagttccagggagaaaataaactagttatctggaaagcttatacttagtggagttttatagtttcgacttttgaatagacattaaatttcatgccatctagaatggaaaaacatatataactagactcattccacggcctttaagacttatttgacgtgtccaaatgtgtccaactatgtgtctatatgtctgtttattgctgatggaaacagcaacagtaattcaccttcaaaatccctaaaacgtggttgaataaacaaatgaagaacgcaggatggtgtgtaatgccgaactgctgtaggtgcagagttagggagggaaaaacccggaaggttatcagagcctccaacattcagaaaagacttcctggaggagagaggccttcaattaggcctcgaaggacagtatttggagagagaggaggaggtaggtaaggtgtccctgccagtaattacagcctcgtgaaagaagcctgcgggacagaaatgaatatggtattgagatggcagaggagagaggtcaagggtgccacaatcttcaggcacaactaagaagatccctgcaaaggcaacggctcctctgggccagcagagaaagtggagaccccaaacaggggctctcaagataggatggggctgcggctgggagcggcaccacctttgggaggctggcaaggtgggcaggcccacgggggagccgtggcttgctggctggggtttctcctgccagcagcactggcgtcctccaaaattgcttcctgcggcttttctatttctcttaacttcatccactgtcttttcttatgtcctgtgacccactcactgccatgccactgaaaatgctgttagaacaagaaaacagtagtctgtgtcatgttaatcacatcctgctcgaacatggccagagttccctgcccataccctttataaagcagtggacagtccccagatgggcttgctggaagtctgcaccggcgctgcatgcaggagagccccgggctgctctgaccacagtgacatgccgggttgtcacaccctgcacggatgcagacaattccatacagatggatcagcaactttgcaggtcttcacaactatgagcccagatccgctgagccaggatgcctcagcaaaaggtgacttcacatagggtggcttgaaaaggcaagcaatcctggctgactgcatgccttccccaggaccagcacccaccaggtgactccttttaccctcaacaaactccatctgccagtcagagccccttatccatgagcttgcatagtttcagaatcactctcaacaagcagagatccatttgcctctctgaggtgggaccatacaggtgcaagagcctctccagaccactggctgcaggttggccatgataaacagcctcacccaagaatgctgagcacgcagttactgtaggtaaacaagtcccggcttcactctcagctggagctggcactacgttggtatttatgtaatgctgcattggcagatatttcatctgcagtatatgttgaaatggacagataattatttagaacaaataaaataagctacttctgaagatgacttgaagtgggcactgacttgctgggactctcaggccagcctctaccacccaaggcagctctctacagaacacaaaggtccagcctagaagggagtggctgaggtgagtgcctcaggacaagccaacacagtgatgttcattccaggaatatttatgatgaagagaacccaggagagctgaagattagcgtcacactcttataatagagaagagttcacctgcaccaggtgccgtgtcccgctggggcctggctactccagaggctcctccgctgctgcaatgtgcccgagccccaacctgcaagtcctcctggtagagtagctcttagctccagcctgcgtgtcagaccaacgcccacactttgtccacttcttactttgtttagtaagaagggaagggaaaaggaagaaaaagaggaaaggaggaacaaaggaagaggagaaggaagaaggcagtgcagtaagggaagggaaaggtgggaaggtgtggaaataagaagcagagatgagaaggggcagaggaaggtggctctgtggtcctggccttgttcatggcaaaacacacttatactttgagggtgttccgcttccctaaggcacaccggggaaggtcaacaggttcctgtggaccagcgagaagaggagccctgttcaggaacagcaggcaataggaagagacaaaagtgattgattccctgaggtgccagagcaggaagaacagtccaggcatggcctgagagcagagcaaggtaaagagcacgcctcacctaccccccagctcacgctcccaggaggaggccctggccctgcacagccagcccctccacccctcctccaggagcctccacccccgaaaccagccctcagccctctcccaactctgctcctccagctgaaatactgcccctcacaccagggccgcatccctctgggactacagctggagtggccctgccagtgtagcaaagggcatctctggggaggagatggtctcagcaacttcaaacacattttctgttaagttttctcttgtattgtgatgttacagaacacgctcagcaggaatttgtcccccaagaagtattctttgctgcaatccatcttcaattcacaatgggaataacctgctcactatcctttgtatttttctcacctactttcatgttttctacatctctgttaggagatttaaattatttagggacaaagctgaaggtgtgtgaatggatggatgaagagatggctgaactgattgatgaacaaaaagttcacctgccagtaaaaacagaggaatggagtagaatgcaggaggccggaggctgcaggggcattttacagttgacctagatggtaatttggagagagagggagagaaatgacaccagccttgaacttgagagatgccattttctaaattaccctgtgtggctaaatgacttttgcatgctagcccaaagaaataactgccatgcatttcactgtgtgagaaaacatattatgagttcaagaaaataagaggaaacattttaacatcaagatgggaagggataaagacagtccaagaggccgtggagggggcaggatacagctgtccacatgagaaatggcagtgacttctttgtgttaggggcagaggagatggagaaaatggaaatatttgaaaaatattgaagacatataaaggacaggtcttaataacacagaattgtgagtgaggaagtaggatgagtaaaagataacttctggatttctgttctgaaaacaaaattctggaaggggaaatggaatgaggagcacgtttgtagggaaggagggaaattgtaagttgcactgtccttcattgttaagatttcaccaaatgagagacattcaaatagaaatattccctaaataataagacattttgtcttggggctcaataagaaatgcctggtgggaagtaatagattttattcagccatttaagagtgttcaggtcttgggggataactatcatcattaaaggaagagtactcttgtcattaatgatggagatggtccatagaaagtgacacagagcagggacagaagatgatctagggtgcagttctgagtctcaccctctgctatagtttgggtatggtttggatatagcttgtttggcgctgccaagtctcatgttgaaatttgatctgcaatgtttgaagtgaggcctggtgggagggtcatggggggtgcagatccctcaggaatggcttggtgccattctcaggggagtgacttctcatgggagtgggtgagttctcactcttagttcctgcagaaactggttgttgaaaagaacctggcagctcctcctctcttgcttcctctctggccatgtgatctctgcacacaccagctccccttcgtcttccacaataaatggaagcttcctgaagccctcaccagaagcagatgctggtgccatgtttcttgtatggcctgcagagccatgagccaagataaacctcttttccttaaaaattatccagcctcggcattcctttatagcagccccaacagactaaaacacctacatttaagggacagacggctcccaaaggagaccaagcagatgtagccacagatgcaggtcaaaaaccacaggagtttacttctatgggcaccaaaagaagaatgtgtttaaacaaagagagcagagtcaaaaatttctcttggaggcaaagtaaaataaaggctgaaaaatgtccattgaactgagcaacaatgctgtcttgggtaaagcagttttcatatagaggtaaaacagaagccagattataatgggtaaaaaaataaatgagagttgaggaagagagcaagtacaggcaactctttttaaaaagttgattttgacgaaggaaagtggggccaaatgttggtaacgttttgggttagacagagacttgctagttttaagacgaaaagacacgactatgtttaaatgaagaaagatatgagctccatgaaactgaaggtacaaaaaagaaaggctataatctattgtacaagggccctgaggaggtgggaagacatagcggaagaatttgcctgaaatgagaaggggctcacctcttccatcgtaagccggctgaatgggagttgtgggcatgactcgagcagttcagacgcaccacatttcctgctgctctctaatatccccaaacctgtcatatttccccttttgcatgtgacagtctaatgataatcctgaagcatatacagatatatttcttctccattgataaagcatcatataatcttctggagacacaggctccattaaaataatttctcaatttccccattgtacgtaactgccttccatgaagcttgccactaaaatgtcacttgactgagaggaggtggtgttggtgactagaaaatgtatgtcttgagagcatggtgttcttttacttgtggaatatgaaatatctgcttccaaattcctcaaggtccttctccttggagaaggggttttcctcttgccagatcatgccattcatcccctgtgttaatgtctatagactagcaaggaaatgtgcctaaattcaacagcttgccagcacctaagagaaattatcagaaatattgtccacttcctcttatacatttctctctggaaaattttttcaatttcacaaggttttatcatctatattatagggatttgtttttaattcttcacaatttccttacactcctccaaaggaatctttaacaagtacagttctctttttcaattctgcccttggtgagtcaatttatagtgtggtttgatattttattattgtcaaatattgcttataagagagaggctttggtttggtaacaactaaacactaaaaaagaaaggaaaaaagttgttttttttgtttgtttttgtttttttaaagagaggctttgggaaaactggcaaactttctgctcttccaaaggttacttgttatatgactgatctccaagcatttatttatctgaaaaaatctgtttgtgattctgcctatgtcagggcagcaatggctacaagatactttgaaagatggtgggatatgccacacagggtatggcataccctgtatgaacctcagggtaaatcatgttaaatagaactgttctcctcccatctgccaaagcacatttatttttcttcaaaccaaaatgtagtttgacctccaggtaggtttcctaaacaaccctgcccttctccattcctcctagtgccaccttgagctggccttcttctgaatactctttcatttattggtaattgtgactcacttatgtatacttatgctttgctagcttctttccccctttggaaattaatctcagcagaaactgagttgaatctcttctacgtattcctaagcatagctgtcctttgagcactccataaatatttgtctactgactggttgaagatttagtctcacacaagtgcagatgaacttcatctcattttagaactctgatgggaaatatgactgtgttacacaagattccgggtcttttcctaccctcgggtgaataaagagccataatcaattacaaatgtctgctatgggactgaaaagatggcaagaagaggtggagactgtgccgctgtaccaagagtttgccacttcgttttagtggggcattgaatggttgattgtattagtccgttttcacactgctataaagaactacctgagactgggtaatttataaagaaaaaaggtttaattgactcatagttctgcaggctgtacaggaggcatggctggggaggcctcaggaaacttacaatcatggcaaaagctgaaggagaagccagctcatcttacatggcttgagcaggagggagagagcaaagggggaagtgctacacacttttacaacaaccagacctcatgagaactcactatcatgagaacagcaaggggaaagttccgcccccatgatccaatcaccttccactaggcccctttcccaacattggggattacaattcaacacgagatttgactggggacacagagccaaactatatcattgatggtttgatacaggcttttgagatacgtaatgtgtagatatttcctttaattacttagcatgatgaatttcatcaaacctaaatatatatcagtggtttgattggctagttggtgggtggggtttttttggcagggggtgggtttaccctccatttctttagtctgacagtataacttttggtcacgtgattgttccataaaatatattgggattgcatacatcctaatttgcagtaattttattttcttgatagacacagtcttctgtaaatggatttttatcttagcaagtattttttatatacatattttctaccaacatagctaatttgactagatgttattaaatagggagaaaatctagctctagttcatgttttctcttgcttaaggaaaacaaaaatgctcaacttttgttgaaaatgaatgtaaggccaacggtaacattattcaaaatataataatgtcctttttaagataaagtaaattggagttgtctctttgtcaccccagttactgtctctaaggccacatttctgttctcataagataggttatatgaaaagaaattgaagcaccataaattacattagtgtaaggtcacaaattaatcactttataacctattttctcttgaaaactctttctttatagaagttctaccagaaaatggctcacactattgaacttaataggttattactacatgttttgctcagtattctaagccaagtcatcaggaaaagattatagttaccagttcccattgtcctgtttgacatcaatgaaaagatgctttacttatattttcatgtgttatttatcctgtcagaagatatatccattttatatgcagctaaagttcctggggcttttcattaatcaactaaacacaggatgtgcttgaaggaagagctgtggaagggagtattgccccactgtggaagggagtgttgccaaacccttttagtaaaactgaaattatattttcttggttaactgaaaaagaaaatgttaatgatggtgtggactagcatcagaattaattttactctacaattgaatttatggtcaaagtgtcatattcctattatttaagaatgttttgtattatatcttaaataaaatttattagctgaataaatatttatatgcatgatataatggaataaaagagggagcaatggagactttatttcaataagtgagttttatatacaacagtaaataattaaatccaattgattccagaactcataaggcacttcttttataaggataagtgcagtattggtgttagattgagtctataacttataacagtatcatacttgggaggaagaatttgaatagaagggcagaacagaatttgaatctagttcaaatgagagaaaatctttgtaaagtgctggcataatgaaggaagaagtgatttgacattggcatagattctctctgctgtcaaagatctgaagaagtcgtttcatcccactgccccacatggggcattttagccagttgactgctggtggtctcagacaaagaaggaacacgttcaacaccaccatcaaggactttcgtagtcttgattcttagactttgaataactcttctttgagttctattaacattcatctttatttttctcagtattgtagaatagaatgtttagacttcccagaatatttttttctcatgtaaaaggctcaaaaaaatggtgtctcttctgtatttctatcagtcactctttcttctttgtccttcatacttgagttaatccatctcatgcttcaacctcacttttggcgtgtaatcacccatgttgttttgctatctctgatgatggaagtgagtttggtggaagcaaagatggcatttgtctgtgtctatatccccaactactgacctagtggtcagcacttagcatgtggtaaaagcttgtgaaagaagcgtttcaaagtttagttccaaatcccatcacctcgataaattactgaacaaggcacttattctttttgaatatttttctcatttataaaatgaggctaatgatatcttctctctgggttttcatgacaagcaaaataatgattgagagatttgtaccatgtaagatatgattatttttctaaccttcaactggaggaaattctgtcaacacacggttttaagtttccaagtagtatatttctgtgcattctgttggcattcaatacttactgcccactgaaatgagtcttcttcttttatcataatattcttaagatgcttgcctggcgtcttggtttcaaggaccacctctataagagactccacaatctacacttcaacacttgatcatttacctctgcccagaatcatgtctgtaagaattagctccatcagaatttcgtccaggagtccctaggtggacaccttgctgcttctccctgctacaactcaatctctccaagtgcaacccctgtccttcttaacatcacctgatggtgtgggcacagctggctgttcattgcccctcctgctcccacggctgccccaacccctacacacacccacaccccccacccctacacacacacgcacactcccacatacacacacacgcacactcccacatacacacacactcacactcccacatgcacacacactcacacctccacccccacacacacacacactcacacattcacactcccactcccacccctacttctacacacactcacatacacacacactctcacactcccaccccgacatacacacactctgacacacactcacactgtcacacgctcatacttccatccataacacactcacactcccaccccccccacacactcacactcccatcgtcacatacacatacacacacactcacacccccatgcccacatacacatacacacaccctcacccctacttctacagacacatacacacacactcacacctccacccccccacacacactcacacacacaactgacgctggctcgcgcacatgctattcccagagctctgcttccgagacggtggtggctccccggggccgcacctgtgcctccgccgggcctgtggggtgagtgggatgctaacgcctggccttggagagagatgtctgggaggaggagggggggacgtgcaagggacgattggggggtgcattaagaaagaaacccatggaatatgaaagctgtgacggggacagaaaatttaagaaaaagcagaaattttgtttaaagatttagggaaagtgtggctgtttaagagacaagctctgtactcccgtcctcgtgaagacttccataaaatctatactatttaaagctgcttttggtgttgagtgttggagtctgtgagtacagggtgaggtcacggggtccaatggtcgccttgcctgacgccctgtggggtgactcccacctccttggtcccctcctcctcaaccacctggctgggagagggctcgtaccctcctgctttgggctgcgttctcactttcacccagacctcacgctcctaaacacctccttggatttgggcacatacgcggtggggcctcttcagctgtagagtcattaaccctaaactccttgttcatggaatcaacagccgactgtgccgtcctcaccctcggggcgctgccctgtggagggaacgtggtccattccggagcgcagctctgcccatgtttgcccggtgacctcgaccagtatcccccctcaagtaaacgagggctgcatcaggcttccctcctcgcccgtagcaaggggcttgcccttttgcttctgcaccataaaagcactcatgttccagaaagacttctcataacatctgcttgaaattttactccccaaaatcggacttttcttactaatttctaattcttctcaaaaggcaactcaagtctatgtgacatatttatctgccaatctttctccaattcttaatgtaaattatacagaaaattggtatttgatatttttcggcatgtttcctagtgaaagataagattttatataccatgtaaatttcattacctgagagaggggaagaaaaaaggtgaaaggtactgctgaacctgtacactgcaacagtttaatttaaatttatgatatgctgtcattggggaaaaaatcagtaaaatatctgaatgttcacttaacatattttcaacaaaatctcatttttttctcctcaagtctttatttgatttacacaccaagaaaagcagaaaggatggcaggttcaattacaaagctaagtcttgaactttatgttcatttcgcttttaacaggtgtgtgtatgtaatacgcagcccttccgtgatcatctgacctggccctcttgggagatgtggcccaggctccaggagccctcataccctgcactgtttttacacgatacatgcctggggaccagggttttggaaaaaggacctggagggctgagctggcagctgaaaaggcagggtaccaggagccacccctcaatgggctagggctagggacagagctgggagccactctacagtttggtctgggtagatgtggggggtgatctgagttgaggtacatgtttatagcttttgaatggagaaggtaggaggttgatttctggcaaccagttgagaaccatgaagcgggtgtgtagaaggcaaaaggggaaaaccaggtgaatgagaggccatggtaaacccaaagggggggcacgggctggggatggaacagatgaatccattctaatgccaagtccagcccccgtctggcattcctgacattcatacccatttgtgagtaaatctggcagaaaagaaagtgaagggggagacgtgagggtgggctcagactcaaaaacagtcatgtcactgcctaattgcttttatccaagttaaaacaatttttttaaaccaatgatgttagctgaggcaaagctctttaaaagaaaaaaagatttttttaaacttattgagctataatttgttactgttttcatccatgcaacaaaaaacttgggatcaaacattagaaaattaaattaggttcatgcacaaccaaagatcttttctcttgccctatggacctactgagtcgaaattccattttccgtctcctcacagcatttcagagaaatgattatcatctgatgaattgcactaaaagcaaatcactaacagatagatcagcaccattcttctattaattaatgccactgtgtgttgtgtatgtaacaaatgcaaattatcgcatagggcaacattgattttcttttccatgcattcctcagtacaattcaaatgtgttttggaaactgccctggactgggagattgcaatcattgtagcattttcctcttgatttataaggctcaattatctttctttggttgtatgaaatgtcttttctaataaaagagccaaaaagtgagagacagcatttctagcaccaggcacagaagggtgatgggataatatcaaatttcctatggtttagcaaacattgacaaataggggaaattaggattgctcatccaatatgttttggcctcaaaggattcagctaataaagtaactagaaaaattaaatatgtgtaagccacagcacctttagaatacttcacagattaccgagttgtgtcatttatggcaatgaatgtttccaggctgcaagcaaaaaatttatttttcactttacttgaaaagaagatgatgcctccaaatatcacagggaattgtttcttttgtgtccaaatgagttgagatctaaaccaacatttaaatgggcttcaatcatgaattgcaaaatgcagttgaaatgaatattgttttgctgatagtttagtctgaaagcaattgtctttttccctacagatacagtgcctccttcattaagtgacttttagttattttttcataacaggccattatttgtttgaacaaataaattaacctggggagaccaaccatgacccgcattggacttttctgcctgtaagcaaggcgtggtccaggagtcataggttacgtgatgtatcactggctggtgccactgattccactctgagtactgaagctgtgggcctgctattaaacaaatgtcccgaacacccaagtctccctgggcccccagctggctgttgctgacagtgccacacagtcactgtgaggacagaagttccacggggaaaggggaggggcatgtgcctggcaccaagttatgccttcagtagaaatgtgtccagcgtgtgaatgttcacgtacactctgtgtttgtgttgcccagtggtacccaagcgtatgcctgcacccccaacaagcttcttggggttttcattaaggacatttccaagctcccaagtcacttcctgtgtgtgtcagaagtggctcttttcatttccaagactgtgtagctggttggcatctacttgtacctacacgcccacacacacagcaggagccgcgggatggtggaccacccctcagctcctcctctctgggtcctcagtcaccacctaacccaccccagtggtctcctccaggttctggtcctgtctgtccatccgctgaaaaactgaagatgcttagagtctaaaaaacttgagtgaaaccctgaaacactaacctgatggaaatttattatctaatttagaagagaagcaagtgtcttaattgtctccttgttttaaccaacagaagagatttcacctgggtctccaaggcccagctgctgagacttagtaactgaggctaagaagctatctcaccctggttaaataaacagggtccgtgattgatggtgtctgtacaaaaacgaaatgtagtcaaacagagtaagcagagactgagcaagcatttactaacatgtgggcatctgacaaagcattcttacatttgtagtctttaatttgacacagagattttgtctgtaatgtctttggccacttttgtgtgttcattcagtgattcacaaagacgaataatttcagtgccatgtgtgattgtatttcaaacaaaactgagtgtcctaatctggaatatagtctccatttcattttgtaggacaagatagagcagtttgtttcataccattcatttaaatcattttttttcctaaaagaaaagctttcttaagtctctttcttaattccttcatttgcattcagtttgggtggagctgattgatgacgtgtttccgtgtgagcttcatcgaggatctgtgcttgaatcatctagtattttctgtaaggtcgggccaaggagacctaacgtgtgctaaactttacaagcacattttagacactgaaaatacactgccgtgccttgcaattgcacaaatcatttaagagcccctctgtcatgggaataagctgcctccctttgtcatgcactgtgttctgtattttcgaaaggaaggcccagcactgaccatatttcctcctacaaggccccagcccatcagcacaagagctcgtgaggctgaactcaagccccggagatcaaaagtcccatactgtggaagctttaagtatctcattcaggattccatgaaacattgcttcatttctcaatacgtctgtcctccgaaggcaccaactcattcagttgctaaactaattcttcattttcatgtaatcttttgggagaataaaagtgagcagtactaaaatgaaagtgttttttaaacaataatggtgccagaacatgagatttttaaccttggcaaacaaagtattttagccactaaaaaattgcagagctgtaagaaattgctgaaaacttcaatagagaaaaattaattccccgttatgcttctctttttagtaacccatcgacaaagaagtgaattgtcctccatgttagcgaagtggggaggtccagacttgctccttgtctttctaccattttctaccatcattgtatgtaaaagtctaatcttcattttaagtcagtttatgcttcccagactaaactctgcaacaaataatatgaatgtcacacatttcatcatttgtaattaattccaaactaaataaaacaaggagttgtgaaagttgtttttcccctaggatgttctacgtacatttagtaatagtttattatggctttatcttttaaagtctactttcgcggcactttttaacttaattctgttaaactactcttggaaactatcgattctataaactatgccattttcagagacataaaattttgtgcctgaattataattatagcctaaagccaaatataatttagcacattatcagactgggggtatttttaatactaatcagggaggaccctcactaaatatggctttgttcattcaaaaatcgcacagagccggcgtctccgtgacaggtttggagagccgcacgttaatatggttagttctaagtcagccattaaggaaacagaatggatcacggggttcatagagatggagcctcagtcctcttctcctatttatctgcattcattcccttggccatctcaaattcagcctcacagttttcaacaccgtctctgcactgatggttccctcatttgacacccctctccccaccacacactctgagcttctaactcctgtgtccgacttcctaatcagccgctgtgcttggatgtccagtaggccttttaaactgaaggcgctcaagacaactcttgactcggtctccgggcattttctgcccctactcaggtctttggccacctaactacatgggaccactatctatgatttaccaagaaccgtaaagttatcttgaagtcctcattccttcacctttacctcctacctccaaattctgcagcagcaaagcactgctctactccatggtcttcatgaatctgctcacccctcagcgcctccacctctgcctcttgcctggattgctgcaacggcttctaaaaagtccctctgcttccgggacagcccatcgtccactcagtagccagaatggtctttctcaaagttcaatgagattttgtcactcccttgcttaacatcctccaatgatattccatgacgcttagaatcaatgtcagtgcccttacctttgcatataagaggtaacatcacctcaccctatgtatctccctgaccccatctcatctctttcttgtttgatattctccagttgcatcagaagtcttgctgctcttccagcacaccaagattgatgctgcctcagggcctttgcaccagctccttcttctgcctggacactctcgccctggttctgcgcatggctcctttctcctttttgtttggattgctgctcaaattgtgcctccacatggaggctttctaagtgatccagacctacaggctcaggcacactctatcccctcactctgttttcttcttcataatatttacaaccatctgaaatatgtaatgtttacatagccgtttgcttaatacctgtaagattccaccaactagagaggcagcatgtgagaacaggggctctgtctcactccgtgtcagctgcctcttgcccagagggtgctcagtaagcatttctgatgattatgtgacgttagaagccatcacttacatacaaattttctcattccttgttcaacatttacacatatttattttttcacaaaggatttgaaacagctttaggcaaaaacaaatacaatgaaagtcaaaaatagaaaacctagcaccaaggaaaaaaatacaggagaaaagaaaaacccaaagcaaggtggccagttacaacattatcatgagaaagtaggaaagcacagagtatactgtgctttaacagaataagacttttcctaagataaaattctaagtgaaggtcacacagtacagggcaatgtcctcagcagtatttgtaaagcaaatgcagtgggccttttcaaatggctgtttctttgatcatggccaagggcccaaaagaaaatgcagtataatgaagggggatcattaaggggctgagttcatacgctccaagaatagagtgctctggtatccttacttgaaccaagaaatgacttccattctagaaggtttacctaataacataaccagcattttttattgctaagaattaaagggagtttcataattcaatgaaaataaagcattaaagaaatgctagtgtaaatatgtgtccactcatattgctctagctagaaaccctcaatctgccacaggcctgccacagccctggaggagcgctccttatgctccttctgtgaatgttctcccatatgtttcctactcccttagaaaaataggtattattattattaaaagcattaagagatattaagaattgcaatgtgctttatattatgtagtttatcttctaaaaaattaaaatgcaaaattgtcatcatgatggatcttctgtcacatatagattgtgaagttcaggagttggtattgagcagaacctgcttctaacaatattgagcattcctttgaccacagtttgatgaggtcccaggagcacgctctatttttaaaagcattacttaaaaagcactcctggaaagtcttcagtgagcctcaggtcaaagctgcagtcatttctattaggacccccctccataacaaacaatctttaacagacaccaagaagcctgctgttaacacaacctcctacttcaccgtctacctgccactgtcccatctcatcagtaaacaagcagctatttgtctctttccgttaaaagcacctacccccaacttcaatcagattaagaaaaattcttttctactttttccctgtgaagttggtttttattctatgtattaaaaccagggtcctttgaaagatacacttctgtaacattggcacggtagagacacaactgcatgttgacgaagtatataacctctccttccagcaacaccacagacttccaggtaaagccaaagactcgttttcctatgctgcaaagccatctccaagaaaatgctacctccatgccccactgaatggcaacaagggtcatcaatattttgcaaagggcaaatagagaatggcaagaaagagacacacagtgccaggcggagaggttgttgaatgttgcatgggtggggtgaggagcctgtcacaatcatgtgccccgcaagaaagattcccttctttgtttcattcagctgtcgctgagaatcaaagaatgcattagtaattgctattgtttgtagcatttcttgtggttcatagccagatgaccatcctttactgaaaagcttattgtgtggggattgctcagcaccctttcaagatatctagtgttggtttgcggggcaagaggggagtgcatattttatgcaaaaaaaaaaaaaaaagattttgtgctaccacattcctcaattattctaatattttccccaatagaaatatttcctcataatgcaaacacactattccgagaagcagaatacttttctggatctaagttgtctgatggtttctctgggtgatgtgctgcatggcaattgctttcccatgaagccacagaattcccaatttccaacaggagcccaaatctaatccaaaactctatttcacatctgacaactattaggttttctgatagccttgagtaagcaatgacatgtgcttctttctagaaaaagggcatgaccctctgtccacttaagacgaagctgagggaggccaaggcggccagatcacgaggtcaggagatcgggaccatcctggctaacatggtgaaaccccgtttctactaaaaaaaatacaaacaattagctgggcatggtggcaggcgtctgttgggacactactcgggaggctgaggcaggagaatggcgtgaacccgggaggcagaacttggagtgagccgagatcacgccactgcactccagcctgggcaagagagcgagactctgtctcaaaaaaaaaaaaaaaaaaaaaaagacaaagctgagaatctggtttgttcttaatgaaaccaatagaaagtcggtcacttaagttttcaatttatagtgctttcttagccataacagaatgagaaacatgttttgatcatgtctagtggcctgtacgctgaaacaaggatgcacgcaaagtctctgggtcaatattatgttgcctgtagagtggaggttgccctcaaactcaaatttctcactgcattccaacattatggaaatggcatggctaatcatttcaaaagatctgaaaatactaatacattttcaaacatagaaattgtccatttaaaaaaaaacatgcccattatccagcctttcaatatgattaaattcatttgttacatttatttgatttgtttggggccaaaatagccggctggcaagtgcatatcaccagtacaaaccttaagttatgaatatgactgaaaggtcccaagttaattctagttaagggcatgagcctttcagaagggggatcctgatgggccggaagtggagccaactctctcgcctcctgtgcctgcttacattcctggtttggagcaagttattagattccatgggacctagtggtctccgggtgctgtggagattgtgtcggatgccaggccacgaagacttagcaaccagcgaagtttctgtggtttcctggcagcagaagttgactgtgaagtgtgagtttgcttggatgacagggcacccggctccgtggtgaccggcttctgggttggcttctcagtgcaaactgaagtttgagtcagaaaaggctgttgtttaaattggagtgtcttttatgccaaaccaacatggatgctcctttgttctcaaaagggaagtgacgccagctggccagtctgaggctaagtatttgcacaaaggctgaccagatgacacacactccttgcccattgtggttcccaccgcagggaatgtccatggcaaactctctggaatgatcctctaggactgccactcttgtgaatagttggtggcattcttccaagtggtcataaggtgatagacacatttttctgatcatcacattgtccattgcaggaaacaacagttgcaccatttttgtaaatggtagctaatgaagcaacacaaagttctgataaaataagaacagaggtaacaaagcaacagactgccctcttaatggcgccaccaaaatgtgctgtaagattgaatttgcaccataaccattgaaaaataggaagtacaaaaccagagatatttttccttcccgctgattgcctggtcatgagacagactggaacagtgcttggctataaatttgttagcagctgaaatgctcgggggccccatgcaccggagttctgctcctccacactgcttctgcagaattaggagaaagcattgcattttactatcttttaaaattatgaatattggaaactttgctgaattcttttatcagttctaggagctttctggaggagtctgtaggtttttcaaggtaaacgatcatatcgtcagcaaacagtgacagtttgacttcctctttaccaatttggatgccctttatttctttaagaactagaagtagaactaccatttgatccagcaatcccactactgggtatctacccagagggaaaaaagtcactattagaaaaagatacttgcacaagcatgtttatagcagcacaattcacaatttatgtttatgtttatagcacaatttatatttattttatagcacaatttatatttatgtttatagcagcacaattcacaattgcaaaattgtggaaccaacccaaatgcccatcaatcaatgagtggataaagaaattgttgtatatatatatatatatatatatacactatggaatattactcagccataaaaaggaatgaattaacaccatttgcagtgacctggatgagactggagactaatattctaagtaaagtaactcaggaatggaaaaccaagcatcatatgttctcactgatacatgggagctaagctatgagaatgcaaaggcataagaatgatacagtggactctgggagcttagggggaagagtgggaggggtcagggataagagaatacatgttgggtgcagtgtatactgctcgggtgatgtgtgcatcagattctcacaaatcaccactaaagaacgtactcatgtaaccaaataccacctgtaccccataacttattgaaaaataaaatattaataataaaatttaaataaataaataaaattgtgcatattggaaaagaactgggatcatgcagcctttattgggaacttctgaaaccttatctctgcactttggaggtcgttgcacattcgatagtgatggagaacacgtcggggacttcccggaatgcaatgattatgtattttagtggatcttaaactggtttcccaatattcaatcataatctttggcagcctgagtggcagaaacatttgctttctatggggtcctgatttttagctaatattttgggaacactcttagtgtgtattaatcgtcctcttctttggccatagctcatgaggtcaacagtataagggatgagagtgaagatccctgttactcatccattctgtattgcgctgctcggacctccacaggagaagttagggcacgaaatccaagtggcagctcattattggcatgcaatgtaaaatacaaattccaggatgctcagacttccaggacatctgagatatagcctttggaaaataagaaatgggcttgcgatcatagttagttattactactgggggccgtggggcctgatttggggtctttatcatctactagctgagcgaccttgggtaaattgcttaacctttccatggttcttcaaatggaataataataatatcaactctgactgttacatggttcgatgtaatggatgaaggttgaaggagacaaggcacctgtatacctggtctaagccacagctaagcacggtgtctctgcacagtaaatcctcccgagctgtctggtgatcagtgttgccttttgtgttgcttatccacaccgcaaaacgctcccacgtgcgtttcctgcctgcctcacaattaccccacaagacgggtgcactgcatctcacagaggaggaagcagagccaagagacaggcctggtgcacgtgagggccgcagcccctgctgctgtgagcacgccctctgcacccactgaatattccccaagcatcgctgacgctcggccaggcgccggccttcgttcctaggctgtcatctctggacaaggcagacgcaggccctgccttcgtggagtttagatgagcagcaggggggcgacatcatcggggaaacaaatcactgcacgggtgattctgggatggtaactgctaggaagagaatccagtccaggcaggggccggagagggctgggtcccgtggctctgactgaggaggtgacgcttgaggtaggcgctgatgagagccccgctgtgaaggccagaggggcagtgctgcaggcggggctcaccgtgcagagtccgtgactgtcatctttccactcctaagttttggcttagggattgtgaactagatgctccagctttcaatttgtcaactggtttatctcctaacggacacctcaccagtgttttcctcacacattcacaaagacgcttttaacctgttggcaagaagcagatttaattggaaaagggtctgattcctaacagaacaaaagacaaagtatattacatgtagtgactacgttatactcttgtgcagtcgcttacaacttcaggctgggtcaccaaggagatggtgagtgagctttgaaactaaaagtaagcaaattctgactaagaatcatgtccagtgactgagtatgtgtgtgtgtttcttctccattgctgctttgacctattcagatgtcaagaactacaaagaaataagatgctaaagaaatcagaaaatctggccaggcatggtggctcgtacctgtaatcccagcactttgggaggctgaggcaggcagatcacttgaggccaggaggtcgagaccagcctggccaacgtggcgaaaccctgtctctactaagtaaaatacaaaaattagccaggcatggtggcgtgttcctataatcccagctactcgggaggctgaggcaggagaatcatttgaacccaggaggcagaggttgcagtgaggggagatcgcaccactgcactccagcgtgggtgagagagtgagactgtctcaaaaaaaaaaaaaaaaaaggaaagaaagaaagaaatcagaaaatgtaaaaaaatagatgagctcttgtgatatttctaagaaatataattctattaataaaatcgaattggttggaatccaaaggcattttaaagtttcagaacaaattaaactttttaaagtttcaggacacatgtctaaatgtctgtctatctaaaatttattttaggggtaggagggaaattggagattgtctatctaaaccttcttattttacaggagaggagactgaggcccaaagaatttagccatgttgtataagcttactcagccaggtggtggtcaaatctaccctagaaagaatgttccccatcacctggcccaaaaactgcactgtcagttttataaatagaatgcacgttatcaggaccagagtaatattagaagagattaagccacacaaaactatcttccctcaccaggtgcctccttgagcctgaaattccactcttggataatcattcttggggcacacatttccgagttggcctgctcctccaaaggacgtgctcccggccctgcagtcactgagtgccactggagcagggctcccagctctgagagggaggggcttagtgttcctggagacccctgacggggagccagggtggacggctgcagtggcaccccaagctcactggaagccttggggacaagggaggatccaggagaaagggacgggtgtagagcacagggcagaagcggagggccagccacttctcctgctaccaccagggccagccctgcctctgcatcttgggcatcgggacagcagcaatttcaacatagccctgagccaacttaaaatgcaacagcactttaaaaaaaatctcattcatcatgtaatatgtctgatcttaaaactgacatctgattttttaaggcagctgctctggaagaaattttctgtggatcgcaagagtctgaagccccatgaatgaccaaaaatatgcgcctgaaagagaaatgcgctgatgaagggggaggaggatgggaggggagactctgaaattgtttctcactttagggaagaggcacaacaataaaaaacatgaggccccattgaagtaggactttaaattccacccgaaaacaatcccaacaaacagatccattgttatatgttttgctacaagtaatagacaaagcaattgtgaaccaggacctgagccctcccgtcagcacatagtctgggttcttcagctcgcgagtgggctcagatggcctcagaaatgtagtttgctctcccctttaaggtcactgtccaggacgaggtgaggtaaacaagggttccaagtaagccatgtgttacccataattgatcaagggaagataacagccatgaggctgtcctggacccctgcccgtgcagcagggcagaaccattgccactctgcccagaaggtgccccctcctcactcccttctctcgtccaccccataggccagcaggatttgaaggaaggaaaacagttacagctgcaccactgggcttggcctgcactgtgctgatgtttttaaagcgtgggctgtaacagaagagatgatcttcagcctcactcttttcctggtgcctcctcagtatcttaacaccttctttttctaatcaactatttaattacacaagccacgggctttctacgtcaggttctcccttacacgtgaaaccgaggctcacgcagcacatgagaaacaacgtgttgccctgagaggttagcaagttaacctggacttagacccatcatcaaccaaagaacaagaaagacccaatgtccatggcaacatccagctagaatagcacctctccctaaaactggattttgcccggctgcagagttctgtgctgtctacatagaattgttggtgtcacctgggaggctcaggaaaggagagcccgaataaagaggaagaagaaactgcaatttaggtccccaagcccaggaccagcctgagagaccaacctggccaggcttggtgtcaaagggtactgcaaggatttccaggcaggcaggcaggtgacctgaatccaggtaccttcaatgtccaggaggtgactgacgggcagcagccactcaggtgtttgcatagaggcaactggacaccatcctgcaggccaagaggaggtctgtgcatggggcaagaatacaggctctgtctgagggtcaagcaggatggcaggttgtcaggcacagtcagcaggtgggcagccagggagaaagagacctgggccttgggggcgacccacccaatcacctgggaacaacaacaggtcctgattctttttcttcttcttgttctttttttttgaaacagagtttgagacagagccttgctctgtcacccaggctggagtgcaatggcatgatctcagctcactgtaacctctgcctcccgggttcaagcaactctcgtgccttagcctcccaagtagtgggactacaggcctgagccaccacacccagctaatttttgtatttttagtagagatggggttttaccatgttgtccaggttggtctcaaactcctggcctcaagtgatccacctgcctcggcctcccaaagtgctgggtttacaggtgtgagccaccatgtccagcccctgattcttactggaagcaagggggcacaaatggtacaaaatttttaaacagcagaatgtatcactattagctttataacttccccaactgctttcactctttgaaagttattatccttccagaggctcatgtactattctacgttctgctaatttttctatgaatttttaaacatatttgactttaattttcttttagttcacaggataggatgtgtatctgaaattaatttttctctaatgtgctatatctcaaaatcagctattaatcctcccccactgctttgtactgcctgttttactgtatattccattctgactcaaaattcagtctatttgcattagtttaacaaacacatgctgagtcccaccacgtgcggggcactattctgggtgctgaagatgcaacagtgaacagcttggctgtcacatctgtacttacagaggattctcgttggaggagacaagataaacaaggaaataaactatcatctatcacatggtgatcaatttcatgaagaaaaataaaacaaagaaggggaatagaaaattccagccaggtggtgaggtgcaacctaaagccaggtggttagggaaggccttaccaagaaggggacattgacaaagacccccagggatgatggatccgtgaggaaaacgttccagcccacagaaagcacatgcaaaggccccaagaagggacacgtcggtgccttgaaggaggccagtgcccgagtgaaggcaagagtggtaggaggtgacagggaaggtggccggcagttcatgtagagacttcactgtgaggacactgacggtgaccctgagtgagacgggaggtccatgtcctggggatgctgtaactaatgaccgcaacttggtggcttaaagaaacagacacttatcctctcacagttgcagaggccaaaagtccgaaatcaaggtgttggccatgtcgtttccttcgagaggctctgagggagactaaaggcagggggaaccctggatcctggcagttgcaagcgacctttggtgttccttggctcgtagacacatcactccaatctctgccgccatcttcacgtggtcttttcttgtctgtgtctcggcgtctctgcctatctgtctcttataaggacacaagtcattggatttagagcccattctaactaaatctaggatgttcttataccgagatccttaataacatctgcaaaaaccctatttctaaataagggcacactcacaggtatgcaggttagcagtggggcgcatcttttggggagacacaactcaaccccgtacatgttgagttgagaaggtctttgaacacaacagggcaatgatctgtgttaaagggggcattctgggggctgtatggataggggtaagggggttcaggcagcagcagagagcccagttaggaaagactataccagttatccaggtgagaggcgcagttggttgaacaagtcagtggtggtataagaaatagttccatgagactaattacgtaagacacagaaggagccgttattcagaaggtggattctgatcccttagtcagttccactcatttaaattgttatttttttacaactatcaaactacgttcattgctgtttctctatgttttcaaatatctcatagagttaatcctcttcttccttttcttagttggattatataaatctattaatttgcttgagacaatattttccttctccttcaggaatactgtatatatgtaagtgtatgaacagatagattgattgatgtcaacttattcaagtcttttattatcttttaaatattttttaacttctttatagctaggacacatgcctcaatagatttattgccaagggtctcttgtggaaaaggggttgatattgtggacaggatttatatttttattacaacaactggtgccaactaataattaacaaggctattaattttggtatgcttattttagatctagtactttattgaatcattttattaaatattattatttccgctgattcctctgcacattctggttttccattatattaagcacaaataattatcttttctctcttcccattattatacctctttatttttttatgtctcattgcattaactagagttttcagaacactattaaggaatcattcttgtttccatttttaaacagaatttacttcatctatccattaagcacaatatgggctcttattttccacaactttttatcatggtagaaaaagtagaatctattcctaatattttaatatttttggaaccttattaagtgttatcagttgtcttttagacatgtcatttattttaatttaacccattaacattgtatacctttttagtgtatgctgtcatgttggatttcttgcattgtggaatataccttccagcagactcctttagatgggcttaaagcaagatttcagggtgttaatttttgcatttctttgcttatttttatgattagggatctgcttgatttgggtgacatcctcattaaaatcaatattctcgccgggcgcagtggctcacgcctataatcccagcactttgggaggccgagacgagcagatcacgaggtcaggagatcgaaaccatcctggctaacacggtgaaaccctgtctctactaaaaatacaaaaaattagccggcaatggtggcaggcgcttgtagtcccagctactcgggaggctgaggcaggagaatggcgtgaacctgggaggcggagcttgcagtgagccgagatggcgccactgcactccagcctgggtgacagcgagaatccatctcaaaaaaaaaaaaaaaatcaatagtctcatattataatgttcgtaagaactatgacaccttgggagagggtcttggagaactggctaccaacaatttttattaacacttctggcaaaagcactagctttcggtatcaacatcattatgataaaaatgtgtttatgaaatgcctctaataatcactaatgctttggtgtggttccaaatagttcttgtccccgaggaactaacaacacaaagttgtagattgtgtcagattttgcagttcataaatcgtctccacatcaatggtcatggggcagcattattagacccatttttacaaatgaggaatctgatacctgacaagaataggaatttacataaggtcattaagcaaccaagacaggcacagacagaacttgaactcaggagtcctgatcccaaccccgtgctcctttcaacgtgccacactgactcaacacccagcaactaacaacattcagcaaaagcatgagaagacatgatgttctatgctaagactggctaataactgctatggggagagattggaaagggttcttctggaatccccatgctccccaatgccacttcctaacaattatccccattcaccgtgtagaaccccattgctcctttaacattcaggccagttagtggtatcgtcctgtgtccctctcacttgtgtcacctgctgacctcttcagccactgaaccatactgattctagcatctggcccagaagcctccatctctgtcatccgaggtgacctggtgtccatacggaagacagctccgaattcttccttgacctcttcggctccactggtcatttgggcatcacttcagccatccagacccacagcctcagcctcactttggacctcaggaggacctcaccccaaaatattaagctctgacatccttcactctgactataaggtcttagccttcatctctctacagtacgccttcccagctgttccctcacccaggtctttcccatgttgccccatctgtggcccctttccttgccttctccaggctgggtctcagggttgatcgctaggactataggagacctcccatccgccccgctccacccccagaggctgagggatgaggggcgggcagtggagctgatggaggaaggagaacaggattctctgaggagctgcttcaggctaaggtccggtcctctgatgatgtgctggtttcagagttggaagagggtgtgtgcctgtgtgttcctgatgtcctgatgagggtgccccaggacacacgagggccatcccgcccctccaagccccagcccctggcttatccttggtgcctccagatctcactccaactctcatcccccttcccttcccgatgttttccctgcagcatcgtccagtccccaagcacttccatggagctctgctcactgccgtctgggccaccagccagcacctcagcagccccttcagcgatcgctggcatgggctctgccttggtctctcctggtctgacgccaacccggccgcttcatttcctgcgaggggagctctcttcagctcccacgttggtccaaattggtttggtctcttctagacctcagagcccatacacaaagaacaaaggccagttagtctcccactctgcaattattcaaagttcgggctttaaaacgcagagatttttctgcttcatctacccacagctcagcaactgtatttctacacctattgttattctatttctgttcctaattgctattgtagaaaaccgtgcctagctgaagcttcgggagttgccaatccgtgggctcccttcaaatgtaaatgtgttatgcaaatgtcttctgaggctgggagtgggatcctgtggtcttccctgggtagagacagggaaagaatactgctgggatggctgagaaacagaagacaatccgctgccctcgttatttaaacgctcactgttctgagatggtttcctgtctccaacttcctctcctgctctagcagctgaatttaaaatacttgctacagaacactgcttcttctgggcagggaacgctgctgcttaacccttccatgctcgttccctgtggggacacagcgtgttggccagctgcacctctcccagggtctcaggaccatgtctgtaaggtagatgctattcgaatctaggaaccttttttttttaatatggaaaatcacctatctaaataatgcattgtcatcgttagcaaaaccttaaagcatcagtactggtggagaccttgccattccaagcagagttcgaatccttccaaaaacagccacgacatcaatgcaaaaaaaatgttgttttccaggagtgctagtcccatcgggagagctccttccctcctccctctgtcttcccggctccccatgttcctgagcccggagctgatctccgcctcttctgccctcagcttagctgcctgtcatcatgccaggcaggcactggattttcttttctttctatttttttaattttactttaagttctgggatacatgtgcagacagtgcaggtttgttacataggtagacatgtgccatggtggtttgctgcacctatcaacccgtcatctaggttttaaaccccgcatgcattaggtatttatcctaatgctctccctccccttgccccccaccccctgaggtgctggattttcactgtcctgagattttcactctccctcataccctctttgctggcctcccattatcaccagcagcaatttggtccaaagaaagttctcagcttctgaatgaatgagccctcaaacccatgagctccttgactcagtgcttatgctgtgctgagccaggcactcgcaggacactcggccctgctggtcagccctgctggccgggggctccacatctgtggatttggcaaaatgcagatctgaaatacttggggggaaaatatgcctgtactgaacatatacagaaattttttcttgtcattgttccctaaacaataaagtataacaactatttacatagccttacattgtgttagatatgataagtaatatagagatgatttaaaggataccaaaggttgtgcaggggttatacgcaaatactgcaccatttagtatcagggacttgagcatctgtggattttaggatcacccggggtcctggaaccaatcccccaggaatacggtgggacaactatattaattaattaaccttttttgcatttatcagtagtttctgtgttcaatattgtctattgctgctatttccaagatgtggggaaaaggtgaccacaaatatatagaaatgtattctgtgcattctaaaataaattctaaactatatgaaagtagagggcaaagcagaaaatgctggaaaaacggccctggcccaagactttgagctgtttgtctttcgtttttcacactgtcgtgttactcagtagtcctggcagctctactgtaccattctgaatttcagagaaagaaaggggagctaactctgccctggaatattatttatgttctaaagtgctaaaagtactttcaagcgcaattagcttatttaagaggcagagattatgttgttctctgcctacctcatcgggtcactgggaggatcacaggcgggggaatatatatctgtgttttgagcacagtaggaagaaaatctttgtgtaaattcaggttggctttataatgatccggcaagattggaatatctgatcaaagcgaatcactctgatctactcagttacaacatgatctctttttttttttcagatctaataatatatcacaaattgacatgtgcttgtgagaatgatttgtggttgatctcgatgctcagacatggccatcggcattccaattattccctcccctttacttaatttcactacagacttgccccatagctcatggttctataacagtctctgacttcatcacatttttatcaggaaacaaatggatcactggcttgcacaaaatacaaatttaggccaggtgcagtggctcacacctgtaatcctagcactttgggaggctgaggcgggaggatcacttgagcgcagaagttcaagactagcctgggcaacatagtgagacccccccccccatgtcaactaaaaatttaaaaaattagcccagtgtggtggcgcatgcccaggtagtcccagctactcaggaggctgaggcgggagatctcctgagaccaggaggctgaggctgcagtgagctatgatcacaccactgcactacagcctgggcaaccgaacaagactctccctcaaaaataatagtaatatataaatttgtctgcaattgtgaaaaataaataaatttacatactagatccaaggccctgagttttaacttgataactggggccaggtatcttacagaccccaggaggcctttcaaacccgttacttgcgtcgtcatgccaaggggctgagaacccttcccttcccatcccgagagcccagaaagaattctgcaactgtctgtgagccaactagacttgaacaggctaactgacctgctactcaggaaagaaacattagcttgctcacaagagcttccctcacagacttggtacagaagtctaaggatcacgtggcggccgcagcctctgtgtttctgtcccctgagtcagcacgtacagaacacgctgtgcgccaaggaccagaccctgctgtggagaaagctacagtgaaaggtcaagtctgtgcagaaatatgtgactattgaacaccctcctcttctcaatcacaaaagctctttataattcctcctctgcaggcaaaaactgtgggaaactctcacattaggcagaatttttttctgacaatatctggaaccaaagacccacagtcaggttaaaaatcacattttcattgaaacagtttatgaaaagcctattacctagcaattttatatttgaatgcaattatgttaatgttattagtacattatgaatggtactaatatgattattgtttcatgtggtattacaggaaattaattcaaatggatttacatattttttagataaagggcactgctaacacggataaataagaagcctgacgttactttaaaaacaaaagatagcactgagaaagccaggttgtgacttcatttgtaatactaacacaccatttttgtgcttttttgttgatgtaaatattttgcaatttccaaagtgtttttcttgttgaatgcagcaatctgaattaatttccccagcctctgccagtgtgcctttagcccattttatacttgagggagttgagagtcaagagaaggaaacttgccccaatttatacccagaatccagacagtgcaagatgcaaactcaaatagctgagaactcaactcctactgttagatcatcggggaatgtaacttctcacgtcgaatcattcagagttgtaattaagtaaggccggacctctggaagctctccttccctggattttggtgaaaggaaatgcttgtttctgcactgggcaaggctgatttccatctcacagtacactttctgcatctcctgcttatccagaggagaccccaccagcctcccgagctccatcgtccctcagagtcactccgcatccactgcgcactgctctacacactgctctgggctagtcacactgtgctgctggagacaaaagtgtgagcacaaaacaagccagcagcaggggacactgtgtgcactcagcccatgcaaacagtaggtgccagccgaagtcgttcaagggcgacagagcggtcacaggtgtggttgagaagagccgcccagaaacaagatctgggctgggcctagacagagattggtggggcagctgaggtgaggggagctgtgggtgcaagggcagagggcaatttgcagggtatatacacggtgagggcagagcttccgctggttggaaaatagggggtgaaactgagttggggacaaactgcagattacctctaggcttaggacggaggagttgctgccaacttttaaacacctgaaattgataagggagaagctgcctctgccaaaaccaatctggcaactgtgcacagaaaaacaggttaagaaacgagtctttcgcaagtatgtaggcctggggtgataaaggcctgaactacctaggagggatggcctctgccccaagccaaggaacgctatcaaatctgataaactagtaagctgggaatgataattctatggtgatagatcctagcaatggatgatatgcttttaagctgaaagtgctttgaggactagtactctatcttatttgtctattttcagcttgtagtaaagagccggcttccactcctgctgggtgaatgaacgcatgcatgaacgaatgaatgcaggcatgtgcgaatgagtgggctctaaagatagtatgttgtagataatttcctgactaatgatagggattccgaccctgataggcttacaggaagctgcctctcagtcggtcctggtgtgggtggctccatcacctgtgtgcaggccccttctggtccgcatccttttccctggatgaggagggcctgcaggctgacagtgacaggtgttcctccagtgcccgtcaggaatgcccgggctcccttcttctccagggaagggggtggggggcactcttcgggcccgtgggtatttgttttaatggaagaaatgtgggtaaatacagtcttcaagcacagaatgaagtgaggataatattaattactaccttcggtgattgttgtgaggattaaatgagttaatatatatgcatagagtagtcgctgatgtatatataataagcatatagtgttagctgatgttattattatttgttattactaaccaaaccaattgtcccacctattaaattcttaatatttccattctagaaataagctaaataagagcaattccttaaattctttcagcagtaccaactttcctactttcccttaaagccacagttaatttctaagtagctagttgacatgttaatgatcgaggttaaatattacatcaggattttattttagtgattaaagaaaataaacacctaaacttttatattgagcatttaccataattccgagtcaaaaattaatctaatattttgactactgtacatttcacttctgcaaataaaaatttgacccataaatttaaatggatgttggtgcatctccaactatttagcattaaattcattctgtcaacactttccaattatcttctcataagacaaatagtaacagaccaattcctaaaaagtcatttgtgtttaattgaattagtagttgtgtttgattgaaatatgttaaagccattataaaaataaattcttttcacttattggtgaatttttctacctatgctgtcaaaatggctagaaatatcaattacaaactttgtgaatgggaagtggaaatgtccattctttattctttcagaacagataaaaatactgtaaaatcagaaaccggatttggattttaaagactataggtaagtaataccggtaaataggatatctcgtaaagagaaaatggactgtggcttaggaatttaatgaaatagaggggagcggtaattttgagtccatttaggattttactggcttactgtccagcaagaggacttagattaaattattggttttctgtgaatctgaatttcctggtctgtgttgtcaggacagggatggaactttggggaaatgtgtggaacagatgtgtgggagaagccagatggggccaggatcttgggtctaagagagctttctgtaaactctgtagtctctcatgctcatctaacctccttctcctgatttttttgctcacatttattgatcatttactctatgcaagacaaaattctgtgacttttgcatgtattacctctcaatcttcaaaacagcccacagattaactgcttatgtgaccctcatctgacagatgaggaaactggaagctcagagaagtggatgctttgcccagggctggagagccaggctggggctgatatcccagccgtcaaatgtcaggctcctgctctagaccgtggccacaagatttggggaaagttccctcttcccgggcagcaccagttttatgagcacgttcttccttcctgcccaaatgtatagtgagcccctcatcaaatggcttaacttcaacatggaacacgtctgtcacacaggaagctgcgtgcccagagcctggccagagaaccagggccaggggcatgaaagcaaaaaggcagagggtactaaagaccccaggagcttgatgctgaggcagtactctggataagtcactgtagggaaaaatgctccacgtaaactaagctcttcctgaagctttcacactgggagagggggtctgccactcgttggtgctgggtaggcagaactcttcatcctgggaccacaaatgacccctgcattcttccatgagctctgggcttcactgtcagcacagtcccatcagtgacgagtccccgcctcttcctaactgcatgatttatcttggctcattcatttaccaagaaactattgaatgcctactaagtgcctattattcagcagttgtttagtcaagaaatgagccaacgtacaagaacagaaggcagcctgcttctaagtcctagttttctaaagtacttttaagatcagtcatatccagtgggaccataatatttcacaccaattctacaaaaagctacattcaattaatgaaaagcgtaagttatcaaacatgtaaaaagtaccatttgtttctttgaagtatctactataagtcaaattttattaatgagacattacagatgacctgcctcaaaggttagattaaaaagtatttttgcatatcaattctatgtatatgtgcagatcttctaacctattctaaggtgtcataaaatggtttattcttagaacaatcgtataaatcccctgtcacatttaaacaatttactctgtgagtaaaggcttactaagcaaggaaactcccatacggtccctaataaattattaatttcaaataaatgtagtctttctctcccaatggctcactctctgatgtttctcatgcttttcagcactgccagatctgagaaataaaacaaagtaacacccaaatgagttacttttaattctgagaagaatttataactaacagataagatgttgatattttcaatatgtggctttagaaaacattaaagtaatttagaaagaaaaatttagctagcttccataaaaatttagcacattaatttaaatgaataaaatttaacagaaaagcaaaagtacgttatagatactttgaaagtgttgaaattggcctggcgcggtggctcacacctgtaatcccagcactctgggaggccgaggcgggtggatcacaaggtcaggggattgagaccatcctggccaacatggtgaaaccccatctctactaaaaatacaaaaaaaattagccgggcgtggtggcgggcgcctgtagtcccagctactcgggaggctgaggcaagagaatggcgtgaacctgggaggcagagcttgcagtgagccaagaatgcaccactgcactccagcctgggtgactaagtgagactgtctcaaagaaaaaaaaaaagaaagtattgaaatatagtaggatgtaagcttccaaacaacttacagtttaaaatctcaaaaataaaaatcttttactaatgtgatataatttattacttcacatttccaacactatagtaggaatattagcttttttctttcataagaaagccctaaacggtcagtttgctgttcatactttttctgatggccaaatccttacttttttttccaattgttttatggttctatcagctataacatcatatttgctgatttcattctgaatctttccaggtcatggttttgcctgcttttatgtaatattcatttgtgttttatttttatccatgcctccttgaaaagtaggaaattcaatttggattgctatcatgtttttctttctttgagtggctccccgtagcttccttcttgctctgtgtttctcctttaccatggaccccgtgtgctgctggcctgggtggaaacaccaaaatgatgtgcttccgacttcttcctaagtttgtgattataaggttttcaaattacatgcaactttctataacaggcttctcatctggcaaatgaattaaaatatttactgatattgtctcaatcctagcaacagccaattggaaatgtcagtttttaaaagatcctatcgagagtgtcaacaagaactgggtaactcctccaagtaaacttagtaagacatctgcaagacctctgtgaaagaaaccatccaagaaagatacaaaagattggaacaaatggaggcacacatcctcctggctggaaggactcacgttgttggttttgcccatccagcacctggtaacacatgcttagtttctctttacagtctcagtggggtaggcctgccaaggatcccttcccatccctggccaagaggtgagcatttggcccaacttaggccagctgggctctgcctggggacttgaagcttgactgagggtcaaagggctgaaaatgtttggagatgattcttctggttgacaggttctgtagatagcccctacatcatgccacctgtgtccatggagcttcccaaattcctgcctctttctgagacctggttcttcacattgttctttgattcagttcgctacctcctacctttccagtaggttctctttatgttccagttatctgaagttagtttccacttcttgtgagcaaaaaactcaactgttacaattcaatatggtaaagatatcccaccccaccaagttaaggagccaatgggaggcttttatggatctttaaaaaagtgattcaagtatccatatgaaagaaaaaatgggtgagaataccactgagggggaaaagaagaaagagagagagagagacagacagacagacagacagaaagaaagaaaggaaggaaggaaggaaggaaggaaggagaaagaaagaaagaaaaagaaagaaagaaagaaagagaaagaaagagaaagaaagaaagaaagaaagaaaacaaagaaagaaagaaagaaagaaagaaagaaagaaaacaaagaaagaaagaaagaaagaaagaaagaaagaaagaaagaaagaaagaaagaaagaaagaaagaaagaaagaaaggagggagggagggagggaggaaggaaggaagaagagagagagagaacaggcatttcctccaccagatattaagataaatttaaaacaacagtaattaaaaatgtgtggccccaacaatagcatagacagatcagtataacagaaataaatccaagaataattttaaagtttttaatattttataaagcgagcatttcaattcactgggaaaataaaagatcatctcataggaggtctaggtcggcaggctaaccccctggggaaaaatatttttaaaattattaggacctgtctcatatcatcacgaaaacttaaaaatacatatggcttacttaacaaattaaatgtaaaacataaaatgaatttttttttttaaatttcagtgataaggtctcatttggttgccaagctggagtgcagtggcgcaatcatagctcactgctgtctcaaactcctgggatcaagggatcctcccatctcagcctctcaagtagctgggactaaaggtgtatgctaccatgcctgactaatttttttttttatttcttgtataaagggatctcaccatattgcccaggctggtctcaaactcctgggctcaagcagtcctccctccttgcctcccaaagtgccgggattacaggcctgagccaccacactcagcctgaaaccatttttttaaagcccaaatacaatatgggcaaatataacataaagaaagaaatccaaaggaaaagatagatttgattacataaaaatgaaaagattctgtcaaaatcaccacaaataaaaataaaacaccaatgatatgagagtgacgatttccctacatcttctccaatagaaaatggtagcaaacttctgaattggttgtatattaatcagggttctctagagggacagaactaataggatagatgaatatatgaaggggagtttattaaggagtattgactcacatgattacaaggtgaggtcccacaataggacgtgtctgcaagctgaagagcaaggaagccagttcgagtcccaaaaccttaaaagtagggaagccaacagtgcagccttcagtctgtggttgaaggtccaagagtcccaaagctgaagaacttggagtctgatgttctagggcaggaagcttccagcacgggagaaagatgaaggccagaagactcaggcagtctagtcttttcacattcttctgcctgcttttattctggctacactggcagctgattagatggtgcccacccagattgagggtgggtctgcctctcccaggaccgactcaaatgtttatctcctttggcaacaccctcacaaacacaccaggaacaatactttgcatccttcaatccaatcaagttgacactcaatattaaccatcacaggtttgaatgaatctttttcttttcattgcttctggaaattgagccatagtttgatgggccttcccaattcatgtttataaagggacttgcctagatcttttgtgactttacttttatatttaaattcatttggaattatcctaatgcaaggtgtcaggtatgaatccaaatcataacatcaggtgccccaacatcacttattaaatagttcatgttttacctactggtttgagatgacgcatgtatatcaattaaattcctgtatgtatgtttgcccgcatattttaatgtctggtagttcttatccactccaaacatcgattattggtcttttaaagaatgttcctggcaattgttgcttgtgtattttcacatatgaaatttgagaccaatatgtctaattacaattaaaaacctggcatttctactggaatctctttaaatgtaaaaattaacttaagtagaattgctatctttgtaatgctcagtttccctgatcccagaacatgatgtgactttccacttgctcctgtcttacaggcccatcaactgtgttttaaagttttcttcatataggtcatataaaaactattgaagtctgtgtatttgttttcttttcttttcatttcttttctttcctttttcttttttttttttcaagatggagtctcgctctctcacccaggctggagtgcagtggcccaatcttggctcactgcaacctccacctcccaggttcaagtgattctcctgcctcagcctcccaaatagctgggactacaggcatgcgccaccatgcccagctaatttttgtatttttagtagagacggggtttccccatgttggtcaggctggtcttgaactcctgacctcatgatctgcgtccctcggccttccaaagtgctgggattacaggcgtaagccaccgcgcccggcctgtgtattaattttcaaccctactaccttactgaatttgtttgtttattcagttaattctcaggttttccaggtgtaaattttagaaaatttacaatcctcctaaatgtgactatattaccttctccttcccaagttttttacctcaaatttatttttcttgtaatagcattgactatttcctatagtaatagcactgtgtaattcttgtaatagcactgactgttttctatagtataatgttaaataacagtgaagatactggtgagggtggaactttattgagcatatttatgatatgtctccaccaagcagggtgctggcttttggactgagatagatgtattttaacttataaaggcagtatttcactcttcgtattttgtttttatcaatggtggttgttaaatattgtccagtgctttatcaacatccatggaaatgatcataatattttttacttatatccttagtatgataaaatgtatgaatagaattcatagtaatgaaccatccttacatttctgaaacaaacatttggtaatgatgcatcattctttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttagtagagacggggtttcaccgttttagccgggatggtctcgatctcctgacctcgtgatccgcccgcctcggcctcccaaagtgctgggattacaggcgtgagccaccgcgcccggcctgcatcattcttttgatatgtggctggatttattttgctaatattctgtttaaggatttcataagtgacattggtctattgtttgttctctaaaatgtttgtctttcagtatcaatgttatacttcctccagagaaaaaaaatcttaaggtgtttttttgttttgttttgtttgtcgttcttgttgttgttgttgtttccctaagctctagaaaaagcacttaatttgtggtattctcatgtctggacctagcgactttttctttttgattagacaagaatagctttttgataaccttctgtatttttcccatagaaataagactttttagattttctgcctcttcaagggtcagttttgactaattatattttcctaaaaatttcttcaatttatccaaatttcaaatgtatttgcacagttaaacaaacttatgtcctgtgtttcttttaattctcttaattttctgttactttcctccccccttgatatttcctgtttgcaagttctccattttttttcttgattaaattagatattggctcatatatttcactacatttttgtcttttaaaagccatcttttggacttattttgtagttctgctgtttgggttttctagttaattaatttcagcttttaaaatttcttatgatttaattccatttattttgttgctccttgcctaactttttgagttagtttaattccttttaaattcttacttgttaattaaattaaaatgtaaagtaatgcatttttctctgagcattttagtggcatatcataacttctgatatgcagtatctttattatgttgttttctttttctttttagtttttttttattattatactctaagttctagggtacatgtgcacaacgtgcaggtttgttacatatgtatacatgtgccatgttggtgtgctgcacccattaactcgtcatttacattaggtaaatctcctaatgctatccctccccgctccctccaccccccaacaggccctggtgtgtgatgttctctgccctgtgtccaaatgttctcattgttcagttcccacctatgagtgagaacatgcagtgtttgtttattttgtccttgcgatagtttgctgagaatgatggtttccagcttcatccatgtccctacaaaggacatgaactcatccatttttatggctgcatagtgttccatggtgtttatgtgccacattttcttaatccaatctatcactgatggacatttgggttggttccaagtctttgctattgtgaatagtgcctcaataaacatacgtgtgcatgtctctttatagcagcatgatttataatcctttgggtatatagccagtaatgggatggctgggtcaaatggtatttctagttctagatccttgaggaatcaccacactgtcttccacaatggttgaactagtttacagtcccaccaacagtgtaaaaatgttcctatttctccacatcctctccagcacctgttgtttcctaactttttaatgatcaccgttctgttgttttctattcgttctataatttgggactgtacttcctctttgatgtagaagttgtttaaataaaatcaagttacttggtatgtacctttgcttctgttaaatgtacttctttttcttttctttctttctttcttttttttttttttttgagatagagtctcactctgttgcccaggctggaatgatgcagtagcatgatctcagctcactgcaacctctgcttcccaagttcaagcaattctcctgcctcagcctcccaagtagctgagattacaggcgtgcaccaccagacccagctaggtttgttttttgttttgtctttttaatagagacggggtttcaccattttggtcaggctggtctcaaacttctgaccccaaatgatctgcccatctcagcctcccaaagtgctggtattacaggcatgagccaccatgcccagcccttatttttctattatttgatatatctgcttaaaataatgttctttaatacccaactattgcaaatgagacagcagcaaatgaactctattttccatctttttctcccttcttcctcttatttttttgttagcagcatcatttctacgttaccaaagcttttcatatgtatgttctgttttgccacccacattgttttcatcttagctcttcagtaaatatactcaacactcagcactgatcatttttgtcatcgctaggttgcctgagtattgtcctctagtcattttctcataaaggcaagaaatgatatttcccaaatgtcacatttttttcaaaactgtttgcctttagactttttatttgaagaacagtcttactggatctaaaatttctgacatattttatttcctttggtttgtatagatatttctccactgtccttcgacctagaaggtagctgcggagaattctgagaccaacataagttttctcccttttaagtgacttggtctttttttgtctggctgttcaattatttttctttatatttaaaattcagtaacataggatatggctttgtgagataatataaaggatcagattttccaactaagctctcaagaattagacctgcctccttattaataattcaaaggacatagtgactgcaagagacggggaaagcatgaagtcaaagtgtcagtgcagctcctcaagtcctttcctgccacactgggacactgttcccggctgagcagctgaggactccaggtgatgtgcgaagagtattgctttttttttttattattctctttccttccttccttccttccttctttctttctttctttctttctttcttttttatttagacagagcctcactttatcacccaagctggaatgcagtggtgtgatcttggctcactgcagccttgaccttccaggctcaaatgatcctcctgcctcagtctcccacatagctgggactacaggcgagcgctaccatgcctggctaatttttgtatttttttgtagagatggggttttgccatattggccaggctggtcttgaactcctgggctcaagtaatctttcctccttggcctcccaaagtgctggaattacaggcatgagccactgagcctggccttaaaatagggtattactttcaatcatgaaacagcacaaggtatatccaataattggcattttccttcattttgtttccactaggttcgaagtgaccatttctcttttccttcctttctccccagacatcctcagggtagagaggatgagggacagaccagcttctaacccttcattcctacctggtgttgatcattctgggtcagttttccttgacatagggtgtgctcttccaatatgtgggttgccgtggtcggaatgtttgtgtgactccaaaatgcatatgttgaaatctaatgtccaacgcaaagtattaagaagtgaggcctttggggggtgattagatcatgagggctctgccctcatgaatgatattaacacccttagagaatgagcttgagggagccctttttgcactttcaccacgtgaggacacatagaagcaaccatctatgaagaacaggccctcaccagacaatgactctgctggtgccttgatcttgcacttcccagccgtcagaactgtgagcaataaatttatgttgtttacaaattacccagtctaagatatttggttatagcacttcaaactgactaaacaacaggttcaagtcttcagttatttcaagaataatttctttaatgaaatattttcatattcgttctgtttcagtgtattcgctgtcctcaggaactccaagtatgcatgtttttaaaatctccatgcctgtcttctctacctctcactttatctttcatcattttatttaatgttttacaattttttttatttcaatagtttttggggaacaggtggtgtttggttacatgaataagttctttagtggtgatttctgagattttggtgcacccatcacctgagctgtgtacactgtacccaatgtgtagtcttgtatccctcaccaccacgtacccttccccctgagtccccaaagtccaatgtatcattctcatgcctttgcgtcctcatagtttagctcccatgtatgagtgagaacatatgatgtttggttttccattcctgaattacttcacttagaataatagtctccaattccatccaagttgctgtgaatgtcgttatttcgttcctttttatggctgagtagtatctcatggtgtgtgtgtatgtgtgtatatatatatacacacatacacacacacacacatatacacatatatacatatatgtgtatatatgtgtatgcatatgtctattttgtctatatatgtatacatatatacatatacatactttgtctatatatgtatacatatatacatacgtgtatatatatgtatatgtgtgtgtgtgtatatatatctgtatctatatctatatctatatatatagatatatatcacattttctttatccactagttgattgatgggcatttgggctgattccatgtttttgcaattgtaaattgtgctgctataagcatgcatgtacaagtatctttttcatgtcatgacttcttttcctttgggtaggtacctaatagtgggatttctggatcaaaccacagatctacttttagctctttaaggaatctccacactattttccttagtggttgtactagtttacattcccaccaacaatgtaaaactgttcccttttcaccacatccataccagcatctattatttttttattttatgattatgaccattcttgcaggagtgaggtggtattgcattgtggttttgattttcatttccctgataattagtgatgtggagcatttttccatatgcttgttggtcattcatatatcttcatttgagaattgtctattcatatccttagcccactttttgatgggattgcttgattttctctttctgatttgtttgagttctttgtagattctggatattagtactttatcaggtgtatatagtgtgaagattttctctcactctgtgggttgtctgttaactctgctggttcttttgctgtgcagaagctttttagtttaattaagtcccatctatttatttttgtttttgttgaatttgcttttgggttcttggtcatgaagtctttgtctaagtcaatgtctagaaaagtttttccaatgttatcttatagagtctttatggtttcaggtcttagatttaagtctttgatccatcttgagttgatttttgtataaggtaagagatgaggatccaacttcattcttctacatgtggcttgccaattatctcagcaccatttgttgaatagggtatcctttccccactttaagtttttgtttgctttgtcaaagatcagtatgctgtaagtatttggctttatttctgggttctctattctgttccattggtctatgtgcctatttttataccagtaccatgctgttttggtaactatggccttacattacagtttgaagtcaggtaatgtgatgcctccagatttattctttttccttattcttgctttgcttatgtgggctcctttttagttccatatgaattttagtattgttttttctacttctttgaagaatgatggtggtattttgattggaatttctttgtttctagattgcttttggcagtatgatcattttcacaatattgattctacccacccatgagcatgggatgtatttccatttgtttttgtcatctatgatttctttcagcagtgttttgtagttttccttgtagaggtctttcatgtccttggttaggtgtattcctaagtatttagttttttctttttgcacctcttgtgaaaggggttgagttcccgatttgattctcagcttggtcgctgttggtgtatagcagagctactgatttgtgtacattaattttgtatcttgaaacttggctgaattcctttacaagttctagaagctttttggatgagtcttgggttttcgaggtataccatcattatcagcagcaaacagcaacagtttgatttcctcttcaccaatttggatgccctttatttctttctcttgtctgattgctctggctaggacttccagtactgtgttgaatagatcttcaatcattttacattccctattgcaatttgactttgcttaatttttctaatttctagtatctatctgtttaccaagttttccctagtgcaattcttcctttgctcctgtcattttgatttccatttctatgatttattattcttttagctctttcctgagtgctgtcaacttgcttttcattttctccagtagtcttgctgtctgtgccctgagatcttgtgtttttgctttaagggctcttaatattgaattcaatcagaggtttaatattcaataagagatttcttggcagttgtgtctgtgagtatgtgtgaatatccttcctctaataattttcactactctttcctgtatttttttcttattatatcaatgctatgctggcttttgtttcaaattattcactatcacataagtcatattttccagctaattgaaagagcttgcttgagagaaggagagtcaactccatgaagatagattattcctatgttattgaattacctgggaagaattatcttcccaaatcaacctagcagggcatccaccctcagcctgcactgcgcatccttgttttgggatctgttggtctgtcctgaggttcatcctttgcactggaagcttctgagtgagccctccctccagaggcagagattgttttcgctcgggtctgctgccacctggccagctggcccttccttcaccaagcgtctctgctccacttccactctgcatggcctctgctcagtctcctttccatcctcccagatctagcagctcatgctgtgtgcatgggatgtggagttatcactttagggagtgagtctgccacctctagaagctgtgttgttgctgccgtgtcctgagccctgcctcctctgaacgtcctgctctgcacccccatgctagcaccaccacagttccccagttgtggctcttgagctggccccacctgtctgggctgtctcaacagttttgggtttgcctggatttcactgcatcttgagctggtaggggttatactgtgcaccaccccataggcacacacagagccaggcagtgtggtgaacaaaggcaaatgttcaatgaacactcatttcaaggtcttcactctaaatgagaagatcccatctatcccatgttgtcttagtctgctcaggctgccatagccaaacaccagagactgagcggctggaaccacaaaaatgtataatctcacatttgtggagacaggaagtccaagatcaaggttcggccaatttagtatctggggagggctcttttcctggcttgcaggtgaccaccttctcactgtgcactcacatggcctttcctggatgcatgtgcacagggagagagcgggagcaagctttctggcacctccttataagaacatgaatcctattagatcatctgacctcgtttggacttaatttcttccttagaggtcccatctccagatacagccacactgggggttaggacttcaacatatgaatttggggaacacaaacattggtttataacacatgtaaaccacaacttatggcaggaaatgatgtcatgagaagtagaattaaaatcaccaaggagggaatggaagagaagatgctccttcccgtcagattatgaaaagggtatcatttgaactgagatgagcaagatgggtaggctttgtgcatccggagatggggggatgctccaggtgcagaagccagtgcaagcacaagtgggcaaacataaggcactagactctgggctggagcggtggagaggtggggccagctcaagagccacaactggggacctgtggtggtgcgagcttgggggtgcagagcaggacgttcagaggaggcagggctcaagaaacggcagcaaggctactgggaaaaacaccctcaggagtgaggaagagcagatcattgccattgaagaagcccttggctcctgtggagagatctgagactttgcctcagcacagtcctcaaaggtatctgcatgggatggaagtggggtggcagcagctggcatggctggagctgtaccttagaaagggtaagcttgcaacacaatgtaaaatacattggacagtaaggccagatcaaaacattggcgtacaactgctaaaaaataacaatagccaaaaatcaagatgaatttttttttttgctatatgaaatctagatagtgtacatttaatttcatttaatttcagaagtagaaatctatagcaagatctctagtaaatgaaccttcaaatttatcattatgaagacaaaatttaaacatcttatattcaataattaccaattctaagcaaaattcagaatccatagagtaataatatataattgaaatacagtgtatatgagtcaggctacattgagctaatcttttgatctagtaattcaacagcataggaaaaggaatgaggcccacccaattttggcatgcattccaaattcaattaactttaaccgatatcttgacagcattctttcctttcttattaaaacaaaatctcttaaatgttcaagataaaatcagatgagtatcatgtgcacaagaagcagatcaagtttttcaagaatctttaaaaataatgtagattaaatcaatagaaatagaagcattaatttgaatattcagaacttttttaaaattattgtttgggtcacttgaaaaaaagggcaattttcttttccttattgaataaagcatttggataatattaagacatttaaagtaagccaccagagaagaaaaatttcaccatagttacgctcattgtaagtcaaagactttgaggtgatatacaaattatgctgatgttaatatacacacagacttaagaaaaagaaattttcccaccccaccaagtaattagcaggtcaaatctgtcctcttagagccaaaaagtgaaaatctaaatgaagtccttggtcaagaagtcttgactgaaaagctacctcctgtgtctccaatttaccccctacaaaaatatttatttctcttatctctttatcaaaagaaattcatctgggccaggtgcagtggcttaggcctgtaatcccagtactttgggaggacgaggcaggtggatcacctgaggtcaggagttcgagaccagcctgaccaacatggtgaaaccccatctctactaaaaatacaaaaaattagctgggcatggtggtgtgcgcctgtaatcccacctacttgggaagctgaggcaggagaatcacttgaaactgggaggtggaggttgaaatgagctgagatcacaccactgcactccagcatgggcaacaagagtgaaactccatctcaaaaaaaaaaaaaaaagaaaagaaattcatcttaaaggttttggatttagccatgacaaggcttacaccatccagtgtgtacttttcttcactttcttttagacataaaaaacaatgggaaacaacaatttctttctgcaaacacatggccccaaattgctcaatcatcaagcccttctacaaggaaagcctttgcacccattgctacaatgacctgccactggggcaaattttgtgtaaacatgtaaattttagtggttatcattttattaaaaaaagaagctcttgaatgttttttactactgattcttggcattctgtgtcttttgtgtatgtataatttaaaaatcactttgagcatttatgcacattactatatgacatgataattttcatgcaaaaaatcaaaatcaagttttagattaatttaaagggtatctgtaatatacactcagtttataaatgtgggtgatgtgaatgtaaagagacagacatgacctttcctgactctggttggtggcagatgtgtattttagtgtctgagctttccagccatgaacacaacattcctgatgatttccaaaaagcgcttaactcgaagatgtggaaattgcaatgaaggaatcagtccttctaacttgtagccagcaattatatatccaaaaagattggaactagggatcaaacctgaacaaagaaatagatatgcaatttgattaagattatgtttttcagattaggatgccataaacacaatgttatggataaatcaatgtgttaggtttttccaataaaaacaaatttagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaatttaggccagatgcggtggctcacacctgtgatcccagcactttgggaggccaaggccggtagatcacttgaggtcaggaatttgaggccagcttgaccaatgtggtgaaaccccatctctactaaaaatacaaacttagctgggcatggcggtgcatgcctgtaatcccagctacttgggagactgaggcaggagaatcgctcaaacccaagaggcagaggttgcagtgagccaagatcaaaccattgcactccagcctgggcaacaagagcaaaactctgtctcaaaaaaaaaaattaaatagggtttaataaacagatttattttgaatttttaattattgcaatccaaagaattatacaattataaaactgtaggttttctggaagattatcttgtccctcttgccatcctgcataaaaacaagccaaggttcagagagtttgctgccagcccggggccaggccagcagctgctggacgttctgacctcagtcccagactgtcagctcctttagaggggagtcatcttccgttccagccggtatcactgccctctggccccacagagttcacgggcatgaatttcttccatgcacatgctgaagaacagtggtctggcagagagccttgaactaggaactgggagatgtgagtgattattagaaaattgctcattaaagctcatagtgtgtttaacagattaatgttattttattttagatatttttattttagatttttaaaaccatcttattctagatgttttaaagcaagaaataaaaccggtattgaaacacatgacatcacataagtgctcttccagcatcttgatggtatttgagttctggatgtccagagccgcccccaacccccgctccccgcctcccttctgatgcctctcagggactcggccttcatgtgtccaaaggcaaattcctgcccttctatctcctcaagcctttgtcctcccctgttgcccctgctaaagctgttgccatctatccctttgcacaagagaaatacaggtatccctctctctcactttatcaaattcaacaccatgttctagctgttttttaattttccaaaataggtcttcatttctctaccaccctaaaccaagccactatcatcacattgcctggggcagtgcagtagccattgaccttcacacccatcaaatattgtccaaacagcagcctcgactcaaaatcagtcatgcactggtccacttgagccttccttggcctccttttggcccttagaataaggtgaccacccatcccagggacctcagggccagcatcacctgactcctgcctgcttgtccagcctcccccagacacccctctccccaccccacctgcaactccaccggactcatctctgcttctgaacagatccaactctcccctaccgcagggcctttgcgcaaacccttctctttgcctgtgatcctttacgcccctgtctccttccttgttcgtccctcccgcttcccctgacacatccccactcgggcagcacccccaccccgccagccccagtccaggctagatctcccgtctaagctcccacagcacagtagcagtgatgatttatttaaagctcctcttccctgctagagtgaatccccatgaggtcaaagaccggatcttttctgtcaaccactgtatcctcagttcctagcacaatcctgacatctttaatctctgcttcacatcatggcgggagaagccaaagggccccggagatatttgccagagaagcaattaggaaaatggcccagcccagagagctggagcagaaatgaagtccaaggaaaagaatgcaccgtccgtgatggggaaggaataataaccacagctcctgcacaggcagagcagctcggatgcctgtgtcataaggagcagagctgtcatggatgcatatactatgtgcggctctgtataaattcctctcaggtagatgacagcatctagcaaagaacattgcccacagtaggtgcaccatccgcctcgaccggtttgatttgactgtagactctgaaaggagcctcactgttcagctaggctgctggaagggactgaatgactccatcccttcatgacagaggctccttgtcttgaacttggaggaaaatgctctattgcatggttctgtcgtgtaaatcacttttaaaaattattcttccctctataaaagtatgcatattttggagcatgatctatctttatgcaagtggaggggtgaacggaatatttcatcaggataaccatttactgacaattcatgctattttatagtccatgtcttttggaatggatgggagtttgttattcagtggtttataaaatcttccagactgaatgatgagctcacatctgttacaattggtatggaaagtaaaactggcgtgagttgtccataaatatttattgtcaggaaatatcagtatgtacagctgtttttaggaaaataatgcctattttattattgatacataaagtgggacatttatgtttactacccataataacacaggtagtaataaaacaatattctgtaaagagtatcagagaggcagaaacaaagatgaaattttggtttctaaagcaagttttacaaaaacattatttaaagaccatactactattctcaatccctttcaaagtgttaaaaaactttaagtcagtcaagaattggcaactaattttcagaatcaataatatgatcataatttctgccatagaaaatggctttgctgtcaaagaccatcttgagaacaggcagtatatccatgctgaattcaacagttcttacctcctaatgtgagccttggtcatctggaaagaaacaggctccttactgagttccatatcgtcccttcctgctccccaaaaggcttttttgagggaaaactttccgcaacaggtcactttaaaactacataaatatgtatatgtggtatgtaagtgtatggatgtttatgtacatgtgtgtatgtatatgcatatgtgtatttatgtgtgtgtttatgtgtacacgtgtagatgtatgtgcatatatgtaggtgtgtatttgtatatggatatgtatgtgactgtggatgtgtgcttgcatatgtgtagatatgtgtatatgtgtttgtgtatctgtatatatgtatatgtacatatgtgaatgtgtgtatgtgcgtgtgtgtgtgtgtgtcttccctcaaagaccatctgattatttttcccatgcagcagatagtacatgagtagtttgcacctaacttttaaaagtcttatgcgtatggttggtggctgtcggaacgaaagtgatttttcaggacaatgtcaggctgcagaatcaagggccctgaggagagaaatggcaggcaaatgctggggtcgcatttgctttggtgttccttgcaggtcaaaaagacagcaagctcttgcctttcactttgcaaaatctgaacaacgttttggaaacctggtccccactgctcttacagaagggaaagggacccctcaccaggaagagccagtttcccaaccccagaagccggggaccctcagccctcccagcagccttcgccgccacgtttgtccccacaggccgcacacacggccatgctcacctcctcctgcggaggctgcccaggcccctcacagcccgcaggatctgggtcacacctgagccagctctggggacacttcgaggctctgcatttcttacatgtttcttttcaatcctgaccttctcttagatcaccccaaagggacaccccgagccctgaccatttacacagatagtcttttaacacttggaatggaagcatttgagcaaagaacaccagaaacagaacaccagccagtctcctgccagatggatgacattattttccactcatttaacagagaaaaataattgaacgaggaaccggggtacatgtgttgctctgagtgtggcgtgcgcagttgggaaacctcagaacggtgtggcccgaccgtggccatgctgagggttttgtggtctggaggttcctggagattttcaggatctcacattcagaatcccacattttcagaaacaccacagaagaagctatttatttggctttgttgttttcttaaaaattaaggaaatgatttggagagactaggcctccgggttcttgcttttcttttccccacagaatttagacattattcaaacatttattctgtatcatctttttagtttgtttttcaaaaaagacatttatcttgtgataatggctagttgcagaagctcagtgagattctcaggttttcttaattgcaatttcgtctcatgcgcttgaaatgccaagcactaatggtgtttgaagtggggctggcgtctgattcaccttcagagttatcttgagctttcagccacaagaattttaaacctgacagtggtaaagaaatgcccttctttcctgattgctccgtgtgcgtggtattctgtaaccgaggtcattaaaggtagacgtcacagtggcaagagcccgacaggcctgtctcctggtgtgccacctccatactttgggacttacctgttacagtttcttggccttgatttcctcatctgaaaaacaggagaataagctctgttaagcaggatcagtacaaggattagattcacttattaacattctcctacatttgaaattctaaatgagcacaaaagagtttcgcgactgtcatacctttgaatgggaactaataaaactaaaaatcccatgttgccaagtttataatgctgattcattttatgcatcactttgcctgaagtttcagcataaaatgtgctctcgattatctaagaaaaataatgcatagagaactttttatgaccaaatactcgtctataccactcaacacttttgaatggctttcccaattaccttcccggaatatacagggaccataaattagttctacagaatatctaaaataactacaatttagggggtatgtgtgtagcaaaacatcatggaatgcactctaaagagaaatacatgtgaattcagattgcatgttcttcaggagggacttattcagatgcggcccttccttagtgcaattaactgtgaactgccacagtgagatcagaaggtcgtgcccagcaaaggtgaaacacagtgataaaagcagtccctccatcagcgaggacaggctcaaggtcagccagttgccattgagatgctagactgtggcatgcagatgggagcctggaactggtcgctggaaaccacaccaacaaatttggaattccgtgcactgatatctaccccacatgagcagaaactgagtttggccgtggaccgactgaaccctgcgccagttcccatgtgtcaggactcgctggtgtgcagagtatttgctgcggctttgatctcattgttttagtttactggctctcctgatttggcattaaatgcgttagaacctaatcagttccaagatggctttcacgatgcggttccttttcctaactatttccaaatcaattcacttagggacattataggttaagagtagttgttgttctcatatgaatcttgagtcagtttttcttttgtaaataacttcattctttttcattgacctcctcaatatttatttctaaatatttttaattttttaaaatacttaagatttcatttgaaatagaattaaatgaaagttaaggaagccttatcatgaatccagttctgcaatgtcattctattaatagctgcagtctaaataccagtcccagccatcacagcatgtccatcgggtaaatcctcactacgtgtggcgcatgttgtcctccccagccctgtactagtccaggagggagttattctgctccctgctttacctatgaggaaatgaagaccgggagtggggacagggggagctggtgccagggcagggacagagcttgtgccccccaccttgaccacagcaccactcagtcctcttctgttttttttttctttttcttttttattttattttattttgaggtggagtttcactcttgttgcccaggctggagtgcagtggtgccatctcggctcaccgcaacctccgcctcccaggttcaagtgattctcctgcctcagcctcccgagtagctgggattacaggcatgcaccaccacacttggctaattttgtatttttagtagagactgggttggtcagtttataatgaccacgttagtcagtctggtctcgaactcctgacctcagatgatctgcccacttcggcctcccagagtgctgggattacaggcatgagccaccacgcccggcctcagtcctcttccagttacccactaccctacccagaagtcacggccaatccccaccctgtgccaactccaaattcacttaattatcatacgcacatgtgcgcatgcacgcgcgcgcgcgcacacacacacacacacacacacacacacacacacacacacacacagcaatcactgagtgaccatcttaatggggattgggttacattcataacctattttgtaggagagaattttccaagggaccaaaaacgttgaccagacccaaatctaaaaagtattgctgcccctgcgcctgtgaaaatgcaagggactgagccaatgggaagaaggtggggagaaggggctgagcgccccgcagcctgcccccacccctggacctgcggctgcctccacttactcctgggaacctgggcaaaccacttcacttctccaagcctccattgcctcaactttcagtaaggatgctaatcatagcacctgcctcacagttgagttactaagattagatgaaataatgcatttaggcacagttcagctcctggcactagaaaatattcaacggtgttagcactgtcgctattactgtgtcatgactcaatgggagagcacttaagctagtgccttccacacaatggtcacttaaaaatgtccttagttaaatgaaatcggatgcgcatgagttcagcgtgaggtccgggtcagggagaggaaggggcattggcgggtagggttgcgtcggtggggcctcctctctgcctctgactggcctctttgcccctctgctttcctggtcaaaggttcgtaagcaaacggtttctcccactcctcggaacatggacttcctttctggaaggcactggcctggccatttacctcaaatgccggtgttcctggcttcagtgcccggctgcccagcggcctctccctgagtctgggttctcaggtttctgctccgcctctagatgacccctctgcccgccagagctggcctgcgggtcaccctgcaagatgaccctctgcctgcccgagctggcctgcgggtcaccctgcaagatgtcccctctgcccgccagagctggcctgcgggtcaccctgcaagatgacccctctgcccgccagagctggcctgcgggtcaccctgcaagatgaccctctgcccgccagagctggcctgcgggtcaccctgcaagatgacccctctgcccgccagagctggcctgcgggtcaccctgcaagatgaccctctgcctgcccgagctggcctgcgggtcaccctgcaagatgacccctctgcccgcccgagctggcctgcggggcatctgcagcccacggggccagagacccggatgcaactatgggcccgccccgtttcctcaggcagctagatttctcttcatattccttttccaacaaacgtctcttgaacatcgactgagttgatagacaccacggagcctaattcttgtaaatgagatattttcacagtaacttcagaacgtggtatttgtcaagggcctctagagaagcaccaacattgctagcgcttaaaagaaagacaaatgtcttccgactctggtgattcagagatcaaggcaccttcacagattttcataagcagagctggggaaggaactccagcaggaagaaatgactcaaggccagatgaggaggtggggaggccctgactcttgtctgggggtaacaatcgtggtttaactggatcctgatgttgctgtgagggaggattagaagacaattggcctgaagcccatcacgtagggcttaatgccaggccaggggagctgaaatttattcaacagataatggtacatttctgaaggttttccccagtggagaaatgcaacacgagctgagctaacgaaggtttaagtaggcagtggaaaagggtgaatttaaagggatagagagaaggcaggagagggcggtggggaggttattccaacaggaaggtaaatttggagacagaccataagggacaacgtgcggtggtggcaacagaaacagaaaggaagaccgacctcgacagtcgaggggctgggggataggatgggcttaagccagctcctcctgcactttcacaagtggcaagacccaactcttttggtagcgtaatccagtgtcttaccatttttcatggaaccacatttgcactaaaatgaagcataagaaattcagaatggaggaggaattgttatgggaaactatcactgggcccatggctttttgttttgtatttttgagatggagtcttgctctgtcacccaggctggagtgcaatggcacgatctcggctcactgcaacctccacctctgggttcaagcaattctcctgcctcggcctcctgagtagctgggattacaggcatctgccaccacgcccagctaatttatgtattatttatttatttatttatttatttattagtagagatagggtttcaccatgttaacaggctggtctcaaactcctgacctcaggtgatccaccctccttggcctcccagagtgctgggattacaggtgtgagccaccatgcccagtccccaatggttgttttaaatggcacacaatttgaaaacatctaaatttcctgaccatttggctaaccttaatactctttaataatattaagtaatctaaaccagattagttcaaagttctgtttctttcgatttctttaaaaagattttcctccattccttgtgcgttgctattacagaagacgattgttaccttctgatcaatgagcaggcgatctcacaaacttgcaaggatttttttcaaagatagaaatagatacagattgatcccgaatgtaaaaatcaagcatagtgctaatatttagacattttcccagtgtatccagggattatttgagtcaccagaaaagatttttcgtgacttttctttattcttaacatgaaaagtttagcagcaagtcaagtttctggaaaatcctatgaaccatcttgttctttggagagcttaacgacacctaggtcatcaacaacaatcaacaatgaactattgatttcagctgtaatgatcgaatagcagtgccttaaatccttcctggcagggatggcagcattgcatgcacatgtatatgtgcacgtgccagagtaagccagtgtgtgggcaccaaagttacctctgtggtttggaacatccagaggcccaaagccagcccttagctccgtgcaggtaaaaagggtaagaaagtgcaacagttaaagcaatacaacggagtgaagcctcctgtgcttatttctaagtaatcaaagcagctgtataaccacaaggcagctgtcccaggccgactgctgaccgtgtagctgacagttacatcatgaactaagggaatgtgatttttagaaatttcacttattacctacctacccatagttcatgagatgaaaaagttttgtaactaaaatatgtaacttccacataaagaatcggggaattaagaggacatataacaacaagataaacatacataatgaaggtccacgttaccattagagaaagtgaacataaatactgaaatattaaagtaaggtatacagggaatataggtttacagtgttgtgatttttaagtagaatttttaatcatttttggaaactaaacaaaaatccagaagaaagcatatgtttttctcatcataaatataaaaaaaaactgtgaaaagaaaatggcaatactaaccacattttgatacattctcataaagtctagtaacaataacttctagcactttaaagttttctagttccgacctagattttatttttgccaagatacaacctagcctgatagctccaatagcaattacagaatatgacccaattatttctttaccccccaaaaaaattaacatttttttggttaggaaacagaagatattttaatgaaaatgatctaaaacaaaaaatgcaattgtggtaaaatagatgaggaaattgtacttctttgtattaaaatatttttcataaaacattaaaaatatattaatgagaatttaatctcatataagaaagttaatatgctataatattgctttatgtatgtttatacgaaattgcagggaagtaaaacaaattatgtcatcataatattattttgtatcccctacagaaatatttttctaaaaccactaaaaaagcatattacagacttagtgaggaggctacctgtaaacaaattattttcatggagaagcaaggaaaattactaaaaacaaaatttacatttaaaatgtagtcaataaaggtcaggtggtcaatgttggtctcagttttccccaaatgtaaaatggcagcccaaggaaaagagaaccgttggacaaaatttgaaaggaaagacatatttttaaggatcagttaggaacaactttttattttcttttatagtaaattttctgacagccatatccttgcatttaaattctaccaatcacagtgactcaaaattataatttgtaattataattgttaattgcttaatgaataattaatttcacagataacttgaaagctatagatggatgatagattagctagataataatagagaattttaagattagaaggaaaacagttttcatctgaataatatgtccattataaagaaatgttttaagtggtattttttatttcactttgttttcatatatatcacaactgaatttctcagccagagcatctataaagacatttcattattttgcatatggtggtttccctttgatgtttggtggttgaacttaacctttctgtaccatgggctcctcctctgtaaaaatgtgagcagtaacattatcaactttccaaggttgttgtggggattaatgagaattcaaattaaataagctaaatgtatttaaatgcttagcatagtgcctgacacacagtaagaattaaaatttaggtcaaaccacatgaaattgacattttttagccaaaaatagttgaatattggcaacgttatctggttcattataaagcagtattcacttttataattattctaggctacgtgcctatttttaaaaacgtaaatgcatacaaaagaaaaaatgacacggaccaaaaagtatttaaaaccaagtaatccacagattagggggagctcctgtcctaaagtgattacaagggcgaccataaggaatttctgtgttaattggcttggccacaccgacactgagtgcccttagcaaggaagcagactgtaagggaaacagccgaggcttcagctttaggttgacctgagatcaaatcccactttgacaatttgcttatccgtacagtgggtagatttggaatattaatgaatgcaccatgaactccttgaattgatcttattacggaagtgaaagaaagtaacattttttagcaccccataattgtcaagcttttggctaggtgctgtctataaattagttcatttaattgttagaactatcatgtaagaagcactgatactgttattataataatgattataattacagcaaactctgctgcaggacttactagtagatagcagctgctttgcatatataccctatttaaccttcacagccacacgctaacatagatccctgggaggaatattcgagagtttttcccatcttcttcagcatcatggccaacctcatagaattaaggattaaatgaaggagcatacataaaactcctagcctgatgcctgacaccttgcttcccacagggccaattcagggtccttgtcccatgccctgaggccctgagtagccctggccttctgctatcagaagggcttccttagtaaaccccacgcagttctaagctctataacccagagcagcaggaggctgtcttcataccgcagcccctggggggtgttaggagactcgtggaaacccattttactttattcttcaggaaatataggcccccaaagtctatttcttgccaaaagctctaatttgctatcttatagtggtcaggtttttggggtagaatagtagaactaattaaaaagggagtccattgtgttccttcaagcaggaaacaatcataacaggacttaaaggaatttagtattttgagtaattttcttcaccttcaggcattttttttttgagacggaatctcgccctgtcgcccaggccaggctggagtgcagtagcacaatctcggctcactgcaaactccacctcccgagttcaagcagttctctgcctcagcctcccgagtagctgggattacaggcacccgccaccacgcccggctaatttttgtatttttagtagagacggggtttcaccatcttggccaggctggtcttgaacttctgactgagtgatccactcacctcggcctccaaaagtgctggtggaattacaggcgtgagccactgcgcccagcccaccatcagactttttacatggagaatgtttgggggcccagtgatgtagttctttatgggattcataaagggtttcctgacagacacactactcgagtaatgactgtagcacgcagagatatgtgcagcccagccatttatttcactcattttaatgtactttgctctttcagacagggcaataattagacctgccagtagcttttcgatatgagaaaaaccactttaaatgctccacactgatttctgtaaacagcttgctttttcttaatttataatgttatctcttctaacaggccataactacataaagggacatgaaaaaagtaaaagaaataccagataatttcgaacttaagatcacatgtactgaactatctatccaaaccattattttaccttaacttgaatagctgtcaattgtcgatctgattttgcaatagctcactgcctatcagaaattccaaatctttttgtaatgtttgtttttaactttcaaacctgctctcaatgtaatatctttcttcctgcgacgaagctttgtttctttagttaaattgaaataagactatgtaaagactttgtctccctattattcactaaagagggtgaacaaaatcaccagacctcaaaacaaaattgacaccctggtgcttactggtgcttaaagggaatgtcagcacacccactgaaatacttcttcagtggaggtcacggttcaggttgctggcatggttttataaggaggctcgtgttgcagctgtctgcactgtccctagcctgaagataaatagcagacttcagtttccactgctactggtcttttaaccttcaataagaacaaatacttctgccttagcttcatctgcctccaagttcatctcccaggacctagtgagctatctcttatctatctccttcccagccttcagcttgggcttcctagagctcaagagcatcccagcccactctcatctttagaggctccccatacattaaaaaatgtagaaatgccaacacaagttcaaatcaattgcaatatatcatgaatgtttacattgaacaaattcacacttttcacatacaaaccaaaataacaatgactttatgtgtagcctcattgagacttaatccaacttaagacactttgtaaacctgagcgctgcacccagaagtgtgagttcttgcctctgattagcgacccctcacagccacctgatgggtgggtgggtgtgcagtcataaggatgtaaagcaagctttttagaaacctaattcactgtaaatgtccctccttctgtatatgaccatcaattcagcttctcacaatgatggactgaccgtgcagtgtcctctgcattgcttaacacaatccctccaattcttcggtgcccaaggtggtggcccgggatacctgggcacctttagaagtgatagtgactcttcatcacatctctctgctctctgaaatagtgcttattgcatcgaccaaaaagaagtgaatgctggagtggcttgtgcatgccaaaaaatctaacttctgagatcttctggtctactccctagcttcccagggtgataagatgagactttgttttctttataacctctacccagtagacaaataggccaaagataagaacaaatcactctcacaaaggaaaaaaaaaaaagcccacacagcaaaataatacatgggaaaaggttaaccctccttagtaattagaaaaatgctaactaaagcaaccttagagtagcattttatagacgctggattggcaaacacaattttacttctaacacccaatgctgtgataaagcaggcacccgtatgtgttgctggaacatcatacactggcctaacctttctgaacaatcaatgtggcagcctataccagtaaccacaaaatgttcatattctttgaagcagtaacctcacttttgagaattctttcaaggaaataatacaactaaggaaaaagactttatgcacaaagatgttgattgcatcactcacaaaaattgtgcaaatctggaggtagacttaatgtctctagccaaagaagaacagctgagtaacttgtattccttccactccatagctattaaacagccatgacaaatgataattaggtagagtagatatcaatgttgaaaatcccagatgccataactcagtgaaatcatcctctccggtaacaacgcattccaacctcaaggtctttgcctttgctgttctgcactgcacgttcttctcaagcttatttctttctcccaagccgacttctccacactaagatgtcagcttaaatttaattttcccagggagatcttctggatcatcgtgcctgtagtggccccccaagtccatctctaccacatcacctttccgttccttgccaggacttctcactctgaagtactcttatttaatggttggttacctggcatattaccggactcctctgccagaatgtgagccccctagtctacattcccactctagtccaataatctatcctcagctgctgaagctctagaacacagctggtcttcttgaaatcacagaatttggatgatgacatctgagttcatattagaagctggttcctgagtcccaccttggatttattgccttgttcttttatcctccgactgggaagccagtttacaaacagacactgatctaagcaccaggcaggccatgtggccaaatgaagagagctgtatttcaccaaggcgaatgctccagctgttgctctgggggtccttcccaccacccaagccccatagacgtgtcaggaaccatcagcctgacctgcccgccctgccctgcagccagagcctacctgtgatgaggagagtggaggacggagttggcgtcctcgaggccaggaaggttgcctgtccctcagcacttcctctgccagactaccttgactccccaaattcccaccactggagctgctcctttgagccaaaggtgtctgtaaaaactaaacataggccgggcacggtgctcgtgcctgtaatcccagcactttgggaagccgaggtgggtggatcctgaggtcaggagttcgagactagcctggccaacatagtgaaaccccgtctctactaaaaatacaaaaattagctgggcatgggggcgcgtgcctgtagtcccagctactcaggaggctgagccaggagaatcgcttgaaccagggaggcagaggttgcagtgagctgagatggcaccactacactccagcctgggcaacagagggagactccgtctcaaaaaacaaacaaacaaacaaaaatatatagcctagactgaggacccaccatcacatggcaagtctttaagtccagggtcttgctgatagaagcacgtagggggcacagagctcccagtacagatatttccaagaggctggaactaagtggaatgacctatccggaggccttgggcaggtgaaggacaacagaactctgggaggtaacactggggtgaagccagaaaatcagttgagccctttacccaggtctccatcaacctctggaggtttacattgtccagacctaagatggcaggcgccagacttagtggaagcttggtgagtgagcctgcttaccagagcatttgcctcagtttactcggcgctctcagtctactctgcagatgacgttgaatttggaagcctggtccagggcaggagctctgatgtctaccccatcccaaagggcctaggaccatggcgctgaagagtctggaagaggacggagggtttctttgggctcagaggccaacgtagcaatctatgcagagaaggtggcggtagatgcggggattttcgcctcagtagagaagcggagggagtctcctcgaagcctccgccctcactctcttcctgcagggaaagatgtgagccagaatgctgccaatgcctcttactatctcctgcttaaccgggctgtctcctcgtggccagcaacgggcaaggagatagtctctctgtcaattcagctacttatctgacataaattggaattataacacatgtattaagtgcctttagtgcctcaaaacacaaaatcaggaaaccggaatataaattattttgcaaatattaaatcccatagtgatactacaaaagaatgacctttttgtggcttaaagcacaagtatcaggtgtgcatttgaaaataaaatctgcttcctcccatgagtttagtagggccacgtccactgcttcctctcgtgagtttagtagggccacgtccactgcttcccatgagtttagcagggccacatccactgcttcccatgagtttagtagggccacatccactgcttcccgtgagtttagtagggccacgtccgctgcttcccgtgagtttagtagggccacgtccgctgcttcccgtgagtttagtagggccacgtcagctgctgcccgtgagtttagtagggccacgtccgctgcttcccgtgagtttagtagggccacgtctgctgcttcccgtgagtttagtagggccacatccgctgcttcctgttggcttatcagggctgcatgtctcacagtcagccagcagtctagggaatgggccagtcatgagctgtgctcctaaatttggaaaaatcaggaccttgtggagacaaaaaggaagtaaacagagctaccatccttcagatgaccacgtctgggtgccatttgcagaagaagagccagtcttttccccattcagttaagcaccaacatattgaactatatctgaaggaaaacggaacgattaagtgtaagcttaagctataaattgtttgctcataaagtcctacgaccaagtatcttaatcagagatgtaagcagggtgcaaggtaccagtctagactaaaaaaactcataaagggacatcccaaagatgagggctccaagttcaaggtgagtccagataacaatgtcctgctgtccctcatggcctgaggatgaagcagttgctctttaaaagtgttgctcctttgtgaggttgtagagtaaactcattttattaaacagtaaagcaaaaaacactccatggcgttctgtggggctatacttcctgtcctctcccagaggacagttaaatgatggccagtctactcttatctgggagctacagtatagacaaaatagcagctgcagtaataatagttgtcgaaatttatcaacagcacgttaaattaatataaacataatgcatattctcttatttttgtcctggaacctgtccttacagatggatattatttcccctgtttcagtggagctgggatgcatggccatttgtgttcaacaagagcacgcctccgcccctcaggggtcctgttgtttcatttccaagctgcctttgtccagactaatcttaatgtcctgattcaggggaaagccatcgggtacactaaactgaggaattttaagagataaaaatgtaactcggacaaataaacattctttattcaaaagtatcaaaagtcagcatatttcacctatcaacatttccaacaagcttcagtgtctattgtgcaaacccaattttgctgctgtggcaaattaaatggccacattcaaaacttccccccacagtttagatactgttctctctctctctcttttttttgtttgtttttttttgtttttttttttgtaagatgtggccaaaactttgattgggctttaaagccttaaacatttgtaaaaatatcaggcaagctcaagcattttcagactgtgtcctgcattaatacacttggggcaaagtggatgtctcttgccacatttaactcaccagtgtagaagctgataaaggctgatagccagagcttggaaagatatttctaggttatttttaactaagacagttgtaaaaggcgtgatggatttaactccgtcactttcagagcagctaactgagttcagccagcagactgctttgatttgttcattaaatgtattatgtttgcattacttgagttcatttgatgagatattcccactctgtaaaatatccagctaaggatttggaaatctattcaaattttgcatccattaattcattttagaattttcaaagagtaggtactttaggcaagctaagatatatcccaaatattcggggaaacatccaatctacagaaatggtgtaacgtgttttttcatcgtaagcacgattggtgagtttatccatttaattatttttcttgctagaacaagcagtacatcaaggccatgagaatcttttactttgtagctctgtgccccgctgtgcagcccagtcacctacaatgattcagccttatcttgttatgatggtgagcactgggatggctatgcaaaggcttctaagttctgagttcatcattttagaaatgcgtttccccatagtttaatgtgtttgctgataacatttattagaaatctgagatgagcagggtgagggggccaagcctgtaatcccagcactttgggagaccgaggtgggtggatgacttaagtcgagacgttcgagatcagcctgggcaacatggcaaaaccccatctctacaaagataaaaaaattaaccaggcgtggtagtgcgtggtcccagctactcgggaggctgaggcaggagaattgttggagcccaggatgccgggattgcagtgagctgagatcgtgccactgcactctagcctgggtgacagcgtgagaccctgtctcacaaaaaagaaaaaaagacatctgagatgaatttttatttttgtgcctcaatcacagaaaaaaaaatcagagctgaaaacaggttgtatctggcatcattaacattacctagaaatggagaagtctgatagcagctgccaggctggctcatttttaaaagttttcaccaccagtgtagaggtggttacaattatttccagtaggttttatcactcctgagggcagccatcagtagttcttttccaatcaaaatcatctattttgctgtttcgcgagctggttgaaaatcaccatgtagctatgaaataaaccatacaaaacaaaacttagatattaaatgaaagcactataaaaatccgatatgttcttcttcttggagcaaaagctgctaaaaagtaaatgggaccaggtgcagtggctcatgcctgtaatcccagcactttggggggctgagacggggggatcacctgaggtcagggattggagaccagcctggccaacatggtgaaaccccatctctattaaagaaaaaaaatacaaaaattagccaggcatggtggcgggcgcctgtaatctcagctacgcaggaggctgaggcaggagaatcacttgaacagggaaggtggaggttgcagcgagccgagattgagccatcacactccagcctgggtgacagagcaagactccatttcaaaaaaaaaaaaaaaaaaaaaaagtaaatgggataatctcatttttcactatgaacaaaaagttttttttcttctcaaatttaaagatgatccaggtaaaccccactttaagttgaggagtacatgattgaaaagcagccagatgaagctacctagctgtagagaccctccacatattgaagctcatttgatcgaacatttccaaattcatgtaagtgctatttccatggataacaactcacaaatatgtaaatagtaaacaaagaattggaattaggcacatggtggccactacacctaccatacactttatttagaactgagtttgcttatatcagtatctggatccagtaaacccacaaggtagcaatttacttatactttcattcattcagtttacaagtgcccaatttgaatttgatgcccacgatgaggtttataacataattaccatgatcctttccccccacgaggtggtagaatgcaaaagggctaagtaaacaggaaacatctattaagggttttagagtaacctggaaataagcagggaggggactacaggcctagtgctccaggaattcaaaagaaagaaagatgatgtggatgcaaaatcaaagagggagtaacattagccctgaaccaaagtaagcttgaacttaccaggaggaagaggagagcatattcccatggggaatttaggcatgaatgaaaatttcatgcagtggggtcagtaggaaatccagcctgagtgaagcaggaggtcccactgtggaggagaatgcaagtgaccggcttcgtgagggagatgagatcacacaggggccagacgactggggttttgaatcggatccattatagaacatggagacactgattattaaccagaaaagaaatgatgagataaattgttctgcagggtaaatcaggaagaggaggctttgaagatggaaagataaacagactattaactatgatccaggaggaactggagtgggaggcctggccccaccgtgtcccacacagcagcaactgcacaaagaaaggagggccaagggcagcatttcatcttccgagcccacactcggtgcctgtgctcctcacaggagccttctgcacttaccagggggccatctgagggcctccacaccacattcaattccagcaagaactgttggagaactgcaagaaccctttcctgaaggaaacccagagactctcctactcttcgtagagaatgggaaccttcaactttgattcctaaactttcccaacataagtgacttcaatgtggctttctggtttgtttcttaagaccattcaaatacttggaaggttcctcctttttaccttctcactctattcctgcgatcccacagttataggttctcctcgtgcctctggtccaataccaggcgtccgtccactaagtagcaatgacgtccctgggcagtcacgctcagcctgctcgtctatcttgtattcatgaaagccttataatttcctcatctagaagactatgtaactaatatctaccagactaaaaataaatcataataaatgcccataaagatgggggtatgaaatgtgaaattgatcctagactttgcccatactgaccatgtgtttatggcactgagagaaaagtccttgaaatcagtcggccttgatttttgtcatcctgcctgtatctctgtgagtgatactattttaaggacctgtaatgaagtaaagatagtgtaatagtctatgtcataaaaagtgatattttttatcatagcaattgactatcctaggaaacactacccggttggttgcagtggctacagtatctccccatcacttactcacctggaacctctctgctgatgatacggggctaaagttcttctgtaggtagcaaatgttctgctacctcctgctctcgctgtgatgacatgtgatgcttggacctctctttctgaaccttcccgccatcattcttgcacttcagcagattcttactttgatttctctttttcaggatcccagtatcacttactgcttacatcatttcactacattttctcacctctcaaaacctcaattttctcccctgtgaaggggaataataatagtatttagctcatagggctattcttagttttaaatgacctaatctttgtaaatgacattatattgttgttattattactccaccatgagataagacagcgagaaatagatttaacacagacagctggacttaactctctgctctttttttgaagcactctgttccccgaatcatgttggccaataagaaaagagatgagcttttacttcacaagcttgaattcagcttaattcaatgataactgaatctattgttataattatccagtagagggataaattgatgaacccacctatttttcttagtataactttcaggtcaaaacagtaattaatcagagaagaccttagcttgcctttttgtagtcttgaccaaatcattgtcaattggtatgtaaaaaagaaattaacccatataattggtctttaaaaagctatatagacttactgaaatagcagaatgtaatagcatttgatgtagggtgtcaacaaataatatgaattttgcacagtgctctcttaactagaattaattatataaacatttggtcttttcaggttttcttagaacttgacttgacacctgattttgatgcttatgaggtttctgacttactttgaagaattacatagttgctttgtgatcatcttttcagttgaaatacaggcatccattgaataactgtcatttctaaatgcttattccaaagttacattgtgatattataaaaagtaatattaggtgaatagaaaccagagagcatccaaagttcagtctttattcagaggcagtaactgagattcagagaagttaaataacctgcccatagttaaatagctagtgagttattgaatagtatagctactaagttattgaaaattatatctcaggctatttgccttgaagtccagtattcttttcactatatcagtatgatcccattgttagtgttgtacatttcatagataaatgaatctactttgcagttggacaacgacaattgtttagaaattgtcattgtctatgtgagggaaatttagatattgaattgactcttaggccaagattcatgatctcttcaggtgaccaatggccccattcagaagatgaaaacgtttcctcaagcttttggaaatatgatggcttagtaacctagtgctttagtgacccagccttcggtgtcaagaagagagaaagagaacgagacatccagctgggaatcgagtgcttacttcaaagcttttatcttcagaggaaagaaatcttgtgaatttcattaatgtcaacaagatctgagaagatttgaagtgggtaagcccttgggcatctctagcgtgccagatgccgtggttattgtaagttttggttgaaaaaccattgcaactttgattcacacacccatgaaccaagactttggaaatatccattgtaaggttgtatttaagggaatgtagggaaccttcggtttccaagagaacatgaagtcagccaaggaagcagtggctaagcatggcccagacacagaaacacccaggattccaaatggggaaacacacattatggttaagggggagaaaagttgagtcccctcaaagttacatagcaaagctaaaaaaatagagtgaaagaagcatttctttaggattctaaaagcagataacttcacggcttctccccaaaaggctcttctcttactcattgtttaaaaagaaaaaaaatgaatttggtcctaggttttcccctgcctctttcttttctttctcactccttcacctccagaaaagaccagattggaattcatagctgtttccctataattatctaaactttactggagaaaactcttattctaaaacaggtaacactatttctatatagtaaattcagtccaagctaacccaaacaaacacatttctggcaaaacaaatggtgacaatttaatctaggtattgaaactgtaaatatcttaaaagataaaatatacctgtagctttccttttcccctttcttaattcatattaaaaaaactcaaaagcaaccatttctaaattcgcaaacattatgagttattgttaatgactttttttagcaatatgttatctgttgaataaatttcttttgaaaatttttagctttatttcactaaaattgacatttctgcttaaaaaacaaggagtaaatacaaacaaggagtttctgttttggtcatctcaatcttttaactactaaatccaataaacacaaaggaaaaatttggctgggtgtggtggctcacgcctgtgatcccagcactttgggaggccaaggcgagcggatcacttgaggccaggagttcgagaccagcctggtcaacatggcaaaactctgtctctactaaaaatacaaaaattagctgggcatcgtgatgcacacctgtaatcccagctactcaggaggctgaggcaggagaatcgtttgaacctgggaggcagaggctgtagtgagccaaggttgcaccactacacttcagcttggaccacagagtgaggctccgtctcaaaaaaaaaaaaaaggaaaatttattcagaatcatccaacagagaatctgtgatggcttagtgtcgtcaagaaacatgataataataaatgcagtgagttccacctgcacaaacctgccaagacctgagccaggccgccagggctcgctttctctctcaccacagcggatgacatcactgcaacccaatcagaagaaagccagctttagctgtgactgatgacgtcaaaggttacaggtcttaataggtgaaaatccttttacttgggccttaaagctcttgaaattttttagttcagcatttgagaatcaaaaatatgccttttctggtccagaaagaaactatttgatttcttctgtcagcattttttttttaaattccactcagtgttgcttcagcgagattacctggccccagtggggaacacatggcaaggcgatttctgcagtcggcttgattccgacaaatgctgggtacggaaagagcttggatctggcctgagttcactcaagcgccatgtgtgcaaagtggctacgcctggcagcaaatgctccacatgccaacggccagagcacagccctagaccgatggcggtgcggctgaaccacgaggcctccgcagctatttatttcagagccttggttttatggctgtcattcagccttgggtgcgtggagagagtcagtctgcctgagtcaatgtctcatgctctctgcggctaaggtgaatgttgttctatcagtataatcgtcatgtatttgtctgagatagttgctaatttctacagtcagttctacagtctagctattgtgtacctaggaagtaacacaaaccattgttgttactgagcctggcaagttgcatcataaaattcaagcttccgaaagcaggtatttagtgtgaagaaagactggtaatgatagttttatcatcatctcagtcacctcttaaccatttcctgattcactcaggtggtttttaatggagtttcccaagttagtgtttcctgggagaatgtttggttcgttgccttctaacagcctccagctcttcaggcatctcaggcaggagagcgtgttggggccgggactctcctcccgtggacctgacaactctgccttccccggtgtggtctcgctgttccctttgagagtgcgatgctgccgcttcagccaggacgttctcaaaattagcagaagggcttccttcctgaaatcgtgcctatttaggattttcttagtcattacgaaaaagtatagatagagttcataaatgacttcatctattcggtatcaaatgaacaacacttcaggcatgttgaatgagcaatctaaaggaaacatttatttgtttaatttttccagtgccttcaataaggctttcatttccaaataactcctttgtgtattgctgttcatacaatggctatatatttaccatttaacagtattgccccaaagcgtaagagtgagaaaaatccaaatttgaattaaattctccctgagcctcgcagtggccgtcacacgttcccctcctgcttttcgcgtctctaggatctccgagtgtcttgactacaacaaaccgttcagagttctcaagacgcagggctcggtggcaagcaaagcgccacgggggacacacagcgcgtggaggctctggaagcagtggggtgcgtgggcccagacatacttccatggaggagaaagtgaccactgtatgctacaggaagcgtggctaattaggcttcctcagctggatggcaagctcccgggggtcttttttgtctcgcattgccctatagcgcggagtagatgcttagtctacagggaggacagcctgtgaaacagctgcagctgctgccacgacccacggcgttctgcaggacggaggagcaacgcgtcagcacacgtcccgggagtgacgtgggaagacctcgctctggccaccaaaccgtccttcctttctgtctttgcttccttcaccttcgattttttcctttctcctgtaatagtcataactaaagaacgtagaagaaagaatgaagtttgcacacagtctagaattgaaatggagaatacatcatcagaatcctaggtcatccaagcctcttgctggtccgtgtccacggagtggcagatatctttgtgaaatgtaaatgtgtcaggtgcagctccccattgcggtggccctcggtgacaagatatacggctgtcccttcacagccccaagctgagttcacgcagcccggaggatgctatcgctggacaagagaccagagaccgggatagacacgtgcgtcctagttctgaacaaaatggtatccggaaagagaaagcatcccatggggacagtttaaggaggtttagatagaaaaatgagtgtgcatattattcatgcttaaactgcttacatcatcaaaaacaccaatattcagaggaataaatgcacttaaaataattcttaaccaagaacaactttgaggcagtaggtcacatgcctcctgcatggagggatctccaagaacagaaactaaatccctcgttctcctctgcctgcctctcatctttccagaagcaccaggtctggcttaaaccattgctttcattctatttgtttgattataaataaaatatatcttttccatcatcaatgtatattttctagctcccagacataaaatccactccttgctttctaaattgaagtgtcattttcctaatcagaattgacaattgtaaataaccatttgggtttattcgttttaatgtcctattctcacaaacgtatttttcacgtgtcgcatgtatttaaaatggtgagttcaaacttaatcatctcaatttcaggccctcaaaaaactgtcaatgtagcaggtttgaaatggagacctcatgattcacctgcttctcaacatagttagaccccaaaccgtgcagggtcattgtttcagcatgaaaagtaaaggaggtgttccttttttggtcttttttctaccccaatgatacgcattctgcaaccacaaatattccaactccaactcactttttgaataagcaactcctattgtgttttgttcttttatcatttgaggttatacactgtggaaaaacaaaaaaagctacatagtttacttactcctatggtcaaattttttttaaaagtaagaacatgagataaagttctgcttgtcattgctgccttctggggcagtggaaaagcaggtgccttaagctttccattgtgtgcagatcttccacgccctttccctccatcaggaaaatatgtctgtctcctggtctattcagctcttgaccttctgactcatatgccgacaaaaggcaccatttatgagtgactaatgtatgtatctttgtccataaggaacttgatcacagcagccacaactcagcatcatcatcaactatcttttccgtgtgccctccaggggtttatgcaatgggctctgtcctatgcaaacaggccatgccaccttctccctaggtccacctctttcatgcctaggaggagtttatcagctataatttggggagaaggggcacacaaagatgagcccaactctgaggggacatttgtccctgctttggttggaatcctggaaagctgaagttgtttctaaaaagcacattctctgctgctgacctcccctgtcacgcagggtcctcccaccagcacctctgttcaaatcccctgttgcttttcatcctgcccaccttcttccttaacatcttttctttacacctgtagcaaatgtcaacaacgcctcctcccaacacgagcttcctcctcctctctcaatccaactcaaagtccttcgtggaaggctccccacaagcggagccaccgggcttcatctcccccgtgcagccattcctgcctgcaccttctcacgcctccgaacaccatgtcaatcttaagaaatataaacagaaaaaccggtggacttcaaatgcatatccatttacatgtttgtttttacaaagtgtatcgttgttttcctcaaaaacaatagggcaaggacccttttgtttcaaaatcttatctcttgtttatctgatatattctttttgttttgtttgtttgtttttgagacagggtcttactctttgcccaggctggagtgcagtggcgcgatcatggctcgttgcaacctcgaccacctgggctcaagtgatcctcccacctcagcctctcaagtagctgagattataggtacatgccaccacacctagctaattttttaatttcttttatagagatggggtcttgctgttgttgctcaggctggtctcaaactcctggtctcaagccatcctcccacatcagcctcccaaagtgctggtattacaggcatgagtcactgtatccagcatctctctctctctctctctctgttcctctctctcattcgtgtgtgtatatatatatacatatatatatataacattttgaatatttgggatgatcaaactttaaataaattgaaattcagctttacctgtgacagcacaaacacatgtactatgaggaacgaaaaacccacctaatcacaatggctttgtgaaccattttaaggtcatttattatgaataaatgacatgcactacagttgtgtgactcacaatctttttttttctgaaaattagtaatatatctgcctgccttcaccctcaccaaaagaaaagaataaggatagaaatttattgtgtgtatatcacagaagacagtgatatttctctaataagtttctggaaaaatcaagcaaaagaactgcttccctgtgctgtgtaggattgtaattgttatatttattctggtctgaaccattactaagtcttttttaaatgtctcgaatgactaattaaggataaaaggttggaaacaccatttttccctctattattttcacattcaaacaagataaacattgtgggtctacacttgaaatatgaataaaatgaattctttctctggtgaaatgcacattttcaagttgcactgaaggtccctggccccatggcactctctaggcctgagctgtcaccctcatcctactgggtcctcccagcccacctgtgtactttccttccaccatagataaggcaggacacactcatgacttgcttgctgggagaataaatgtcgttgaagcccttggtaacctaggagtggaatacaacagaaagcgtggaatgactatcgttagagaaaacaattgtggaatatctacacgcagaatggaaactaaggggccccatttttgtcagactccctcacccttggtaactcctgcagcttggatacaatcgcatatctctttccttagtgatttgagattgagtctgtggtgtagaggagaggctcttagccataggttcctggcctttgaaggccaccctaggaattgcttccctcgtagcatcagaggcagctgaagcggtcacttccagactctgcagctgacacacctccccggacttggggactccaaaactagcagtggcacaaactccctgcaaagccctgactgacaaatagctgtcatcccagcattgagtgatagttcgggagcagccagggcaggagaagcagcttcctcctgtcccacctgcacctggaatgagcaaaatgatttcaaggaactgaacacttggattactgggattcaggagaaagagtttgccatgtgttcaaaagcagcagagatgcgggtgggggctaagcctcattccaaagcagatccattttaaatcacacggaacgaacagcctgatctcacaatagactgttccttctaagtacaccgtgctgtgattttggaaaactcagggcccaagagaacactctgtatataatagatcaagaaagagagtccccgacttgtcatctttcttgtaactgtgattcacttacttttgtttactctgttattcctttattttaggttatttttcatcggctccaatctgggacttggtatttttgtacagttgccactgcttttaaaactccgcaagatcgtgtaaaaatcttgcatgtttgtgtctcctaataagcattcagagaaaatgcctagactgtgtaggacttttcgggaaattgcagagaagtaactggcctctttgtgtgtttgcatgcaccagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacattcaataaaactgttgaatctatattccaattacagcaggaaatttttccagcccattataacctcagctacagttgtaattaatgcctctagcctactagtgatctgggcttcaggggcttttcagtttatatttgggtgcaggtaggggaaaactagggagaggatggggtcagggttacgtgtgaaacgtaacttggcaaatatgtttaaaaaaaaaaaacaagggctagcttgaatccttgtctctccaccgtatggcacactgcatctcaggacctggtgtgttattgacaaaagtgttatctggcagtttgtttagggcttttaattatttttgaaaatgacttatatgtatcttaatgattactccttgaaacagatcaaaattcttccttggcaactcttcttccttgcttcctcccactagttggatgacttctcatagcacgcagtgggtctgatggccatttttggggattttattgagaccaaaaaggaaaaaaaaaaaaagacaaaagacatgcactttttcattcaattgaaaaagaaaaaagtgcccaaagggaagagcaactgtaagatagccccagatcgtggctcttcaggcacgtcagatgggagcttcaggcatttgaaacttagcccagaaaacttcataaagatggaacactgactttgcacacctgagagatgctgtaactgcttagaaatacatagccgaaagtatctcgttcctgtagcaaagtgcaacttctgcataaaatgaagaaatgaggccaggtgcagtggctcacgcctataatcccagcactttgggaggccaagaggggtggatcaggagttcgagaccagcctgaccaatatgatgaaaccccgattgtactaaaaatacaaaaattagccaggcatggcatcatgcgcctgtaatcccagctacttgggaggctgagacaggagaattgcttgaacctgggaggcggaggttgcagtgagccgagatcgtgccattgcactccagcttgggcaacaagagcgaaactccatctcaaaaaaaaaaaaaaaagaagtggagaagtggaatgtgtttctccatgcactaagcgtcagcctccaaactgttttcactatctaaggcataagtttctaaaggcaaacaccaattttgaaaatgagctcatcgttcatttccccttattactgtctcagcatgtgcaatctagcatctaaagagctaccgtcctgtttctgtaagcattttctacggtgaagggagaggcgtgattggataagacaaactgactttgttttttgttttttgagatggagttttgctcttgttgcccaggctggagtacaatggcgtgatctcagctcaccatgacctctgcctcctgggttcaagcgattcttctgcctcagcctcccaagtagctgggattacaggtgtgcgccaccatgcctggctaattttgtatttttagtaaagacagggtttctccatgttggttaggctggtcttgaactcccaacctcaggtgatctgccctcctcggcctcccaaagtgctggtattacaggcatgagccaccgcgcccggccgacaaattgactttgatgcataatatttggtaaaggcacagatagaagtagacatccacagattaaggcaggttattctgcaaactatgacattcaattgcatccatcagctggcgtcagtgaaacaatcaaaaggaacaccaaagtccataaggttattagttagaaggaccgtggcttgttggcgcctttgaaggctggtgctggaatggctctgacccggctctgttggcagctctggctgctgattcttcattatactcatgaaaactgcctggtagaggagcaagaagacctggccacttagccaagagccctaactttggaattaaaacatcaggctttggccaggcacggtggctcacatgcctgtaatcccagcactttgggaggccaaagtgggcagatcacctaagatcaggagttcgggaccagtctggccaacatagtgaaaccctgtctctactaaaaaatacaaaaattagccaggccttgtggcggacgcctgtaatcccagctactcaggaggctgaggcaggagaatcgcttgaacccggaaagtggaggttgcagtgagctgagtttgtgccactgcactccagcctgggtgagagagcaagactctgtctcaaaaaaataaaataaataaaataaaatcaggcttcattgacgagttctgtcacttatttgctctgctgccttgagcaagatactgaacctctctgaaactcacatcgcctcagctgtgaagtggggatgtcccctgcgtgctgcggaattataagctgtaggggtaacctatgaaaagtgctaccagagtttctgatacctgtcagacttttatttcaaagaaaaacaagtacaaaacatgactactctctacccgggcagagcgatatatatatctgagaactcctcagacaatatgatgcttcttacgtgcaatggtgagtttcttgtgaaaagaagataattttgcaaaaacccaaaataactatatagatagtatcatgttctctggaaattaaaaggcaaaataaaaccccaaaacccacatttttgttattttaatagaattagaaaagactgctttttccgatggtcagcccacctacgtctgccttctaaaataatacccgggtctcctgccaaataatttctgattaactcaacagagaaggaggaaatgtcagcagctttccggcctctgagcaagacaacagcttcttccacctgctacatttatacactgaaaccacctttctaagacagctaaaggaacggaatgatgaaaagtgggaaatactggggactgagtattaggcaagggtttttgtttgtcctcttatgactgttacatttactcgaagacaccattcaggtgttcaagtcagttaagagggaggcaaggaatgagatcttggacgccagggtaggggagctgggtgggaaggctgagccggtcactcaggagctggacagcctggagcgagtcactttgtctttcctcgcctgcagtacagcctctcttcccaggtcactgcgaggacacgatgatagatactacagcataatggttctggtgcaggagtgggagcccagcagaactgcgtttgaagtatctttctaccactgagtagctgtcttgtgaccttgggcaaattatgtaaatgctctaaaactcaactccctcttccaaaactgggctgtatgaggtctaccttgcaggtttgttacaagcgtcgcacacatgcatgtttgtccagggctccccgaggtccatggcgggatacccgtgaggatggagggatgttcctggggaagcagccaaccaagtacctggagaaaacaggtgctccgtcatcgtgtggtcccccaggagagccgggatctaatgtctgctgagccctcattggccggggtgggtggtctctggcccccaacaggcccaagtgagacggatgccaggatttgcagcccacacaccctcctggaagtcatctccatgggcacactgctcgctatgagagtatccttccctgcccatcgggtgggaagaatggcacatgatttttatggcctgactctacatgagaaatgtcagtcaaaaatatggcgttcaggctgggcgtggtggctcacacctgtaatcccagcactttgggaggctgagacaggtagatcacccaaggtcaggagtttgagaccagcttggccaacatggtgaaaccccgtctctactaaaaatacaaaaaataagccagacgtagtgtcagcagcctgtaatcccagctactcgggaggctgaggtgagagaattgcttaaacctggaggcagaggttgcagtaagctgagactgcatcattgcactccagcctgagcaacaagagcaaaactccatctcaaatatatacatatatatatatatatatatatatatatatatatatatatatatatatatacatagagagagagagagagagagttaaaaaactctgtgaaatggttacatccttaggaaatattattttcaaagctgaagatgatatcttaaacaacaacaacaacaaaaaaaacccttaagtccttctggggttgacctccatggatctctagcgaagtttcagtataggtcgtgggacatctcagactgctaatttagagaagctaaaactaaagagttttaagtctgtttcaacatgcactgctgcctgttttacttctgttggttattttgagaagttcatcacgagccttttgcaagcaaaagctgggaggctcaaagatggatcttctttcaaaggagtactatacctggggaaatgccctgtggatatttttctaaatataaattttgattctccaataggattttaaatggaatcagaaagcctcaaatgctttccaaacaattccctctacgaaagcttccttcattagaaatgtacccattgatcaaagtttgtccaaaatgtgacacttccaagatataaggaggctttgctttcagcaaagtgaaactgactttgaccaagttcccattcacaccacgtcgattcatgttcaccaaacatccagggcccggaaggaccttggcggtcacacagcttgtgggtcagcagtgcctagtcacacagaggtaaccagggcggtacccattctccaggatctgccacctccacacaggtgtccactggaggcttgctaggcagctcgtaaaacaccatattctttttcagaccaagaaaaaagagctttcccaagcacaaccaaccccatttttgttaaaatcgcctgtttgaagggacttaaagtttctattaccttttgtggagtagattcagtatttctttggtttcctagggaatctgagggagtctcctgtgtgcttggagggaaaggccactttaaaatgggcactctattatgattatttgtaatcatgacgttgtaatacaaaaggaagtcatcctcctctctgtcctgcaatgagaagacaataatacaagtatacttggcttaatcaagagcactttgcaacaggaagatatgtaccggtgttgaatccgattctaaaaatatctcccatcatctttgtttcttttgcagtcttaaatgtgtggatgcatgcaagctgcatggaaatccaaaacagaagtcaagctttgttttgaagaaaccctaactagcaaaccctagtttgctctccagttcaagtgctggtgatgatattaaagaagcgtgtagtagctatagaagaaactttctaagattctttccatggttgcctcaataagaaatgattctattccttttgcttgcacaatcttatccaattttagatctcactactgatatagctcggttcttcttacaagtaacttggcaattacccaattctcctatcagtagttaatgacatggacagatatgtggtggaaagtgccctttgcacattgattgatttgcatttctctgttacagaggttgacttttgctttccccagtgggaatatttgtaaggtacttggattctttattcatttttactttgccaagtttctgtaagtttaaatctgggtgaaaggatttgttctcttcctgtgcttgataagtgtaaaaatttattactttagcttcttttttatttagaatttattgggaaatattccctagcattgccttaagaatctgttggaaactctgcaccctctacccagacaagtgcacatgacatacagtattttgaagataatttgagggcatttacagatgttgtaatttccatctaagaaatggcagtgcttccattgagagaaggagaagagagaatgtaccgtccacctgcttagtgacaaccacccagggagcctgagggccactgcagtaaggacaggccgtgttgtgtgggaggtgcatgcatgctgagacggactgctccttctcagtcacctttgctgcgtctttctcctcttcctcacctctaaacaccgcaggcctcccaactcaagcctctgcctcacctctatttccaccaggtgacccgaccaatcccacggattcacatgccgtctgtgcatggccgattctcacatttgctctctggcctcaacttccccagcgcctgctgggcatttcccccaggatgccgaagagatcgatccaaaccgaatgcatggacccacctgactcccgccactctccgaccccgcaccctctccccgcggagggctccagctcagtgaacaggagctcacgtcaccacggggaccaaaatgccgggattcatcctcctttttttccacgtctgcacccagtccagtacaaatcctgtctacgacaccttcaagatctgcatctgaccaagtcccagcccctcgtcctcactctagtccaggtccctggctcccccagctgacccccaaccttgcaaggggtggccggatcctctacccggaagtcagtgaccctttaaacgccaataaggtccccatgctctcaaccctccaacggcttctgcctcccagctggggcacattccagatctctgctgcgggtgatgtgcggcctgaaggatgtggccctggttcctcctgagctgtttcttcctggtggtgttgggcccctctgtgggcagaggctgtgctggcttcgtccctgctccagcagcaggcccagcatatcctccccacagagcggtgcctggacgccccccacagtgttcactgagcctcctccctcccctggcctcactgtggtctctgctaagtgtcgctacctcagaagggccttccttgacgccatacctcttaatctctgtcgcctatggctttacttgcttcaaaacatggacgagtgtctgactgcagtacctatatgcttgatttttcacttatttctttaccgtgtgtctctaccctagggcgtgagctctgtgagagcagggagcgcctttcactatgacatctccctcgccaggaagcacgccctgggcctagtcagccttcaaaagacatttgttggctgggcccggtggttcacgcttgtaatcccaacactttgggaagctgaggcaggtggatcacctgaggtcaggagttccagaccagcctggccaacatggtgaaatcccgtctctactaaaaatacaatcattacccaggcatggtggtgctcgcctgtaattccagctactcaggaggttgaggcaggagaatctcttgaacccaggaggcagaggttgcagtgacccaagatcccgccactgcactccagcctgggcaacagagtgatactcctgggctttgccctcgtgtgtgacttaggcagggtgctgggctttgccgtcctgtctgacttaggcaggagcgctgggctatgctctcctgtctgatttaggcagggcgctgggctttgccctcatctctgacttaggcaggggcgctgagctttgccctcgtgtctgacttaggcaggggcgctgggctttgccctcctgtctgacttaggtaggggcgctgggctttggagcgtgtcctgtgtcaaaggtactgctgtcttgagggaagaattatcagcccaaggtaagattccttggagacactcaggctttggaaaacacaaatagatgctgctctcgtggagaaaggtgttcattattctgtttaaaccaagtcagaggaaagtattttaaataccctccaaagctcccggaaatgcagggcccacctgtctgttcaaagacagaccaacatccttcgtgtgagctgcagcctaagcaggggtctggtgtggacgccacgtgacacactcaccgtctcctccggatttctcactgggttcctctggggaccacgcaggacccgcactagatgagcatcactgaggctgcaagccggtgtgcagaccccttccagacgctcccccgccgtccagtgtgccctgtagaggactcagtgcaagtggcctcaaaaggccattcacattcacattctcagtgagaccaaagagaaggagaccaagtgtcctgacccctctgacagccagagttaccccagcacaccctagatcagcagttctcaaagtgggctcccggggcagcaacctcagcgtcacctgggagcttgggaagaggagctcgtgttcttagggccctccctagagccgctgaatcagaaactttgggatggggtctgtcaatctgtgtttggacaagttccccagtgactgtcacacaccatgaagtctgagaaccactgttccaaaccgaggcttctaactggatgttcattcccagccatttggaaggctcagctgaaagccagtgagccagaagccagctccactgatcctgctttccagactggccattctcacaatgttccattaggcaatagggctcttcggggaaattaatagaatgtaggcttcaggaatcatcagaaagctgcagcttccctcgtcagggaagctgacgtctacatcgtcctcagtctagaacaagaataataggtgtaccttagaaaaatgtgctttcagtccatcagtaaaaagccaatattgtaaaatcctattatctttgcttcaagtgttatcaaaaaaataataataataaaataaaggcttagaagtttcactgttcaacatggcatttcgaaatattcgatgtaattgttgtctttacatttgagacttttttaaaaaatgaatcatttccattaatacagaaagaaatctttctagtggaggctcaaaattcaaataatcagaatcagttcttctaaaatgacttacgtataatcttgtttgccagacactgaagtaagatgtctgtattagcattttctccattgccgcaggtttctgtctctgtgggttcgtgaaaacaacctacagccaaaactatgtccacatacagcaaacccacatgccacttgatttcatcaaatgcataataggggcattctagaaccagagctttaaatggcctttttgtctccttcctcatacatctggggcagcgaacatgacattaaaatgcagccagaaaaatgtcccataaagaactttattgacaacaaggtaaatttttaataactcttcagtaggcttcattcaagagggggtaatatgtcatatgagtaggatttttacagctctcataggaattccccatattaaaagaatgtttgcagtttagagagaacccaactgcaaaacattcctgaactgtgacaatatttgtctcaatctaatattatgtggtggatctttgtttgtggagaggggagaggctacgtcctgctggagtgatttttccatcaattcagggctcagcaaatatgacccaaacaaacaaccaaattgattaaaatgctttattgagaaggaagagattgagtcttggagacctgtttcaatagctactcatgtcaccagcagggcaaaggccacatagctgacaaataccaccacatctcacagaagaggctgaggcgtcctggccgaataatgctttattctggaaaagatctgtacgaatctgcaaagcagtgaaaatgtgtggacggcttctgtttcttcagccgcaagggaggccacccttcattgccggaggaaggcccgccctcccggctgtggttgctgtggagctcacaggggtgaaggcatgtggaaattcactgcaccatgccagcctgcaggactgggagcgtagttcccactaaagagcaaacactgtactgtttttccaaaaaaaaaaaaaaaagttaaaatctggatcccaatgtttgttcacagcagggctgtaaaacaagtagacaaagatctcaggggctttgtgacagcatggtggattggagttaaaaagaggtggtgtcatttggatacacagatagtctaggcgagccttgagag
